US008071561B2

(12) United States Patent
Sallberg et al.

(10) Patent No.: US 8,071,561 B2
(45) Date of Patent: Dec. 6, 2011

(54) IMMUNOGEN PLATFORM

(75) Inventors: Matti Sallberg, Stockholm (SE); Jonas Soderholm, Linghem (SE); Lars Frelin, Alvsjo (SE)

(73) Assignee: ChronTech Pharma AB, Huddinge (SE)

( * ) Notice: Subject to any disclaimer, the term of this patent is extended or adjusted under 35 U.S.C. 154(b) by 0 days.

(21) Appl. No.: 12/192,776

(22) Filed: Aug. 15, 2008

(65) Prior Publication Data

US 2009/0074803 A1 Mar. 19, 2009

Related U.S. Application Data

(60) Provisional application No. 60/956,326, filed on Aug. 16, 2007, provisional application No. 61/047,076, filed on Apr. 22, 2008.

(51) Int. Cl.
*A61K 48/00* (2006.01)
*C12N 15/63* (2006.01)
(52) U.S. Cl. ............... 514/44; 424/199.1; 424/202.1; 435/69.1
(58) Field of Classification Search .................. None
See application file for complete search history.

(56) References Cited

U.S. PATENT DOCUMENTS

| | | | |
|---|---|---|---|
| 4,215,051 A | 7/1980 | Schroeder et al. |
| 4,376,110 A | 3/1983 | David et al. |
| 4,486,530 A | 12/1984 | David et al. |
| 4,683,195 A | 7/1987 | Mullis et al. |
| 4,683,202 A | 7/1987 | Mullis |
| 4,818,540 A | 4/1989 | Chien et al. |
| 4,873,191 A | 10/1989 | Wagner et al. |
| 4,946,778 A | 8/1990 | Ladner et al. |
| 4,950,647 A | 8/1990 | Robins et al. |
| 4,965,188 A | 10/1990 | Mullis |
| 5,143,854 A | 9/1992 | Pirrung et al. |
| 5,290,678 A | 3/1994 | Jackowski |
| 5,322,770 A | 6/1994 | Gelfand |
| 5,350,671 A | 9/1994 | Houghton et al. |
| 5,371,017 A | 12/1994 | Houghton et al. |
| 5,372,928 A | 12/1994 | Miyamura et al. |
| 5,412,087 A | 5/1995 | McGall et al. |
| 5,585,258 A | 12/1996 | Houghton et al. |
| 5,589,466 A | 12/1996 | Felgner et al. |
| 5,593,972 A | 1/1997 | Weiner et al. |
| 5,597,691 A | 1/1997 | Houghton et al. |
| 5,604,105 A | 2/1997 | Jackowski |
| 5,670,152 A | 9/1997 | Weiner et al. |
| 5,670,153 A | 9/1997 | Weiner et al. |
| 5,679,342 A | 10/1997 | Houghton et al. |
| 5,683,864 A | 11/1997 | Houghton et al. |
| 5,698,390 A | 12/1997 | Houghton et al. |
| 5,710,008 A | 1/1998 | Jackowski |
| 5,712,087 A | 1/1998 | Houghton et al. |
| 5,712,088 A | 1/1998 | Houghton et al. |
| 5,712,145 A | 1/1998 | Houghton et al. |
| 5,714,596 A | 2/1998 | Houghton et al. |
| 5,728,520 A | 3/1998 | Weiner et al. |
| 5,739,118 A | 4/1998 | Carrano et al. |
| 5,744,358 A | 4/1998 | Jackowski |
| 5,747,274 A | 5/1998 | Jackowski |
| 5,756,312 A | 5/1998 | Weiner et al. |
| 5,766,845 A | 6/1998 | Weiner et al. |
| 5,767,097 A | 6/1998 | Tam |
| 5,843,752 A | 12/1998 | Dasmahapatra et al. |
| 5,847,101 A | 12/1998 | Okayama et al. |
| 5,856,437 A | 1/1999 | Miyamura et al. |
| 5,863,719 A | 1/1999 | Houghton et al. |
| 5,871,903 A | 2/1999 | Miyamura et al. |
| 5,879,904 A | 3/1999 | Brechot et al. |
| 5,885,799 A | 3/1999 | Houghton et al. |
| 5,932,556 A | 8/1999 | Tam |
| 5,942,234 A | 8/1999 | Ralston et al. |
| 5,959,092 A | 9/1999 | Miyamura et al. |
| 5,968,775 A | 10/1999 | Houghton et al. |
| 5,980,901 A | 11/1999 | Shih et al. |
| 5,989,905 A | 11/1999 | Houghton et al. |
| 6,020,167 A | 2/2000 | Thoma |
| 6,022,543 A | 2/2000 | Thoma |
| 6,027,729 A | 2/2000 | Houghton et al. |
| 6,056,961 A | 5/2000 | Lavie et al. |
| 6,060,068 A | 5/2000 | Doyle et al. |
| 6,063,380 A | 5/2000 | Chedid et al. |
| 6,063,772 A | 5/2000 | Tam |
| 6,071,693 A | 6/2000 | Cha et al. |
| 6,072,049 A | 6/2000 | Thoma |
| 6,074,816 A | 6/2000 | Houghton et al. |
| 6,074,846 A | 6/2000 | Ralston et al. |

(Continued)

FOREIGN PATENT DOCUMENTS

EP 0 388 232 9/1990

(Continued)

OTHER PUBLICATIONS

Mihailova et al. Vaccine, 2006, vol. 24, pp. 4369-4377.*
Lin et al. J. Clin. Microbio. 2005, vol. 43, No. 8, pp. 3917-3924.*
Grakoui et al. Pro. Natl. Acad. USA, 1993, vol. 90, pp. 10583-10587.*
U.S. Appl. No. 08/008,342, filed Jan. 26, 1993, Weiner et al.
U.S. Appl. No. 08/029,336, Mar. 11, 1993, Weiner et al.
Abrignani et al., "Perspectives for a vaccine against hepatitis C virus," Journal of Hepatology, 31: (suppl. 1 ):259-263 (1999).
Andre et al., "Increased Immune Response Elicited by DNA Vaccination with a Synthetic gp120 Sequence with Optimized Codon Usage," Journal of Virology, 72(2):1497-1503 (1998).

(Continued)

*Primary Examiner* — Bao Li
(74) *Attorney, Agent, or Firm* — Knobbe Martens Olson & Bear LLP

(57) ABSTRACT

Aspects of the present invention relate to chimeric polypeptides including HCV NS3/4A sequences and T-cell epitopes. Embodiments include nucleic acids encoding the chimeric NS3/4A polypeptides, the encoded polypeptides, compositions containing said nucleic acids, compositions containing said chimeric polypeptides, as well as methods of making and using the aforementioned compositions including, but not limited to medicaments and vaccines.

8 Claims, 41 Drawing Sheets

U.S. PATENT DOCUMENTS

| | | | |
|---|---|---|---|
| 6,074,852 | A | 6/2000 | Ralston et al. |
| 6,096,541 | A | 8/2000 | Houghton et al. |
| 6,130,326 | A | 10/2000 | Ramasamy et al. |
| 6,150,087 | A | 11/2000 | Chien |
| 6,150,337 | A | 11/2000 | Tam |
| 6,153,421 | A | 11/2000 | Yanagi et al. |
| 6,171,782 | B1 | 1/2001 | Houghton et al. |
| 6,190,864 | B1 | 2/2001 | Cha et al. |
| 6,194,140 | B1 | 2/2001 | Houghton et al. |
| 6,214,583 | B1 | 4/2001 | Cha et al. |
| 6,231,864 | B1 | 5/2001 | Birkett |
| 6,235,888 | B1 | 5/2001 | Pachuk et al. |
| 6,274,148 | B1 | 8/2001 | Ralston et al. |
| 6,297,370 | B1 | 10/2001 | Cha et al. |
| 6,303,292 | B1 | 10/2001 | Weiner et al. |
| 6,312,889 | B1 | 11/2001 | Houghton et al. |
| 6,514,731 | B1 | 2/2003 | Valenzuela et al. |
| 6,518,014 | B1 | 2/2003 | Seifer et al. |
| 6,541,011 | B2 | 4/2003 | Punnonen et al. |
| 6,555,114 | B1 | 4/2003 | Maertens et al. |
| 6,653,125 | B2 | 11/2003 | Donnelly et al. |
| 6,680,059 | B2 | 1/2004 | Sallberg et al. |
| 6,733,993 | B2 | 5/2004 | Emini et al. |
| 6,762,024 | B2 | 7/2004 | Maertens et al. |
| 6,858,590 | B2 | 2/2005 | Sallberg et al. |
| 6,942,866 | B2 | 9/2005 | Birkett |
| 6,960,569 | B2 | 11/2005 | Sallberg |
| 6,974,864 | B2 | 12/2005 | Maertens et al. |
| 7,001,760 | B2 | 2/2006 | Ryu et al. |
| 7,056,658 | B2 | 6/2006 | Valenzuela et al. |
| 7,105,303 | B2 | 9/2006 | Ralston et al. |
| 7,122,306 | B2 | 10/2006 | Maertens et al. |
| 7,144,712 | B2 * | 12/2006 | Milich et al. ............ 435/69.3 |
| 7,320,795 | B2 | 1/2008 | Milich et al. |
| 7,598,362 | B2 | 10/2009 | Emini et al. |
| 2002/0165172 | A1 | 11/2002 | Sallberg et al. |
| 2002/0187945 | A1 | 12/2002 | Tam |
| 2003/0007977 | A1 | 1/2003 | Wheeler et al. |
| 2003/0008274 | A1 | 1/2003 | Maerterns et al. |
| 2003/0044421 | A1 | 3/2003 | Emini et al. |
| 2003/0054337 | A1 | 3/2003 | Birkett |
| 2003/0138769 | A1 | 7/2003 | Birkett |
| 2003/0175296 | A1 | 9/2003 | Brown et al. |
| 2003/0175863 | A1 | 9/2003 | Birkett |
| 2003/0185858 | A1 | 10/2003 | Birkett |
| 2003/0198645 | A1 | 10/2003 | Page et al. |
| 2003/0202982 | A1 | 10/2003 | Birkett |
| 2003/0206919 | A1 | 11/2003 | Sallberg |
| 2004/0092730 | A1 | 5/2004 | Sallberg |
| 2004/0101957 | A1 | 5/2004 | Emini et al. |
| 2004/0121465 | A1 | 6/2004 | Robinson |
| 2004/0146524 | A1 | 7/2004 | Lyons |
| 2004/0156863 | A1 | 8/2004 | Page et al. |
| 2004/0156864 | A1 | 8/2004 | Birkett |
| 2004/0209241 | A1 | 10/2004 | Hermanson et al. |
| 2005/0025781 | A1 | 2/2005 | Milich et al. |
| 2005/0025782 | A1 | 2/2005 | Milich et al. |
| 2005/0070017 | A1 | 3/2005 | Emini et al. |
| 2005/0208068 | A1 | 9/2005 | Milich et al. |
| 2006/0115489 | A1 | 6/2006 | Birkett et al. |
| 2006/0183705 | A1 | 8/2006 | Sallberg |
| 2008/0131452 | A1 | 6/2008 | Milich et al. |

FOREIGN PATENT DOCUMENTS

| | | |
|---|---|---|
| EP | 0 414 475 | 2/1991 |
| EP | 0 421 635 A1 | 4/1991 |
| EP | 0 421 635 B1 | 4/1991 |
| EP | 0 450 931 | 6/1996 |
| EP | 0 543 924 | 6/1997 |
| EP | 0 842 947 | 5/1998 |
| EP | 0 746 333 B1 | 5/1999 |
| EP | 0 693 687 | 7/1999 |
| EP | 0 556 292 | 12/1999 |
| EP | 1 034 785 | 9/2000 |
| EP | 0 318 216 | 8/2001 |
| EP | 0 398 748 | 1/2002 |
| EP | 1 054 689 B1 | 10/2003 |
| EP | 1 212 358 B1 | 12/2004 |
| WO | WO 90/15070 | 12/1990 |
| WO | WO 91/15575 | 10/1991 |
| WO | WO 92/10092 | 6/1992 |
| WO | WO 92/19743 | 11/1992 |
| WO | WO 93/00365 | 1/1993 |
| WO | WO 93/06126 | 4/1993 |
| WO | WO 94/11530 | 5/1994 |
| WO | WO 94/12305 | 6/1994 |
| WO | WO 94/16737 | 8/1994 |
| WO | WO 95/11995 | 5/1995 |
| WO | WO 96/09805 | 4/1996 |
| WO | WO 96/28162 | 9/1996 |
| WO | WO 96/33739 | 10/1996 |
| WO | WO 97/12043 | 4/1997 |
| WO | WO 97/26883 | 7/1997 |
| WO | WO 97/29212 | 8/1997 |
| WO | WO 97/31256 | 8/1997 |
| WO | WO 97/47358 | 12/1997 |
| WO | WO 98/16184 | 4/1998 |
| WO | WO 98/16186 | 4/1998 |
| WO | WO 98/30223 | 7/1998 |
| WO | WO 98/34640 | 8/1998 |
| WO | WO 98/37180 | 8/1998 |
| WO | WO 99/04008 | 1/1999 |
| WO | WO 99/28482 | 6/1999 |
| WO | WO 99/40934 | 8/1999 |
| WO | WO 00/44388 | 8/2000 |
| WO | WO 00/45823 | 8/2000 |
| WO | WO 01/38360 | 5/2001 |
| WO | WO 01/43693 | 6/2001 |
| WO | WO 01/45748 | 6/2001 |
| WO | WO 01/77158 | 10/2001 |
| WO | WO 01/96875 | 12/2001 |
| WO | WO 02/13765 | 2/2002 |
| WO | WO 02/13855 | 2/2002 |
| WO | WO 02/14362 | 2/2002 |
| WO | WO 02/14478 A2 | 2/2002 |
| WO | WO 02/22080 | 3/2002 |
| WO | WO 03/031588 | 4/2003 |
| WO | WO 03/072722 | 9/2003 |
| WO | WO 03/072731 | 9/2003 |
| WO | WO 03/102165 | 12/2003 |
| WO | WO 2004/007678 | 1/2004 |
| WO | WO 2004/024067 | 3/2004 |
| WO | WO 2004/046176 | 6/2004 |
| WO | WO 2004/048403 A | 6/2004 |
| WO | WO 2004/053091 | 6/2004 |
| WO | WO 2004/055187 | 7/2004 |
| WO | WO 2004/075836 | 9/2004 |
| WO | WO 2005/009379 | 2/2005 |
| WO | WO 2005/011571 | 2/2005 |
| WO | WO 2005/055957 | 6/2005 |
| WO | WO 2006/042027 | 4/2006 |
| WO | WO 2008/020656 | 2/2008 |

OTHER PUBLICATIONS

Bartenschlager et al., "Substrate Determinants for Cleavage in cis and in trans by the Hapatitis C Virus NS3 Proteinase," Journal of Virology, 69(1): 198-205 (1995).

Bitter et al., "Expression and Secretion Vectors for Yeast," Methods in Enzymol., 153:516-544 (1987).

Blastn 2.2.9., "Taxonomy Reports: Distribution of 100 Blast Hits on the Query Sequence," May 1, 2004, pp. 1-155.

Chang et al., "Meta-analysis: Ribavirin-induced Haemolytic Anaemia in Patients with Chronic Hepatitis C," Aliment Pharmacol Ther., 16(9): 1623-1632 (2002).

Chen et al., "Detection of Hepatitis C Virus RNA in the Cell Fraction of Saliva Before and After Oral Surgery," J. Med. Virol., 43:223-226 (1995).

Chen et al., "Human and Murine Antibody Recognition is Focused on the ATPase/Helicase, but not the Protease Domain of the Hepatitis C Virus Nonstructural 3 Protein," Hepatalogy, 28(1):219-224 (1998).

Chiang at al., "Enhancement of Hepatitis C Virus Core Antigen-specific Type 1 T Helper Cell Response by Ribavirin Correlates with the Increased Level of IL-12," Vaccine Strategies Against Microbial Pathogens, 42.11, p. A949 Apr. 20, 2000.

Colbérre-Garapin et al., "A New Dominant Hybrid selective Marker for Higher Eukaryotic Cells," J. Mol. Biol. 150:1-14 (1981).
Cote et al., "Generation of Human Monoclonal Antibodies Reactive with Cellular Antigens" Proc Natl. Acad. Sci., 80:2026-2030 (1983).
Cotonat et al., "Pilot Study of Combination Therapy with Ribavirin and Interferon Alfa for the Retreatment of Chronic Hepatitis B e Antibody-Positive Patients", Hepatology, 31(2):502-506 (2000).
Cramp et al., "Hepatitis C Virus-Specific T-Cell Reactivity During Interferon and Ribavirin Treatment in Chronic Hepatitis C," Gastroenterol., 118:346-355 (2000).
Database Genbank [Online] Dec. 2, 1994, retrieved from NCBI Database accession No. IO6434, XP002278035.
Database Registry [Online] No. 511600-20-7, XP02278058 abstract & WO 03/031588A, Apr. 17, 2003, Seq ID No. 1, 10 and 11 Claims.
Davis et al., "Plasmid DNA is Superior to Viral Vectors for Direct Gene Transfer into Adult Mouse Skeletal Muscle," Human Gene Therapy, 4(6):733-740 (1993).
Diepolder et al., "Possible Mechanism Involving T-Lymphocyte Response to Non-Structural Protein 3 in Viral Clearance in Acute Hepatitis C Virus Infection," Lancet, 346(8981):1006-1007 (1995).
Encke et al., "DNA Vaccines," Intervirology, 42:117-124 (1999).
Encke et al., "Genetic Immunization Generates Cellular and Humoral Immune Responses Against the Nonstructural Proteins of the Hepatitis C Virus in a Murine Model," Journal of Immunology, 161:4917-4923 (1998).
Engvall, E., "Enzyme Immunoassay ELISA and EMIT," Meth. Enzymol, 70:419-439 (1980).
Fang et al., "Ribavirin Enhancement of Hepatitis C Virus Core Antigen-specific Type 1 T Helper Cell response Correlates with the Increased IL-12 Level," Journal of Hepatology, 33(5):791-798 (2000).
Fodor et al., "Light-directed, Spatially Addressable Parallel Chemical Synthesis," Science, 251(4995):767-773 (1991).
Forns et al., "Hepatitis C Virus Lacking the Hypervariable Region 1 of the Second Envelope Protein is Infectious and Causes Acute Resolving or Persistent Infection in Chimpanzees," PNAS, 97(24):13318-113323 (2000).
Frelin et al., "Low Dose and Gene Gun Immunization with a Hepatitis C Virus Nonstructural (NS) 3 DNA-based Vaccine Containing NS4A Inhibit NS3/4A-expressing Tumors in vivo," Gene Thera., 10:686-699 (Jan. 2003) XP 002285892.
Frelin et al., "Codon Optimization and mRNA Amplification Effectively enhances the immunogenicity of the Hepatitis C Virus Nonstructural 3/4A Gene," Gene Thera., 11:522-533 (Jan. 2004) XP002285893.
Gordon et al., "Immune Responses to Hepatitis C Virus Structural and Nonstructural Proteins Induced by Plasmid DNA Immunizations," J Infect Dis., 181(1 ):42-50 (2000).
Grakoui et al., "A Second Hepatitis C Virus-Encoded Proteinase," Proc. Natl. Acad. Sci USA, 90:10583-10587 (1993).
Hahm et al., "NS3-4A of Hepatitis C Virus is a Chymotrypsin-Like Protease," Journal of Virology, 69(4): 2534-2539 (1995).
Heagy et al., "Inhibition of Immune Functions by Antiviral Drugs," J. Clin. Invest., 87:1916-1924 (1991).
Hosoya et al., "Comparative Inhibitory Effects of Various Nucleoside and Nonnucleoside Analogues on Replication of Influenza Virus Types A and B in Vitro and in Ovo," J Infect Dis., 168:641-646 (1993).
Houghten, "General Method for the Rapid Solid-Phase Synthesis of large Numbers of Peptides: Specificity of Antigen—Antibody Interaction at the Level of Individual Amino Acids," Proc Natl Acad Sci. USA, 82(15):5131-5135 (1985).
Hsu et al., "Prospects for a Hepatitis C Virus Vaccine", Clin Liver Dis., 3(4):901-915 (1999).
Http://www.msi.com/life/products/cerius2/modules/analogbuilder. html, C2 Analog Builder, Jul. 6, 2000.
Huffman et al., "In Vitro Effect of 1-beta-D-Ribofuranosyl-1,2,4-Triazole-3-Carboxamide (Virazole, ICN 1229) on Deoxyribonucleic Acid and Ribonucleic Acid Viruses," Antimicrob Agents Chemother., 3(2):235-241 (1973).
Hultgren et al., "The Antiviral Compound Ribavirin Modulates the T Helper (Th) 1/TH2 Subset Balance in Hepatitis B and C Virus-specific Immune Responses," J Gene Virol., 79:2381-2391 (1998).
Hultgren et al., "Antibodies to the Hepatitis B e Antigen (HBeAG) can be Induced in HBeAG-transgenic mice by Adoptive Transfer of a Specific T-Helper 2 Cell Clone," Clin. Diagn. Lab. Immunol. 4(5):630-632 (1997).
Huse et al., "Generation of a Large Combinatorial Library of the Immunoglobulin Repertoire in Phage Lambda," Science 246:1275-1281 (1989).
Hutchison et al., "Mutagenesis at a Specific Position in a DNA Sequence," Proc. Natl. Acad. Sci. USA 253(18):6551-6560 (1978).
Janknecht et al., "Rapid and Efficient Purification of Native Histidine-tagged Protein Expressed by Recombinant Vaccinia Virus," Proc. Natl. Acad. Sci. USA, 88:8972-8976 (1991).
Jin et al., "Expression, Isolation, and Characterization of the Hepatitis C Virus ATPase/RNA Helicase," Arch Biochem Bioplys., 323(1):47-53 (1995).
Kakumu et al., "Pilot Study of Ribavirin and Interferon-β for Chronic Hepatitis B," Hepatology, 18(2):258-263 (1993).
Kato, "Genome of Human Hepatitis C Virus (HCV): Gene Organization, Sequence Diversity, and Variation," Microb Com Genomics, 5(3):129-151 (2000).
Kolykhalov et al., "Specificity of the Hepatitis C Virus NS3 Serine Protease: Effects of Substitutions at the 3/4A, 4A/4B, 4B/5A, and 5A/5B Cleavage Sites on Polyprotein Processing," 68(11):7525-7533 Nov. 1994); XP002077834.
Kozbor et al., "The Production of Monoclonal Antibodies from Human Lymphocytes," Immunol Today 4(3):72-79 (1983).
Kumar et al, "Sequence, Expression and Reconstitution of an HCV Genome from a British Isolate Derived from a Single Blood Donation," J Viral Hepatitis, 7:459-465 (2000).
Kumar, "Hepatitis C Virus Genomic RNA for Polyprotein Gene," (2000) Abstract XP-002203418; AC #AJ278830.
Kwong et al., "Structure and Function of Hepatitis C Virus NS3 Helicase," Curr Top Microbiol Immunol., 242:171-196 (2000).
Kwong et at., "Hepatitis C Virus NS3/4A Protease," Antiviral Res., 41(1):67-84 (1999).
Lawrence, "Advances in the Treatment of Hepatitis C," Adv Intern Med., 45(3):65-105 (2000).
Lazdina et al., "Humoral and CD4+ T helper (Th) Cell Responses to the Hepatitis C Virus Non-structural 3 (NS3) Protein: NS3 Primes TH 1-like Responses More Effectively as a DNA-based Immunogen than as a Recombinant Protein," Journal of General Virology, 82:1299-1308 (2001).
Li et al., "Role of the Guanosine Triphosphatase Rac2 in T Helper 1 Cell Differentiation," Science, 288:2219-2222 (2000).
Lo, "Transformation by Iontophoretic Microinjection of DNA: Multiple Integrations Without Tandem Insertions," Mol. Cell. Biol., 3(10):1803-1814 (1983).
Logan et al., "Adenovirus Tripartite Leader Sequence Enhances Translation of mRNAs Late After Infection," Proc. Natl. Acad. Sci. USA 81:3655-3659 (1984).
Lohnmann et al., "Replication of Subgenomic Hepatitis C Virus RNAs in a Hepatoma Cell Line," Science, 285:110-113 (1999).
Lowy et al., "Isolation of Transforming DNA: Cloning the Hamster aprt Gene," Cell, 22:817 (1980).
Marquardt et al., "Ribavirin Inhibits Mast Cell Mediator Release," J Pharmacol Exp Thera., 240(1):145-149 (1987).
Marshall et al., "Detection of HCV RNA by the Asymmetric Gap Ligase Chain Reaction," PCR Methods and Applications, 4(2):80-84 (1994).
Memar et al., "Antiviral Agents in Dermatology; Current Status and Future Prospects," Inter'l J Derma., 34(9):597-606 (1995).
Missale et al., "Different Clinical Behaviors of Acute Hepatitis C Virus Infection are Associated with Different Vigor of the Anti-viral Cell-mediated Immune Response," J. Clin. Invest., 98(3):706-714 (1996).
Morrison et al. "Chimeric Human Antibody Molecules: Mouse Antigen-binding Domains with Human Constant Region Domains," Proc. Natl. Acad. Sci. USA 81:6851-6855 (1984).
Mulligan et al., "Selection for Animal Cells that Express the Escherichia coli Gene Coding for Xanthine-guanine Phosphoribosyltransferase," Proc. Natl. Acad. Sci. USA 78(4):2072-2076 (1981).

NCBI, Genbank, Accession No. M32084. Hepatitis C Virus, Han et al., 2 pages [Gi:32987] Aug. 2, 1993.
Neuberger et al., "Recombinant Antibodies Possessing Novel Effector Functions," Nature, 312:604-608 (1984).
O'Hare et al., "Transformation of Mouse Fibroblasts to Methotrexate Resistance by a Recombinant Plasmid Expressing a Prokaryotic Dihydrofolate Reductase," Proc. Natl. Acad. Sci. USA 78(3):1527-1531 (1981).
Orlandi et al., "Cloning Immunoglobulin Variable Domains for Expression by the Polymerase Chain Reaction," Proc. Natl. Acad. Sci. 86: 3833-3837 (1989).
Pape et al., "Role of the Specific T-Cell Response for Clearance and Control of Hepatitis C Virus," J. Viral. Hepat., 6(Supp. 1):36-40 (1999).
Park et al., "Monitoring Antibody Titers to Recombinant Core-NS3 Fusion Polypeptide is Useful for Evaluating Hepatitis C Virus Infection and Responses to Interferon-alpha Therapy," J Korean Med Sci., 14(2):165-170 (Apr. 1999), XP 000980030.
Peavy at al., "Inhibition of Murine Plaque-forming Cell Responses in vivo by Ribavirin," J. Immunology, 126(3):861-864 (1981).
Powers et al., "Selective Inhibition of Functional Lymphocyte Subpopulations by Ribavirin," Antimicrob Agents Chemother., 22(1):108-114 (1982).
Proust et al., "Two Successive Hepatitis C Virus Infections in an Intravenous Drug User," J Clin Microbiology, 38(8):3125-3127 (2000).
Ramasamy et al., "Monocyclic L-Nucleosides with Type 1 Cytokine-Inducing Activity," J Med Chem., 43(5):1019-1028 (2000).
Rosen et al., "Hepatitis C Virus NS5A Sequence Configuration does not Predict Response to Induction Interferon Plus Ribavirin," Hepatology, p. 394A (2000), AASLD Abstracts 940.
Rudikoff et al., "Single Amino Acid Substitution Altering Antigen-binding Specificity," Immunology, 79:1979-1983 (1982).
Rüther et al., "Easy Identification of cDNA Clones," EMBO J., 2(10):1791-1794 (1983).
Santerre et al., "Expression of Prokaryotic Genes for Hygromycin B and G418 Resistance as Dominant-selection Markers in Mouse L Cells," Gene. 30:147-156 (1984).
Schulof et al., "Clinical, Virologic, and Immunologic Effects of Combination Therapy with Ribavirin and Isoprinosine in HIV-Infected Homosexual Men," J Acqu Imm Def Syndromes. 3(5):485-492 (1990).
Shimizu et al., "Identification of the Sequence on NS4A Required for Enhanced Cleavage of the NS5A/5B Site by Hepatitis C Virus NS3 Protease," J Virol., 70(1):127-132 (Jan. 1996); XP 000577885.
Sidwell at al., "Broad-spectrum Antiviral Activity of Virazole: 1-$\beta$-D-Ribofuranosyl-1,2,4-triazole-3-carboxamide," Science, 177(50):705-706 (1972).
Smith at al., "Molecular Engineering of the *Autographa califomica* Nuclear Polyhedrosis Virus Genome: Deletion Mutations Within the Polyhedrin Gene," J Virology, 46(2):584-593 (1983).
Spector et al., "The Antiviral Effect of Zidovudine and Ribavirin in Clinical Trials and the Use of p24 Antigen Levels as a Virologic Marker," J Infect Dis., 159(5):822-828 (1989).
Steigerwald-Mullen et al., "Type 2 Cytokines Predominate in the Human CD4+ T-Lymphocyte Response to Epstein-Barr Virus Nuclear Antigen 1," J. Virol., 74(15):6748-6759 (2000).
Szybalska et al., "Genetics of Human Cell Lines, IV. DNA-Mediated Heritable Transformation of a Biochemical Trait," Proc Natl Acad Sci USA, 48:2026-2034 (1962).
Takeda et al., "Construction of Chimaeric Processed Immunoglobulin Genes Containing Mouse Variable and Human Constant Region Sequences," Nature, 314:452-454 (1985).
Tam et al., "Ribavirin Polarizes Human T Cell Responses Towards a Type 1 Cytokine Profile," J Hepatology, 30(3):376-382 (1999).
Tam et al., "The Immunomodulatory Effects of Ribavirin: Recent findings," International Antiviral News, 7(6):99-100 (1999)—Abstract XP-002203415.
Tan et al., "How Hepatitis C Virus Counteracts the Interferon Response: The Jury is still out on NS5A," Virology, 284(1):1-12 (2001).
Thompson et al., "Germ Line Transmission and Expression of a Corrected HPRT Gene Produced by Gene Targeting in Embryonic Stem Cells," Cell, 56:313-321 (1989).
Townsend et al., "Characterization of CD8+ Cytotoxic T-Lymphocyte Responses after Genetic Immunization with Retrovirus Vectors Expressing Different Forms of the Hepatitis B Virus Core and e Antigens," J Virol., 71(5):3365-3374 (1997).
Vaitukaitis et al., "A Method for Producing Specific Antisera with Small Doses of Immunogen," J Clin. Endocr., 33(6):988-991 (1971).
Van Der Putten et al., "Efficient Insertion of Genes Into the Mouse Germ Line via Retroviral Vectors," Proc. Natl. Acad. Sci., USA 82:6148-6152 (1985).
Walsh et al., "Update on Chronic Viral Hepatitis," Postgrad Med Journal, 77(910):498-505 (2001).
Wang et al., "Synthesis and Cytokine Modulation Properties of Pyrrolo[2,3,-*d*]-4-pyrimidone Nucleosides," J Med Chem., 43(13):2566-2574 (2000).
Wigler et al., "Transfer of Purified Herpes Virus Thymidine Kinase Gene to Cultured Mouse Cells," Cell, 11:223-232 (1977).
Wigler et al., "Transformation of Mammalian Cells with an Amplifiable Dominant-acting Gene," Proc. Natl. Acad. Sci. USA 77:3567-3570 (1980).
Winter et al., "Man-made Antibodies," Nature 349:293-299 (1991).
Yamada et al., "Critical Point Mutations for Hepatitis C Virus NS3 Proteinase," Virol., 246(1):104-112 (Jun. 1998), XP004445779.
Yang et al., "Internal Cleavage of Hepatitis C Virus NS3 Protein is Dependent on the Activity of NS34A Protease," Virol., 268(1):132-140 (Mar. 2000) XP004436137.
Zhang et al., "Characterization of a Monoclonal Antibody and its Single-chain Antibody Fragment Recognizing the Nucleoside Triphosphatase/Helicase Domain of the Hepatitis C Virus Nonstructural 3 Protein," Clin Diagn Lab Immunol., 7(1):58-63 (2000).
Zhang et al., "Interferon-alpha Treatment Induces Delayed CD4 Proliferative Responses to the Hepatitis C Virus Nonstructural Protein 3 Regardless of the Outcome of Therapy," J Infect Dis., 175:1294-1301 (1997).
Zhang et al., "Molecular Basis for Antibody Cross-reactivity Between the Hepatitis C Virus Core Protein and the host-derived GOR Protein," Clin Exp Immunol., 96(3):403-409 (1994).
Partial International Search Report dated Apr. 27, 2009 from PCT/IB2008/003047, filed Aug. 15, 2008.
Billaud, et al., "Advantages to the use of rodent hepadnavirus core proteins as vaccine platforms," *Vaccine*, 25:1593-1606 (2007).
Cooper, et al., "Analysis of a Successful Immune Response against Hepatitis C Virus," *Immunity*, 10:439-449 (Apr. 1999).
Database Geneseq, "HCV NS3-NS4A protease and HBV antigen construct DNA Seq ID:1184," XP-002590182 retrieved from EBI accession No. GSN:AWI31632, Apr. 30, 2009.
Frelin, et al., "Codon optimization and mRNA amplification effectively enhances the immunogenicity of the hepatitis C virus nonstructural ¾A gene," *Gene Therapy*, 11:522-533 (2004).
Invitation to Pay Fees dated Jul. 30, 2010 received in PCT/IB201/000324, filed Jan. 29, 2010.
Nagata, et al., "Codon Optimization Effect on Translational Efficiency of DNA Vaccine in Mammalian Cells: Analysis of Plasmid DNA Encoding a CTL Epitope Derived from Microorganisms," *Biochem. and Biophys. Res. Communications* 261:445-451 (1999).
Park, et al., "Monitoring Antibody Titers to Recombinant Core-NS3 Fusion Polypeptide is Useful for . . . ," *J. Korean Med. Sci.* 14:165-70 (1999).
Patent Application No. GB 0226722.7, filed Nov. 15, 2002 to Glaxo Group Limited, publicly available Jun. 3, 2004 (publication date of PCT/EP03/12830 which claims priority to this application).
Sällberg, et al., "A Malaria Vaccine Candidate Based on a Hepatitis B Virus Core Platform," *Intervirology*, 45:350-361 (2002).
Schulze zur Wiesch, et al., "Broad Repertoire of the CD4+ Th Cell Response in Spontaneously Controlled Hepatitis C Virus Infection Includes Dominant and Highly Promiscuous Epitopes," *J. Immunol.* 175:3603-3613 (2005).
Xing, et al., "Novel DNA vaccine based on hepatitis B virus core gene induces specific immune responses in Balb/c mice," *World J. Gastroenterol*, 11(29)4583-4586 (2005).

* cited by examiner

– Gene gun immunization

One Immunization

Two Immunizations

IMMUNOGEN PLATFORM

CROSS-REFERENCE TO RELATED APPLICATIONS

This application claims priority to U.S. Provisional Application No. 60/956,326, filed Aug. 16, 2007 and also claims priority to U.S. Provisional Application No. 61/047,076, filed Apr. 22, 2008.

REFERENCE TO SEQUENCE LISTING

The present application is being filed along with a Sequence Listing in electronic format. The Sequence Listing is provided as a file entitled TRIPEP111A.TXT, created Aug. 15, 2008, which is 4.7 MB in size. The information in the electronic format of the Sequence Listing is incorporated herein by reference in its entirety.

BACKGROUND

Traditionally, vaccines have been based on live attenuated or inactivated pathogens. These strategies are inefficient, however, largely because of the antigenic variability of pathogens (e.g., viruses). Several peptide vaccines that comprise antigenic peptides or peptide fragments of pathogens have been developed. Conserved peptide fragments are less likely to exhibit antigenic variability and can overcome some of the problems associated with traditional peptides. Accordingly, subunit vaccines have been developed, which target conserved regions of pathogens. Synthetic peptide vaccines tend to be poorly immunogenic, however. The poor immunogenicity of synthetic peptide vaccines may be attributed to the fact that although these types of vaccines induce humoral antibody responses, they are less likely to induce cell-mediated responses.

Several investigators have sought to improve the antigenicity of synthetic peptide vaccines. For example, Klein et al. describe the engineering of chimeric proteins that comprise an immunogenic region of a protein from a first antigen linked to an immunogenic region from a second pathogen. (See, U.S. Pat. Nos. 6,033,668; 6,017,539; 5,998,169; and 5,968,776). Others have sought to create chimeric proteins that couple B-cell epitopes to universal T-cell epitopes in order to improve the immune response. (See, e.g., U.S. Pat. No. 5,114,713). Russell-Jones et al. (U.S. Pat. No. 5,928,644) also disclose T-cell epitopes derived from the TraT protein of *Escherichia coli*, which are used to produce hybrid molecules so as to generate an immune response to parasites, soluble factors (e.g., LSH) and viruses. Further, Ruslan (U.S. Patent Application Publication No. 20030232055) discloses the manufacture of vaccines based on PAMPs and immunogenic antigens. Despite these advances, the development of compositions and methods that improve the antigenicity of immunogens is manifest.

SUMMARY OF THE INVENTION

Several embodiments described herein concern compositions and methods that are useful for the generation, enhancement, or improvement of an immune response to a target antigen. Many platforms for the presentation of antigens are provided. These platforms are particularly useful for nucleic acid-based immunogens (e.g., DNA vaccines). It has been discovered that the hepatitis C virus (HCV) nonstructural protein 3 (NS3) and nonstructural protein 4A (NS4A), collectively NS3/4A, and fragments of this fusion protein (e.g., fragments that retain the protease domain, protease cleavage site, and/or the helicase domain) or a nucleic acid encoding these proteins are useful platforms to present antigens (e.g., nucleic acids encoding a T cell epitope, such as a CTL or HTL domain) so as to generate a potent immune response to the associated antigen.

One aim of using NS3/4A as a carrier or adjuvant is to effectively provide T helper cells access to a fused antigen, thereby enhancing the immune response to the fused antigen. In addition, in some embodiments it is desired to have an active, or highly active, NS3/4A protease since an enhanced or altered protease activity can have adjuvant effects that improve the immune response to the fused gene. Moreover, the active NS3/4A protease can be used to cleave the fused protein (e.g., a heterologous antigen), especially when it contains inserted heterologous protease cleavage sites, into smaller fragments to enhance processing and to ensure that the fused protein will not resemble its native structure. For certain conditions or diseases it can be desirable to use the fused protein in a way that is structurally different from the native form since the native form of the protein may have properties that are at an immunogenic disadvantage. It is envisioned that the introduction of foreign protease cleavage sites in the fusion protein (e.g., a peptide antigen) induce protein cleavage into small fragments that can enhance processing. Additionally, if the natural sequence has been changed the cleavage at the introduced sites can ensure that no new, artificial junctional T cell epitopes are generated.

Accordingly, embodiments disclosed herein include compositions that comprise an isolated nucleic acid that encodes a chimeric Hepatitis C virus (HCV) NS3/4A polypeptide or a fragment thereof, which comprises a sequence that encodes an antigen (preferably a non-HCV epitope or, when an HCV epitope is used, the antigen is not in a position on the NS3/4A peptide or NS3/4A nucleic acid or fragment thereof that is naturally occurring). The immunogenic sequence (e.g., a nucleic acid encoding an antigen) can be inserted within the NS3/4A nucleic acid or NS3/4A peptide or attached thereto (e.g., the antigen-encoding nucleic acid can be inserted within the nucleic acid encoding NS3 and/or NS4A domain at a location outside of or within the protease domain, helicase domain, or protease cleavage site or said sequence encoding said antigen can be flanking the 5' or 3' end of the nucleic acid encoding said HCV NS3/4A peptide, such as juxtaposed to the 5' or 3' end).

Embodiments also include an antigenic or immunogenic peptide (e.g., a peptide of a pathogen, bacteria, toxin, virus, or cancer cell antigen) joined to (e.g., flanking or juxtaposed to) or affixed within NS3/4A peptide or a fragment thereof, which peptide fragment can comprise at least, equal to, greater than, less than, or any number in between 3, 5, 10, 20, 50, 100, 150, 200, 250, 300, 350, 400, 500, 700, 1000, 1200, or 1500 consecutive amino acids of a natural or synthetic NS3/4A polypeptide (e.g., a naturally occurring isotype of NS3/4A or a codon-optimized or otherwise modified NS3/4A polypeptide (e.g., consensus NS3/4A sequences generated from 2 or more isotypes), such as SEQ. ID. Nos. 2 and 36).

More embodiments include a nucleic acid that encodes an antigenic or immunogenic peptide (e.g., a nucleic acid encoding a peptide of a pathogen, bacteria, toxin, virus, or cancer cell antigen) joined to or affixed within a nucleic acid encoding an NS3/4A peptide or a fragment thereof (e.g., the nucleic acid that encodes said antigenic or immunogenic peptide can be inserted within or joined to (e.g., flanking or juxtaposed to) an isolated but naturally occurring NS3/4A nucleic acid or a synthetic NS3/4A nucleic acid (e.g., a codon-optimized NS3/4A nucleic acid) or a fragment of these nucleic acids (e.g., the NS3/4a nucleic acid fragment can comprise, consist of, or consist essentially of about at least, equal to, greater than, less than, or any number in between 9, 15, 30, 50, 75, 100, 125, 150, 175, 200, 250, 300, 400, 500, 600, 700, 800, 900, 1000, 1200, 1500, 2000, or 2500 consecutive nucleotides of a nucleic acid sequence that encodes an isolated but natural NS3/4A polypeptide or synthetic NS3/4A polypeptide (e.g., SEQ. ID. Nos. 1 and 35). Polypeptides encoded by said nucleic acids are also embodiments.

In some embodiments, the antigenic or immunogenic peptide is a T cell epitope (TCE), such as a CTL epitope or an HTL epitope, or the antigenic or immunogenic nucleic acid encodes a TCE, such as a CTL epitope or HTL epitope. As above, the TCE can be inserted within or flanking (e.g., juxtaposed to) the NS3/4A peptide or nucleic acids encoding the NS3/4A peptide or fragments of these peptides and nucleic acids, as described above, such that said chimeric sequences are or encode chimeric NS3/4A polypeptides or fragments thereof with TCEs inserted within or flanking (e.g., juxtaposed to) the NS3/4A polypeptide sequences. Preferably, the nucleic acid encoding the TCE, and the encoded TCE, is located at a position that is not naturally occurring in HCV, when said TCE is an HCV epitope. Desirably, the encoded NS3/4A chimeric polypeptide retains catalytic activity (e.g., protease and/or helicase activity).

Accordingly, several embodiments include a nucleic acid that encodes a TCE (e.g., a CTL or HTL of a pathogen, bacteria, virus, toxin, or of a cancer cell) inserted within or flanking (e.g., juxtaposed to) a nucleic acid encoding an NS3/4A polypeptide (e.g., SEQ. ID. Nos. 1 or 35) or a nucleic acid encoding a fragment of an NS3/4A polypeptide (e.g., a fragment of SEQ. ID. Nos. 1 or 35), preferably a fragment that retains protease and/or helicase activity, wherein said fragment can comprise, consist of, or consist essentially of about at least, equal to, greater than, less than, or any number in between 9, 15, 30, 50, 75, 100, 125, 150, 175, 200, 250, 300, 400, 500, 600, 700, 800, 900, 1000, 1200, 1500, 2000, or 2500 consecutive nucleotides of a nucleic acid sequence that encodes an isolated but natural NS3/4A polypeptide or synthetic NS3/4A polypeptide (e.g., SEQ. ID. Nos. 1 or 35), such that when said TCE is a sequence that encodes an HCV TCE, said HCV TCE is in a position on the nucleic acid or polypeptide encoded by said nucleic acid that is not naturally occurring. Polypeptides encoding said nucleic acid embodiments are also aspects of the invention.

Optionally, the isolated nucleic acids can also encode a linker sequence and/or a sequence that promotes adjuvant activity (e.g., a stimulatory TCE, a plurality of immune stimulatory di nucleotides, such as CpG, or an RNA binding domain). For example, in some embodiments, the linker sequence or adjuvant sequence flanks (e.g., juxtaposed to) at least one end of the encoded TCE or antigen. Preferably, the nucleic acid encodes a linker comprising one to six alanine and/or glycine residues flanking or juxtaposed to at least one of a TCE, for example, between TCE sequences and N33/4A sequences. Polypeptides encoded by any of the nucleic acids provided herein are also embodiments.

In some embodiments, nucleic acids encoding an antigen, TCE, antigen and linker, TCE and linker, antigen and adjuvant sequence, TCE and adjuvant sequence, antigen and linker and adjuvant sequence, or TCE and linker and adjuvant sequence are inserted within a nucleic acid encoding an HCV NS3/4A polypeptide (e.g., SEQ ID NOs: 1 or 35) or fragment thereof (e.g., the NS3/4a nucleic acid fragment can comprise, consist of, or consist essentially of about at least, equal to, greater than, less than, or any number in between 9, 15, 30, 50, 75, 100, 125, 150, 175, 200, 250, 300, 400, 500, 600, 700, 800, 900, 1000, 1200, 1500, or 2000 consecutive nucleotides of an NS3 and/or NS4A sequence, such as SEQ ID NOs: 1 or 35). Such embodiments can be used as DNA immunogens, which can be delivered to a subject in need of an immune response to the antigen contained therein transdermally (e.g., a transdermal oil or patch), by injection (e.g., hypodermic or ballistic), electroporation (e.g., gene gun, microneedle, needless, ex vivo, MedPulsar™, electroporation with needless or following needleless injection), or any combination thereof. Alternatively, polypeptides encoded by said DNA immunogens can be delivered to a subject in need of an immune response to the antigen. For example, in some embodiments, a nucleic acid encoding an antigen, TCE, antigen and linker, TCE and linker, antigen and adjuvant sequence, TCE and adjuvant sequence, antigen and linker and adjuvant sequence, or TCE and linker and adjuvant sequence is inserted between the codons of an NS3/4A nucleic acid at sites that do not interrupt protease activity and/or helicase activity such that the expressed fusion peptide retains such catalytic activity and the nucleic acid immunogen is delivered to a subject in need of an immune response to said antigen or TCE by an electroporation system that comprises a needle injection system (e.g., Medpulser™). Again, aspects disclosed herein include polypeptides that are encoded by said nucleic acids.

That is, in some embodiments, antigen, TCE, antigen and linker, TCE and linker, antigen and adjuvant sequence, TCE and adjuvant sequence, antigen and linker and adjuvant sequence, or TCE and linker and adjuvant sequence are inserted between nucleotides 3 and 4, 6 and 7, 9 and 10, 12 and 13, 15 and 16, 18 and 19, 21 and 22, 24 and 25, 27 and 28, 30 and 31, 33 and 34, 36 and 37, 39 and 40, 42 and 43, 45 and 46, 48 and 49, 51 and 52, 54 and 55, 57 and 58, 60 and 61, 63 and 64, 66 and 67, 69 and 70, 72 and 73, 75 and 76, 78 and 79, 81 and 82, 84 and 85, 87 and 88, 90 and 91, 93 and 94, 96 and 97, 99 and 100, 102 and 103, 105 and 106, 108 and 109, 111 and 112, 114 and 115, 117 and 118, 120 and 121, 123 and 124, 126 and 127, 129 and 130, 132 and 133, 125 and 136, 138 and 139, 141 and 142, 144 and 145, 147 and 148, 150 and 151, 153 and 154, 156 and 157, 159 and 160, 162 and 163, 165 and 166, 168 and 169, 171 and 172, 174 and 175, 177 and 178, 180 and 181, 183 and 184, 186 and 187, 189 and 19, 192 and 193, 195 and 196, 198 and 199, 201 and 202, 204 and 205, 207 and 208, 210 and 211, 213 and 214, 216 and 217, 219 and 220, 222 and 223, 225 and 226, 228 and 229, 231 and 232, 234 and 235, 237 and 238, 240 and 241, 243 and 244, 246 and 247, 249 and 250, 252 and 253, 255 and 256, 258 and 259, 261 and 262, 264 and 265, 267 and 268, 270 and 271, 273 and 274, 276 and 277, 279 and 280, 282 and 283, 285 and 286, 288 and 289, 291 and 292, 294 and 295, 297 and 298, 300 and 301, 303 and 304, 306 and 307, 309 and 310, 312 and 313, 315 and 316, 318 and 319, 321 and 322, 324 and 325, 327 and 328, 330 and 331, 333 and 334, 336 and 337, 339 and 340, 342 and 343, 345 and 346, 348 and 349, 351 and 352, 354 and 355, 357 and 358, 360 and 361, 363 and 364, 366 and 367, 369 and 370, 372 and 373, 375 and 376, 378 and 379, 381 and 382, 24 and 385, 387 and 388, 390 and 391, 393 and 394, 396 and 397, 399 and 400, 402 and 403, 405 and 406, 408 and 409, 411 and 412, 414 and 415, 417 and 418, 420 and 421, 423 and 424, 426 and 427, 429 and 430, 432 and 433, 435 and 436, 438 and 439, 441 and 442, 444 and 445, 447 and 448, 450 and 451, 453 and 454, 456 and 457, 459 and 460, 462 and 463, 465 and 466, 468 and 469, 471 and 472, 474 and 475, 477 and 478, 480 and 481, 483 and 484, 486 and 487, 489 and 490, 492 and 493, 495 and 496, 498 and 499, 501 and 502, 504 and 505, 507 and 508, 510 and 511, 513 and 514, 516 and 517, 519 and 520, 522 and 523, 525 and 526, 528 and 529, 531 and 532, 534 and 535, 537 and 538, 540 and 541, 543 and 544, 546 and 547, 549 and 550, 552 and 553, 555 and 556, 558 and 559, 561 and 562, 564 and 565, 567 and 568, 570 and 571, 573 and 574, 576 and 577, 579 and 580, 582 and 583, 585 and 586, 588 and 589, 591 and 592, 594 and 595, 597 and 598, 600 and 601, 603 and 604, 606 and 607, 609 and 610, 612 and 613, 615 and 616, 618 and 619, 621 and 622, 624 and 625, 627 and 628, 630 and 631, 633 and 634, 636 and 637, 639 and 640, 642 and 643, 645 and 646, 648 and 649, 651 and 652, 654 and 655, 657 and 658, 660 and 661, 663 and 664, 666 and 667, 669 and 670, 672 and 673, 675 and 676, 678 and 679, 681 and 682, 684 and 685, 687 and 688, 690 and 691, 693 and 694, 696 and 697, 699 and 700, 702 and 703, 705 and 706, 708 and 709, 711 and 712, 714 and 715, 717 and 718, 720 and 721, 723 and 724, 726 and 727, 729 and 730, 732 and 733, 735 and 736, 738 and 739, 741 and 742, 744 and 745, 747 and 748, 750 and 751, 753 and 754, 756 and 757, 759 and 760, 762 and 763, 765 and 766, 768 and 769, 771 and 772, 774 and 775, 777 and 778, 780 and 781, 783 and 784, 786 and 787, 789 and 790, 792 and 793, 795 and 796, 798 and 799, 801 and 802, 804 and 805, 807 and 808, 810 and 811, 813 and 814, 816 and 817, 819 and 820, 822 and 823, 825 and 826, 828 and 829, 831 and 832, 834 and 835, 837 and 838, 840 and 841, 843 and 844, 846 and 847, 849 and 850, 852 and 853, 855 and 856, 858 and 859, 861 and 862, 864 and 865, 867 and 868, 870 and 871, 873 and 874, 876 and 877, 879 and 880, 882 and 883, 885 and 886, 888 and 889, 891 and 892, 894 and 895, 897 and 898, 900 and 901, 903 and 904, 906 and 907, 909 and 910, 912 and 913, 915 and 916, 918 and 919, 921 and 922, 924 and 925, 927 and 928, 930 and 931, 933 and 934, 936 and 937, 939 and 940, 942 and 943, 945 and 946, 948 and 949, 951 and 952, 954 and 955, 957 and 958, 960 and 961, 963 and 964, 966 and 967, 969 and 970, 972 and 973, 975 and 976, 978 and 979, 981 and 982, 984 and 985, 987 and 988, 990 and 991, 993 and 994, 996 and 997, 999 and 1000, 1002 and 1003, 1005 and 1006, 1008 and 1009, 1011 and 1012, 1014 and 1015, 1017 and 1018, 1020 and 1021, 1023 and 1024, 1026 and 1027, 1029 and 1030, 1032 and 1033, 1025 and 1036, 1038 and 1039, 1041 and 1042, 1044 and 1045, 1047 and 1048, 1050 and 1051, 1053 and 1054, 1056 and 1057, 1059 and 1060, 1062 and 1063, 1065 and 1066, 1068 and 1069, 1071 and 1072, 1074 and 1075, 1077 and 1078, 1080 and 1081, 1083 and 1084, 1086 and 1087, 1089 and 1090, 1092 and 1093, 1095 and 1096, 1098 and 1099, 1101 and 1102, 1104 and 1105, 1107 and 1108, 1110 and 1111, 1113 and 1114, 1116 and 1117, 1119 and 1120, 1122 and 1123, 1125 and 1126, 1128 and 1129, 1131 and 1132, 1134 and 1135, 1137 and 1138, 1140 and 1141, 1143 and 1144, 1146 and 1147, 1149 and 1150, 1152 and 1153, 1155 and 1156, 1158 and 1159, 1161 and 1162, 1164 and 1165, 1167 and 1168, 1170 and 1171, 1173 and 1174, 1176 and 1177, 1179 and 1180, 1182 and 1183, 1185 and 1186, 1188 and 1189, 1191 and 1192, 1194 and 1195, 1197 and 1198, 1200 and 1201, 1203 and 1204, 1206 and 1207, 1209 and 1210, 1212 and 1213, 1215 and 1216, 1218 and 1219, 1221 and 1222, 1224 and 1225, 1227 and 1228, 1230 and 1231, 1233 and 1234, 1236 and 1237, 1239 and 1240, 1242 and 1243, 1245 and 1246, 1248 and 1249, 1251 and 1252, 1254 and 1255, 1257 and 1258, 1260 and 1261, 1263 and 1264, 1266 and 1267, 1269 and 1270, 1272 and 1273, 1275 and 1276, 1278 and 1279, 1281 and 1282, 1284 and 1285, 1287 and 1288, 1290 and 1291, 1293 and 1294, 1296 and 1297, 1299 and 1300, 1302 and 1303, 1305 and 1306, 1308 and 1309, 1311 and 1312, 1314 and 1315, 1317 and 1318, 1320 and 1321, 1323 and 1324, 1326 and 1327, 1329 and 1330, 1332 and 1333, 1335 and 1336, 1338 and 1339, 1341 and 1342, 1344 and 1345, 1347 and 1348, 1350 and 1351, 1353 and 1354, 1356 and 1357, 1359 and 1360, 1362 and 1363, 1365 and 1366, 1368 and 1369, 1371 and 1372, 1374 and 1375, 1377 and 1378, 1380 and 1381, 1383 and 1384, 1386 and 1387, 1389 and 1390, 1392 and 1393, 1395 and 1396, 1398 and 1399, 1401 and 1402, 1404 and 1405, 1407 and 1408, 1410 and 1411, 1413 and 1414, 1416 and 1417, 1419 and 1420, 1422 and 1423, 1425 and 1426, 1428 and 1429, 1431 and 1432, 1434 and 1435, 1437 and 1438, 1440 and 1441, 1443 and 1444, 1446 and 1447, 1449 and 1450, 1452 and 1453, 1455 and 1456, 1458 and 1459, 1461 and 1462, 1464 and 1465, 1467 and 1468, 1470 and 1471, 1473 and 1474, 1476 and 1477, 1479 and 1480, 1482 and 1483, 1485 and 1486, 1488 and 1489, 1491 and 1492, 1494 and 1495, 1497 and 1498, 1500 and 1501, 1503 and 1504, 1506 and 1507, 1509 and 1510, 1512 and 1513, 1515 and 1516, 1518 and 1519, 1521 and 1522, 1524 and 1525, 1527 and 1528, 1530 and 1531, 1533 and 1534, 1536 and 1537, 1539 and 1540, 1542 and 1543, 1545 and 1546, 1548 and 1549, 1551 and 1552, 1554 and 1555, 1557 and 1558, 1560 and 1561, 1563 and 1564, 1566 and 1567, 1569 and 1570, 1572 and 1573, 1575 and 1576, 1578 and 1579, 1581 and 1582, 1584 and 15685, 1587 and 1588, 1590 and 1591, 1593 and 1594, 1596 and 1597, 1599 and 1600, 1602 and 1603, 1605 and 1606, 1608 and 1609, 1611 and 1612, 1614 and 1615, 1617 and 1618, 1620 and 1621, 1623 and 1624, 1626 and 1627, 1629 and 1630, 1632 and 1633, 1635 and 1636, 1638 and 1639, 1641 and 1642, 1644 and 1645, 1647 and 1648, 1650 and 1651, 1653 and 1654, 1656 and 1657, 1659 and 1660, 1662 and 1663, 1665 and 1666, 1668 and 1669, 1671 and 1672, 1674 and 1675, 1677 and 1678, 1680 and 1681, 1683 and 1684, 1686 and 1687, 1689 and 1690, 1692 and 1693, 1695 and 1696, 1698 and 1699, 1701 and 1702, 1704 and 1705, 1707 and 1708, 1710 and 1711, 1713 and 1714, 1716 and 1717, 1719 and 1720, 1722 and 1723, 1725 and 1726, 1728 and 1729, 1731 and 1732, 1734 and 1735, 1737 and 1738, 1740 and 1741, 1743 and 1744, 1746 and 1747, 1749 and 1750, 1752 and 1753, 1755 and 1756, 1758 and 1759, 1761 and 1762, 1764 and 1765, 1767 and 1768, 1770 and 1771, 1773 and 1774, 1776 and 1777, 1779 and 1780, 1782 and 1783, 1785 and 1786, 1788 and 1789, 1791 and 1792, 1794 and 1795, 1797 and 1798, 1800 and 1801, 1803 and 1804, 1806 and 1807, 1809 and 1810, 1812 and 1813, 1815 and 1816, 1818 and 1819, 1821 and 1822, 1824 and 1825, 1827 and 1828, 1830 and 1831, 1833 and 1834, 1836 and 1837, 1839 and 1840, 1842 and 1843, 1845 and 1846, 1848 and 1849, 1851 and 1852, 1854 and 1855, 1857 and 1858, 1860 and 1861, 1863 and 1864, 1866 and 1867, 1869 and 1870, 1872 and 1873, 1875 and 1876, 1878 and 1879, 1881 and 1882, 1884 and 1885, 1887 and 1888, 1890 and 1891, 1893 and 1894, 1896 and 1897, 1899 and 1900, 1902 and 1903, 1905 and 1906, 1908 and 1909, 1911 and 1912, 1914 and 1915, 1917 and 1918, 1920 and 1921, 1923 and 1924, 1926 and 1927, 1929 and 1930, 1932 and 1933, 1925 and 1936, 1938 and 1939, 1941 and 1942, 1944 and 1945, 1947 and 1948, 1950 and 1951, 1953 and 1954, 1956 and 157, 1959 and 1960, 1962 and 1963, 1965 and 1966, 1968 and 1969, 1971 and 1972, 1974 and 175, 1977 and 1978, 1980 and 1981, 1983 and 1984, 1986 and 1987, 1989 and 1999, 1992 and 1993, 1995 and 1996, 1998 and 1999, 2001 and 2002, 2004 and 2005, 2007 and 2008, 2010 and 2011, 2013 and 2014, 2016 and 2017, 2019 and 2020, 2022 and 2023, 2025 and 2026, 2028 and 2029, 2031 and 2032, 2034 and 2035, 2037 and 2038, 2040 and 2041, 2043 and 2044, 2046 and 2047, 2049 and 2050, 2052 and 2053, 2055 and 2056, or 2058 and 2059 of an NS3/4A nucleic acid sequence such as SEQ ID NO: 1, an NS3/4A variant or consensus nucleic acid sequence (e.g., an NS3/4A sequence developed from a plurality of NS3/4A isotypes, such as SEQ ID NO: 35), or any NS3/4A mutant (for example any nucleic acid encoding an NS3/4A with altered protease activity). Preferably, the nucleic acids encoding the inserted sequences retain the reading frame of the chimeric NS3/4A polypeptide and when the TCE encodes an HCV TCE, the sequence is inserted at a position that is not naturally occurring. In some embodiments, the TCE is not an HCV peptide or peptide fragment. In preferred embodiments, the nucleic acid encoding the TCE can be inserted between nucleotides 1370 and 1548 of SEQ ID NO:35, or in an analogous position in another NS3/4A coding sequence. Aspects of the invention also include the polypeptides encoded by the nucleic acid embodiments provided herein.

Accordingly, the nucleic acids encoding chimeric NS3/4A polypeptides can encode an antigen, TCE, antigen and linker, TCE and linker, antigen and adjuvant sequence, TCE and adjuvant sequence, antigen and linker and adjuvant sequence, or TCE and linker and adjuvant sequence inserted between amino acids 1 and 2, 2 and 3, 3 and 4, 4 and 5, 5 and 6, 6 and 7, 7 and 8, 8 and 9, 9 and 10, 10 and 11, 11 and 12, 12 and 13, 13 and 14, 14 and 15, 15 and 16, 16 and 17, 17 and 18, 18 and 19, 19 and 20, 20 and 21, 21 and 22, 22 and 23, 23 and 24, 24 and 25, 25 and 26, 26 and 27, 27 and 28, 28 and 29, 29 and 30, 30 and 31, 31 and 32, 32 and 33, 33 and 34, 34 and 35, 35 and 36, 36 and 37, 37 and 38, 38 and 39, 39 and 40, 40 and 41, 41 and 42, 42 and 43, 43 and 44, 44 and 45, 45 and 46, 46 and 47, 47 and 48, 48 and 49, 49 and 50, 50 and 51, 51 and 52, 52 and 53, 53 and 54, 54 and 55, 55 and 56, 56 and 57, 57 and 58, 58 and 59, 59 and 60, 60 and 61, 61 and 62, 62 and 63, 63 and 64, 64 and 65, 65 and 66, 66 and 67, 67 and 68, 68 and 69, 69 and 70, 70 and 71, 71 and 72, 72 and 73, 73 and 74, 74 and 75, 75 and 76, 76 and 77, 77 and 78, 78 and 79, 79 and 80, 80 and 81, 81 and 82, 82 and 83, 83 and 84, 84 and 85, 85 and 86, 86 and 87, 87 and 88, 88 and 89, 89 and 90, 90 and 91, 91 and 92, 92 and 93, 93 and 94, 94 and 95, 95 and 96, 96 and 97, 97 and 98, 98 and 99, 99 and 100, 100 and 101, 101 and 102, 102 and 103, 103 and 104, 104 and 105, 105 and 106, 106 and 107, 107 and 108, 108 and 109, 109 and 110, 110 and 111, 111 and 112, 112 and 113, 113 and 114, 114 and 115, 115 and 116, 116 and 117, 117 and 118, 118 and 119, 119 and 120, 120 and 121, 121 and 122, 122 and 123, 123 and 124, 124 and 125, 125 and 126, 126 and 127, 127 and 128, 128 and 129, 129 and 130, 130 and 131, 131 and 132, 132 and 133, 133 and 134, 134 and 135, 135 and 136, 136 and 137, 137 and 138, 138 and 139, 139 and 140, 140 and 141, 141 and 142, 142 and 143, 143 and 144, 144 and 145, 145 and 146, 146 and 147, 147 and 148, 148 and 149, 149 and 150, 150 and 151, 151 and 152, 152 and 153, 153 and 154, 154 and 155, 155 and 156, 156 and 157, 157 and 158, 158 and 159, 159 and 160, 160 and 161, 161 and 162, 162 and 163, 163 and 164, 164 and 165, 165 and 166, 166 and 167, 167 and 168, 168 and 169, 169 and 170, 170 and 171, 171 and 172, 172 and 173, 173 and 174, 174 and 175, 175 and 176, 176 and 177, 177 and 178, 178 and 179, 179 and 180, 180 and 181, 181 and 182, 182 and 183, 183 and 184, 184 and 185, 185 and 186, 186 and 187, 187 and 188, 188 and 189, 189 and 190, 190 and 191, 191 and 192, 192 and 193, 193 and 194, 194 and 195, 195 and 196, 196 and 197, 197 and 198, 198 and 199, 199 and 200, 200 and 201, 201 and 202, 202 and 203, 203 and 204, 204 and 205, 205 and 206, 206 and 207, 207 and 208, 208 and 209, 209 and 210, 210 and 211, 211 and 212, 212 and 213, 213 and 214, 214 and 215, 215 and 216, 216 and 217, 217 and 218, 218 and 219, 219 and 220, 220 and 221, 221 and 222, 222 and 223, 223 and 224, 224 and 225, 225, and 226, 226 and 227, 227 and 228, 228 and 229, 229 and 230, 230 and 231, 231 and 232, 232 and 233, 233 and 234, 234 and 235, 235 and 236, 236 and 237, 237 and 238, 238 and 239, 239 and 240, 240 and 241, 241 and 242, 242 and 243, 243 and 244, 244 and 245, 245 and 246, 246 and 247, 247 and 248, 248 and 249, 249 and 250, 250 and 251, 251 and 252, 252 and 253, 253 and 254, 254 and 255, 255 and 256, 256 and 257, 257 and 258, 258 and 259, 259 and 260, 260 and 261, 261 and 262, 262 and 263, 263 and 264, 264 and 265, 265 and 266, 266 and 267, 267 and 268, 268 and 269, 269 and 270, 270 and 271, 271 and 272, 272 and 273, 273 and 274, 274 and 275, 275 and 276, 276 and 277, 277 and 278, 278 and 279, 279 and 280, 280 and 281, 281 and 282, 282 and 283, 283 and 284, 284 and 285, 285 and 286, 286 and 287, 287 and 288, 288 and 289, 289 and 290, 290 and 291, 291 and 292, 292 and 293, 293 and 294, 294 and 295, 295 and 296, 296 and 297, 297 and 298, 298 and 299, 299 and 300, 300 and 201, 301 and 302, 302 and 303, 303 and 304, 304 and 305, 305 and 306, 306 and 307, 307 and 308, 308 and 309, 309 and 310, 310 and 311, 311 and 312, 312 and 313, 313 and 314, 314 and 315, 315 and 316, 316 and 317, 317 and 318, 318 and 319, 319 and 320, 320 and 321, 321, and 322, 322 and 323, 323 and 324, 324 and 325, 325, and 326, 326 and 327, 327 and 328, 328 and 329, 329 and 330, 330 and 331, 331 and 332, 332 and 333, 333 and 334, 334 and 335, 335 and 336, 336 and 337, 337 and 338, 338 and 339, 339 and 340, 340 and 341, 341 and 342, 342 and 343, 343 and 344, 344 and 345, 345 and 346, 346 and 347, 347 and 348, 348 and 349, 349 and 350, 350 and 351, 351 and 352, 352 and 353, 353 and 354, 354 and 355, 355 and 356, 356 and 357, 357 and 358, 358 and 359, 359 and 360, 360 and 361, 361 and 362, 362 and 363, 363 and 364, 364 and 365, 365 and 366, 366 and 367, 367 and 368, 368 and 369, 369 and 370, 370 and 371, 371 and 372, 372 and 373, 373 and 374, 374 and 375, 375 and 376, 376 and 377, 377 and 378, 378 and 379, 379 and 380, 380 and 381, 381 and 382, 382 and 383, 383 and 384, 384 and 385, 385 and 386, 386 and 387, 387 and 388, 388 and 389, 389 and 390, 390 and 391, 391 and 392, 392 and 393, 393 and 394, 394 and 395, 395 and 396, 396 and 397, 397 and 398, 398 and 399, 399 and 400, 401 and 402, 402 and 403, 403 and 404, 404 and 405, 405 and 406, 406 and 407, 407 and 408, 408 and 409, 409 and 410, 410 and 411, 411 and 412, 412 and 413, 413 and 414, 414 and 415, 415 and 416, 416 and 417, 417 and 418, 418 and 419, 419 and 420, 420 and 421, 421 and 422, 422 and 423, 423 and 424, 424 and 425, 425 and 426, 426 and 427, 427 and 428, 428 and 429, 429 and 430, 430 and 431, 431 and 432, 432 and 433, 433 and 434, 434 and 435, 435 and 436, 436 and 437, 437 and 438, 438 and 439, 439 and 440, 440 and 441, 441 and 442, 442 and 443, 443 and 444, 444 and 445, 445 and 446, 446 and 447, 447 and 448, 448 and 449, 449 and 450, 450 and 451, 451 and 452, 452 and 453, 453 and 454, 454 and 455, 455 and 456, 456 and 457, 457 and 458, 458 and 459, 459 and 460, 460 and 461, 461 and 462, 462 and 463, 463 and 464, 464 and 465, 465 and 466, 466 and 467, 467 and 468, 468 and 469, 469 and 470, 470 and 471, 471 and 472, 472 and 473, 473 and 474, 474 and 475, 475 and 476, 476 and 477, 477 and 478, 478 and 479, 479 and 480, 480 and 481, 481 and 482, 482 and 483, 483 and 484, 484 and 485, 485 and 486, 486 and 487, 487 and 488, 488 and 489, 489 and 490, 490 and 491, 491 and 492, 492 and 493, 493 and 494, 494 and 495, 495 and 496, 496 and 497, 497 and 498, 498 and 499, 499 and 500, 501 and 502, 502 and 503, 503 and 504, 504 and 505, 505 and 506, 506 and 507, 507 and 508, 508 and 509, 509 and 510, 510 and 511, 511 and 512, 512 and 513, 513 and 514, 514 and 515, 515 and 516, 516 and 517, 517 and 518, 518 and 519, 519 and 520, 520 and 521, 521 and 522, 522 and 523, 523 and 524, 524 and 525, 525 and 526, 526 and 527, 527 and 528, 528 and 529, 529 and 530, 530 and 531, 531 and 532, 532 and 533, 533 and 534, 534 and 535, 535 and 536, 536 and 537, 537 and 538, 538 and 539, 539 and 540, 540 and 541, 541 and 542, 542 and 543, 543 and 544, 544 and 545, 545 and 546, 546 and 547, 547 and 548, 548 and 549, 549 and 550, 550 and 551, 551 and 552, 552 and 553, 553 and 554, 554 and 555, 555 and 556, 556 and 557, 557 and 558, 558 and 559, 559 and 560, 560 and 561, 561 and 562, 562 and 563, 563 and 564, 564 and 565, 565 and 566, 566 and 567, 567 and 568, 568 and 569, 569 and 570, 570 and 571, 571 and 572, 572 and 573, 573 and 574, 574 and 575, 575 and 576, 576 and 577, 577 and 578, 578 and 579, 579 and 580, 580 and 581, 581 and 582, 582 and 583, 583 and 584, 584 and 585, 585 and 586, 586 and 587, 587 and 588, 588 and 589, 589 and 590, 590 and 591, 591 and 592, 592 and 593, 593 and 594, 594 and 595, 595 and 596, 596 and 597, 597 and 598, 598 and 599, 599 and 600, 601 and 602, 602 and 603, 603 and 604, 604 and 605, 605 and 606, 606 and 607, 607 and 608, 608 and 609, 609 and 610, 610 and 611, 611 and 612, 612 and 613, 613 and 614, 614 and 615, 615 and 616, 616 and 617, 617 and 618, 618 and 619, 619 and 620, 620 and 621, 621 and 622, 622 and 623, 623 and 624, 624 and 625, 625 and 626, 626 and 627, 627 and 628, 628 and 629, 629 and 630, 630 and 631, 631 and 632, 632 and 633, 633 and 634, 634 and 635, 635 and 636, 636 and 637, 637 and 638, 638 and 639, 639 and 640, 640 and 641, 641 and 642, 642 and 643, 643 and 644, 644 and 645, 645 and 646, 646 and 647, 647 and 648, 648 and 649, 649 and 650, 650 and 651, 651 and 652, 652 and 653, 653 and 654, 654 and 655, 655 and 656, 656 and 657, 657 and 658, 658 and 659, 659 and 660, 660 and 661, 661 and 662, 662 and 663, 663 and 664, 664 and 665, 665 and 666, 666 and 667, 667 and 668, 668 and 669, 669 and 670, 670 and 671, 671 and 672, 72 and 673, 673 and 674, 674 and 675, 675 and 676, 676 and 677, 677 and 678, 678 and 679, 679 and 680, 680 and 681, 681 and 682, 682 and 683, 683 and 684, 684 and 685, or 685 and 686 of an NS3/4A polypeptide (e.g. SEQ ID NO: 2) an NS3/4A variant polypeptide (e.g. SEQ ID NO: 36), or any NS3/4A mutant (for example any NS3/4A with altered protease activity). In preferred embodiments, the antigen, TCE, antigen and linker, TCE and linker, antigen and adjuvant sequence, TCE and adjuvant sequence, antigen and linker and adjuvant sequence, or TCE and linker and adjuvant sequence inserted between amino acids 453 and 513 of SEQ ID NO:36 or an analogous position in an NS3/4A polypeptide. The encoded polypeptides of the nucleic acid embodiments described herein are also embodiments.

In some embodiments, the encoded antigen, TCE, antigen and linker, TCE and linker, antigen and adjuvant sequence, TCE and adjuvant sequence, antigen and linker and adjuvant sequence, or TCE and linker and adjuvant sequence is juxtaposed to or flanking the HCV NS3/4A polypeptide or fragment thereof. For example, the nucleic acid encoding the antigen, TCE, antigen and linker, TCE and linker, antigen and adjuvant sequence, TCE and adjuvant sequence, antigen and linker and adjuvant sequence, or TCE and linker and adjuvant sequence can be 5' to the nucleic acid encoding the HCV NS3/4A polypeptide or fragment thereof, such that the TCE is on the N-terminal end of the encoded chimeric polypeptide. Optionally, the nucleic acid encoding the antigen, TCE, antigen and linker, TCE and linker, antigen and adjuvant sequence, TCE and adjuvant sequence, antigen and linker and adjuvant sequence, or TCE and linker and adjuvant sequence can be 3' to the nucleic acid encoding the HCV NS3/4A polypeptide or fragment thereof, such that the TCE is on the C-terminal end of the encoded chimeric polypeptide.

The antigens and/or TCE used in the platforms described herein can include, but are not limited to, nucleic acids that encode viral antigens, bacterial antigens, parasitic antigens, tumor antigens, and toxins. In some embodiments, the encoded TCE comprises a sequence selected from the group consisting of SEQ ID NOs: 221-571 and SEQ ID NOs: 809-1011 and SEQ ID NO:1014 and SEQ ID NOs: 1016-1034 and SEQ ID NOs: 1146-1173 and SEQ ID NOs: 1210-1328. In preferred embodiments, the encoded TCE or antigen is obtained from a hepatitis virus, such as an antigen from the Hepatitis A virus (HAV), Hepatitis B virus (HBV), or HCV, HIV, a flu virus, an allergen (such as Birch allergen), or malaria. For example, in some embodiments, the encoded TCE comprises the amino acid sequence of SEQ ID NO: 1014. Antigens and TCEs that are present on pathogens that infect domestic animals are also embodied. That is, some embodiments include veterinary preparations that comprise a nucleic acid encoding an NS3/4A platform, as described herein, and an antigen present on an animal pathogen (e.g., swine flu, avian flu, or equine flu).

Some embodiments also concern the chimeric polypeptides encoded by the nucleic acids disclosed herein. In some embodiments, the chimeric polypeptide encoded by the isolated nucleic acid retains NS3A protease activity and/or NS3A helicase activity and/or a protease cleavage site. Optionally, the chimeric polypeptides include a linker or adjuvant polypeptide (e.g., an RNA binding domain, such as poly Arg). For example, in some embodiments, the linker flanks at least one end (i.e., N-terminal or C-terminal end) of the TCE. In some embodiments, a linker comprising one to six alanine and/or glycine residues is flanking or juxtaposed to at least one end of the TCE, such as between NS3/4A amino acid sequences and TCE sequences.

Also provided herein are NS3/4A chimeric polypeptides that include NS3/4A polypeptides or variants, or fragments thereof and at least one antigen, TCE, antigen and linker, TCE and linker, antigen and adjuvant sequence, TCE and adjuvant sequence, antigen and linker and adjuvant sequence, or TCE and linker and adjuvant sequence. Optionally, these sequences are inserted within the HCV NS3/4A polypeptide or fragment thereof. For example, the chimeric NS3/4A polypeptides can consist of, consist essentially of, or comprise an antigen, TCE, antigen and linker, TCE and linker, antigen and adjuvant sequence, TCE and adjuvant sequence, antigen and linker and adjuvant sequence, or TCE and linker and adjuvant sequence inserted between amino acids 1 and 2, 2 and 3, 3 and 4, 4 and 5, 5 and 6, 6 and 7, 7 and 8, 8 and 9, 9 and 10, 10 and 11, 11 and 12, 12 and 13, 13 and 14, 14 and 15, 15 and 16, 16 and 17, 17 and 18, 18 and 19, 19 and 20, 20 and 21, 21 and 22, 22 and 23, 23 and 24, 24 and 25, 25 and 26, 26 and 27, 27 and 28, 28 and 29, 29 and 30, 30 and 31, 31 and 32, 32 and 33, 33 and 34, 34 and 35, 35 and 36, 36 and 37, 37 and 38, 38 and 39, 39 and 40, 40 and 41, 41 and 42, 42 and 43, 43 and 44, 44 and 45, 45 and 46, 46 and 47, 47 and 48, 48 and 49, 49 and 50, 50 and 51, 51 and 52, 52 and 53, 53 and 54, 54 and 55, 55 and 56, 56 and 57, 57 and 58, 58 and 59, 59 and 60, 60 and 61, 61 and 62, 62 and 63, 63 and 64, 64 and 65, 65 and 66, 66 and 67, 67 and 68, 68 and 69, 69 and 70, 70 and 71, 71 and 72, 72 and 73, 73 and 74, 74 and 75, 75 and 76, 76 and 77, 77 and 78, 78 and 79, 79 and 80, 80 and 81, 81 and 82, 82 and 83, 83 and 84, 84 and 85, 85 and 86, 86 and 87, 87 and 88, 88 and 89, 89 and 90, 90 and 91, 91 and 92, 92 and 93, 93 and 94, 94 and 95, 95 and 96, 96 and 97, 97 and 98, 98 and 99, 99 and 100, 100 and 101, 101 and 102, 102 and 103, 103 and 104, 104 and 105, 105 and 106, 106 and 107, 107 and 108, 108 and 109, 109 and 110, 110 and 111, 111 and 112, 112 and 113, 113 and 114, 114 and 115, 115 and 116, 116 and 117, 117 and 118, 118 and 119, 119 and 120, 120 and 121, 121 and 122, 122 and 123, 123 and 124, 124 and 125, 125 and 126, 126 and 127, 127 and 128, 128 and 129, 129 and 130, 130 and 131, 131 and 132, 132 and 133, 133 and 134, 134 and 135, 135 and 136, 136 and 137, 137 and 138, 138 and 139, 139 and 140, 140 and 141, 141 and 142, 142 and 143, 143 and 144, 144 and 145, 145 and 146, 146 and 147, 147 and 148, 148 and 149, 149 and 150, 150 and 151, 151 and 152, 152 and 153, 153 and 154, 154 and 155, 155 and 156, 156 and 157, 157 and 158, 158 and 159, 159 and 160, 160 and 161, 161 and 162, 162 and 163, 163 and 164, 164 and 165, 165 and 166, 166 and 167, 167 and 168, 168 and 169, 169 and 170, 170 and 171, 171 and 172, 172 and 173, 173 and 174, 174 and 175, 175 and 176, 176 and 177, 177 and 178, 178 and 179, 179 and 180, 180 and 181, 181 and 182, 182 and 183, 183 and 184, 184 and 185, 185 and 186, 186 and 187, 187 and 188, 188 and 189, 189 and 190, 190 and 191, 191 and 192, 192 and 193, 193 and 194, 194 and 195, 195 and 196, 196 and 197, 197 and 198, 198 and 199, 199 and 200, 200 and 201, 201 and 202, 202 and 203, 203 and 204, 204 and 205, 205 and 206, 206 and 207, 207 and 208, 208 and 209, 209 and 210, 210 and 211, 211 and 212, 212 and 213, 213 and 214, 214 and 215, 215 and 216, 216 and 217, 217 and 218, 218 and 219, 219 and 220, 220 and 221, 221 and 222, 222 and 223, 223 and 224, 224 and 225, 225, and 226, 226 and 227, 227 and 228, 228 and 229, 229 and 230, 230 and 231, 231 and 232, 232 and 233, 233 and 234, 234 and 235, 235 and 236, 236 and 237, 237 and 238, 238 and 239, 239 and 240, 240 and 241, 241 and 242, 242 and 243, 243 and 244, 244 and 245, 245 and 246, 246 and 247, 247 and 248, 248 and 249, 249 and 250, 250 and 251, 251 and 252, 252 and 253, 253 and 254, 254 and 255, 255 and 256, 256 and 257, 257 and 258, 258 and 259, 259 and 260, 260 and 261, 261 and 262, 262 and 263, 263 and 264, 264 and 265, 265 and 266, 266 and 267, 267 and 268, 268 and 269, 269 and 270, 270 and 271, 271 and 272, 272 and 273, 273 and 274, 274 and 275, 275 and 276, 276 and 277, 277 and 278, 278 and 279, 279 and 280, 280 and 281, 281 and 282, 282 and 283, 283 and 284, 284 and 285, 285 and 286, 286 and 287, 287 and 288, 288 and 289, 289 and 290, 290 and 291, 291 and 292, 292 and 293, 293 and 294, 294 and 295, 295 and 296, 296 and 297, 297 and 298, 298 and 299, 299 and 300, 300 and 201, 301 and 302, 302 and 303, 303 and 304, 304 and 305, 305 and 306, 306 and 307, 307 and 308, 308 and 309, 309 and 310, 310 and 311, 311 and 312, 312 and 313, 313 and 314, 314 and 315, 315 and 316, 316 and 317, 317 and 318, 318 and 319, 319 and 320, 320 and 321, 321, and 322, 322 and 323, 323 and 324, 324 and 325, 325, and 326, 326 and 327, 327 and 328, 328 and 329, 329 and 330, 330 and 331, 331 and 332, 332 and 333, 333 and 334, 334 and 335, 335 and 336, 336 and 337, 337 and 338, 338 and 339, 339 and 340, 340 and 341, 341 and 342, 342 and 343, 343 and 344, 344 and 345, 345 and 346, 346 and 347, 347 and 348, 348 and 349, 349 and 350, 350 and 351, 351 and 352, 352 and 353, 353 and 354, 354 and 355, 355 and 356, 356 and 357, 357 and 358, 358 and 359, 359 and 360, 360 and 361, 361 and 362, 362 and 363, 363 and 364, 364 and 365, 365 and 366, 366 and 367, 367 and 368, 368 and 369, 369 and 370, 370 and 371, 371 and 372, 372 and 373, 373 and 374, 374 and 375, 375 and 376, 376 and 377, 377 and 378, 378 and 379, 379 and 380, 380 and 381, 381 and 382, 382 and 383, 383 and 384, 384 and 385, 385 and 386, 386 and 387, 387 and 388, 388 and 389, 389 and 390, 390 and 391, 391 and 392, 392 and 393, 393 and 394, 394 and 395, 395 and 396, 396 and 397, 397 and 398, 398 and 399, 399 and 400, 401 and 402, 402 and 403, 403 and 404, 404 and 405, 405 and 406, 406 and 407, 407 and 408, 408 and 409, 409 and 410, 410 and 411, 411 and 412, 412 and 413, 413 and 414, 414 and 415, 415 and 416, 416 and 417, 417 and 418, 418 and 419, 419 and 420, 420 and 421, 421 and 422, 422 and 423, 423 and 424, 424 and 425, 425 and 426, 426 and 427, 427 and 428, 428 and 429, 429 and 430, 430 and 431, 431 and 432, 432 and 433, 433 and 434, 434 and 435, 435 and 436, 436 and 437, 437 and 438, 438 and 439, 439 and 440, 440 and 441, 441 and 442, 442 and 443, 443 and 444, 444 and 445, 445 and 446, 446 and 447, 447 and 448, 448 and 449, 449 and 450, 450 and 451, 451 and 452, 452 and 453, 453 and 454, 454 and 455, 455 and 456, 456 and 457, 457 and 458, 458 and 459, 459 and 460, 460 and 461, 461 and 462, 462 and 463, 463 and 464, 464 and 465, 465 and 466, 466 and 467, 467 and 468, 468 and 469, 469 and 470, 470 and 471, 471 and 472, 472 and 473, 473 and 474, 474 and 475, 475 and 476, 476 and 477, 477 and 478, 478 and 479, 479 and 480, 480 and 481, 481 and 482, 482 and 483, 483 and 484, 484 and 485, 485 and 486, 486 and 487, 487 and 488, 488 and 489, 489 and 490, 490 and 491, 491 and 492, 492 and 493, 493 and 494, 494 and 495, 495 and 496, 496 and 497, 497 and 498, 498 and 499, 499 and 500, 501 and 502, 502 and 503, 503 and 504, 504 and 505, 505 and 506, 506 and 507, 507 and 508, 508 and 509, 509 and 510, 510 and 511, 511 and 512, 512 and 513, 513 and 514, 514 and 515, 515 and 516, 516 and 517, 517 and 518, 518 and 519, 519 and 520, 520 and 521, 521 and 522, 522 and 523, 523 and 524, 524 and 525, 525 and 526, 526 and 527, 527 and 528, 528 and 529, 529 and 530, 530 and 531, 531 and 532, 532 and 533, 533 and 534, 534 and 535, 535 and 536, 536 and 537, 537 and 538, 538 and 539, 539 and 540, 540 and 541, 541 and 542, 542 and 543, 543 and 544, 544 and 545, 545 and 546, 546 and 547, 547 and 548, 548 and 549, 549 and 550, 550 and 551, 551 and 552, 552 and 553, 553 and 554, 554 and 555, 555 and 556, 556 and 557, 557 and 558, 558 and 559, 559 and 560, 560 and 561, 561 and 562, 562 and 563, 563 and 564, 564 and 565, 565 and 566, 566 and 567, 567 and 568, 568 and 569, 569 and 570, 570 and 571, 571 and 572, 572 and 573, 573 and 574, 574 and 575, 575 and 576, 576 and 577, 577 and 578, 578 and 579, 579 and 580, 580 and 581, 581 and 582, 582 and 583, 583 and 584, 584 and 585, 585 and 586, 586 and 587, 587 and 588, 588 and 589, 589 and 590, 590 and 591, 591 and 592, 592 and 593, 593 and 594, 594 and 595, 595 and 596, 596 and 597, 597 and 598, 598 and 599, 599 and 600, 601 and 602, 602 and 603, 603 and 604, 604 and 605, 605 and 606, 606 and 607, 607 and 608, 608 and 609, 609 and 610, 610 and 611, 611 and 612, 612 and 613, 613 and 614, 614 and 615, 615 and 616, 616 and 617, 617 and 618, 618 and 619, 619 and 620, 620 and 621, 621 and 622, 622 and 623, 623 and 624, 624 and 625, 625 and 626, 626 and 627, 627 and 628, 628 and 629, 629 and 630, 630 and 631, 631 and 632, 632 and 633, 633 and 634, 634 and 635, 635 and 636, 636 and 637, 637 and 638, 638 and 639, 639 and 640, 640 and 641, 641 and 642, 642 and 643, 643 and 644, 644 and 645, 645 and 646, 646 and 647, 647 and 648, 648 and 649, 649 and 650, 650 and 651, 651 and 652, 652 and 653, 653 and 654, 654 and 655, 655 and 656, 656 and 657, 657 and 658, 658 and 659, 659 and 660, 660 and 661, 661 and 662, 662 and 663, 663 and 664, 664 and 665, 665 and 666, 666 and 667, 667 and 668, 668 and 669, 669 and 670, 670 and 671, 671 and 672, 72 and 673, 673 and 674, 674 and 675, 675 and 676, 676 and 677, 677 and 678, 678 and 679, 679 and 680, 680 and 681, 681 and 682, 682 and 683, 683 and 684, or 684 and 685 of an NS3/4A polypeptide (e.g., SEQ ID NO: 2) or NS3/4A variant polypeptide, (e.g. SEQ ID NO: 36), or fragment thereof. In preferred embodiments, the chimeric NS3/4A polypeptides can consist of, consist essentially of, or comprise an antigen, TCE, antigen and linker, TCE and linker, antigen and adjuvant sequence, TCE and adjuvant sequence, antigen and linker and adjuvant sequence, or TCE and linker and adjuvant sequence inserted between amino acids 453 and 513 of SEQ ID NO:36, or in an analogous position in any NS3/4A polypeptide.

In some embodiments, the chimeric NS3/4A polypeptide includes an antigen, TCE, antigen and linker, TCE and linker, antigen and adjuvant sequence, TCE and adjuvant sequence, antigen and linker and adjuvant sequence, or TCE and linker and adjuvant sequence that is juxtaposed to or flanking the NS3/4A polypeptide or a fragment thereof. For example, the TCE can be juxtaposed to or flanking the N-terminal or C-terminal end of the chimeric NS3/4A polypeptide or NS3/4A variant. In preferred embodiments, the chimeric NS3/4A polypeptides retain NS3 protease activity, and/or NS3 helicase activity.

In some embodiments, the TCE can be derived from antigens such as viral antigens, bacterial antigens, parasitic antigens, tumor antigens, allergens and toxins. For example, in some embodiments, the TCE comprises a sequence selected from the group consisting of SEQ ID NOs: 221-571 and SEQ ID NOs:809-1011 and SEQ ID NO:1014 and SEQ ID NOs:

1016-1034 and SEQ ID NOs: 1146-1173 and SEQ ID NOs: 1210-1328. In preferred embodiments, the encoded TCE or antigen is obtained from a hepatitis virus, such as an antigen from the Hepatitis A virus (HAV), Hepatitis B virus (HBV), or HCV or HIV, flu, Birch allergens or malaria. For example, in some embodiments, the TCE comprises the amino acid sequence of SEQ ID NO:1014. Antigens and TCEs that are present on pathogens that infect domestic animals are also embodied. That is, some embodiments include veterinary preparations that comprise a NS3/4A platform, as described herein, and an antigen present on an animal pathogen (e.g., swine flu, avian flu, or equine flu).

Another embodiment disclosed herein includes a composition that comprises a recombinant peptide immunogen comprising at least one antigen and a hepatitis C virus (HCV) NS3 protease cleavage site, wherein the HCV NS3 protease cleavage site is joined to the antigen at a position that is not naturally occurring. In some embodiments, the antigen comprises an epitope from a plant, virus, bacteria, or a cancer cell. In other embodiments, the antigen is not a peptide from HCV. In still other embodiments, the antigenic fragment comprises an epitope from birch, peanut, wheat protein, a hepatitis viral protein, a hepatitis B viral protein, or hepatitis B virus core protein (HBcAg). In other embodiments, the antigenic fragment comprises a fragment of an antigen presented in SEQ ID NOs: 1016-1034, SEQ ID NOs: 1146-1173 and SEQ ID NOs: 1210-1328.

In some aspects, the recombinant peptide immunogen comprises a plurality of NS3 protease cleavage sites. In some embodiments, the NS3 protease cleavage site is chosen from the group consisting of NS3/4A, NS4A/B, NS4B/5A, and NS5A/B. In some embodiments, the HCV NS3 protease cleavage site comprises the sequence: SADLEVVTSTWV-LVGGVL (SEQ ID NO: 1340). In other embodiments, the HCV NS3 protease cleavage site comprises the sequence: DEMEECSQHLPYIEQG (SEQ ID NO: 1341). In still other embodiments, the HCV NS3 protease cleavage site comprises a sequence from the sequences presented below:

| HCV Strain name: | Amino acid sequence: | Junction | SEQ ID: |
|---|---|---|---|
| H-FDA | CMSADLEVVT↓STWVLVGGVL | NS3/4A | 1342 |
| H-AP | CMSADLEVVT↓STWVLVGGVL | NS3/4A | 1343 |
| HCV-1 | CMSADLEVVT↓STWVLVGGVL | NS3/4A | 1344 |
| HCV-J | CMSADLEVVT↓STWVLVGGVL | NS3/4A | 1345 |
| HCV-BK | CMSADLEVVT↓STWVLVGGVL | NS3/4A | 1346 |
| HC-J6 | CMQADLEVMT↓STWVLAGGVL | NS3/4A | 1347 |
| HCV-T | CMSADLEVVT↓STWVLVGGVL | NS3/4A | 1348 |
| HC-J8 | CMQADLEIMT↓SSWVLAGGVL | NS3/4A | 1349 |
| HCV-JT, JT' | CMSAQLEVVT↓STWVLVGGVL | NS3/4A | 1350 |
| H-FDA | YQEFDEMEEC↓SQHLPYIEQG | NS4A/4B | 1351 |
| H-AP | YQEFDEMEEC↓SQHLPYIEQG | NS4A/4B | 1352 |
| HCV-1 | YREFDEMEEC↓SQHLPYIEQG | NS4A/4B | 1353 |
| HCV-J | YQEFDEMEEC↓ASHLPYIEQG | NS4A/4B | 1354 |
| HCV-BK | YQEFDEMEEC↓ASHLPYIEQG | NS4A/4B | 1355 |
| HC-J1, 4 | YEAFDEMEEC↓ASRAALIEEG | NS4A/4B | 1356 |
| HCV-T | YQEFDEMEEC↓ASHLPYIEQG | NS4A/4B | 1357 |
| HC-J8 | YQAFDEMEEC↓ASKAALIEEG | NS4A/4B | 1358 |
| HCV-JT, JT' | YREFDEMEEC↓ASHLPYIEQG | NS4A/4B | 1359 |
| H-FDA | WISSECTTPC↓SGSWLRDIWD | NS4B/5A | 1360 |
| H-AP | WISSECTTPC↓SGSWLRDIWD | NS4B/5A | 1361 |
| HCV-1 | WISSECTTPC↓SGSWLRDIWD | NS4B/5A | 1362 |
| HCV-J | WINEDCSTPC↓SGSWLKDVWD | NS4B/5A | 1363 |
| HCV-BK | WINEDCSTPC↓SGSWLRDVWD | NS4B/5A | 1364 |
| HC-J6 | WITEDCPIPC↓SGSWLRDVWD | NS4B/5A | 1365 |
| HCV-T | WINEDCSTPC↓SGSWLRDVWD | NS4B/5A | 1366 |
| HC-J8 | WITEDCPVPC↓SGSWLQDIWD | NS4B/5A | 1367 |
| HCV-JT | WINEDCSTPC↓SGSWLKDVWD | NS4B/5A | 1368 |
| HCV-JT' | WINEDCSTPC↓SGSWLRDVWD | NS4B/5A | 1369 |
| H-FDA | GADTEDVVCC↓SMSYTWTGAL | NS5A/5B | 1370 |
| H-AP | GADTEDVVCC↓SMSYSWTGAL | NS5A/5B | 1371 |
| HCV-1 | EANAEDVVCC↓SMSYSWTGAL | NS5A/5B | 1372 |
| HCV-J | GEAGEDVVCC↓SMSYTWTGAL | NS5A/5B | 1373 |
| HCV-BK | EEASEDVVCC↓SMSYTWTGAL | NS5A/5B | 1374 |
| HC-J6 | SEEDDSVVCC↓SMSYTWTGAL | NS5A/5B | 1375 |
| HCV-T | EEDGEGVICC↓SMSYTWTGAL | NS5A/5B | 1376 |
| HC-J8 | SDQEDSVICC↓SMSYSWTGAL | NS5A/5B | 1377 |
| HCV-JT, JT' | GEASDDIVCC↓SMSYTWTGAL | NS5A/5B | 1378 |
| CONSENSUS | D       C↓S | | |
| CONSENSUS | E       T↓A | | |

In other aspects, the recombinant peptide immunogen comprises a plurality of antigenic fragments of a protein assembled in a non-naturally occurring order. In other aspects, the recombinant peptide immunogen comprises a plurality of antigenic fragments of a protein assembled in a naturally occurring order. In still other aspects, the recombinant peptide immunogen comprises a plurality of antigenic fragments from at least two different proteins assembled in a non-naturally occurring order.

In more aspects, the composition further comprises an NS3/4A peptide. In some embodiments, the NS3/4A peptide comprises a mutation that enhances protease activity. In some embodiments, the mutation is selected from the group consisting of Tyr6Ala, Arg11Ala, Leu13Ala, Leu14Ala, Glu30Ala, Cys52Ala, Gly58Ala, Ala59Gly, Ile64Ala, Ile64Ala, Gln73Ala, Thr76Ala, Pro86Ala, Ala111Gly, Gly122Ala, Tyr 134Ala, Lys 136Ala, Gly 141Ala, Val158Ala, Arg161Ala, Ala166Gly, and Thr177Ala. In some embodiments, the NS3/4A peptide is joined to the peptide immunogen. In some embodiments, the NS3/4A peptide is C-terminal with respect to the peptide immunogen. In other embodiments, the NS3/4A peptide is N-terminal with respect to the peptide immunogen. In still other embodiments, the NS3/4A peptide is inserted within the peptide immunogen. In other embodiments, the peptide immunogen is inserted within the NS3/4A peptide. In yet other embodiments, the NS3/4A peptide is not joined to the peptide immunogen.

Another embodiment disclosed herein includes a composition that comprises a nucleic acid encoding a recombinant peptide immunogen comprising an antigen and a hepatitis C virus (HCV) NS3 protease cleavage site, wherein the HCV NS3 protease cleavage site is joined to the antigen at a position that is not naturally occurring. In some embodiments, the antigen comprises an epitope from a plant, virus, bacteria, or cancer cell. In some embodiments, the antigen is not a peptide from HCV. In some embodiments, the antigen is an antigenic fragment of a birch, peanut, wheat protein, an antigenic fragment of a hepatitis viral protein, an antigenic fragment of a hepatitis B virus protein, an antigenic fragment of the hepatitis B virus core protein (HBcAg).

In some aspects, the recombinant peptide immunogen comprises a plurality of NS3 protease cleavage sites. In some embodiments, the NS3 protease cleavage site is chosen from the group consisting of NS3/4A, NS4A/B, NS4B/5A, and NS5A/B. In some embodiments, the HCV NS3 protease cleavage site comprises the sequence: SADLEVVTSTWV-LVGGVL (SEQ ID NO: 1340). In other embodiments, the HCV NS3 protease cleavage site comprises the sequence: DMEECSQHLPYIEQG (SEQ ID NO: 1341).

In other aspects, the recombinant peptide immunogen comprises a plurality of antigenic fragments of a protein assembled in a non-naturally occurring order. In other aspects, the recombinant peptide immunogen comprises a plurality of antigenic fragments of a protein assembled in a naturally occurring order. In still other aspects, the recombinant peptide immunogen comprises a plurality of antigenic fragments from at least two different proteins assembled in a non-naturally occurring order. In some embodiments, a peptide immunogen described herein is not native to hepatitis C. In other embodiments, a peptide immunogen described herein is not native to a hepatitis virus. In other embodiments, a peptide immunogen described herein is not native to influenza.

In some aspects, the composition further comprises a nucleic acid encoding NS3/4A peptide. In some embodiments, the nucleic acid coding for NS3/4A peptide is codon-optimized for expression in a mammal or bird. In other embodiments, the nucleic acid coding the NS3/4A peptide is codon-optimized for expression in a human, dog, cat, horse, pig, cow, goat, or chicken In some embodiments, the NS3/4A peptide comprises a mutation that enhances protease activity. In some embodiments, the mutation is selected from the group consisting of Tyr6Ala, Arg11Ala, Leu13Ala, Leu14Ala, Glu30Ala, Cys52Ala, Gly58Ala, Ala59Gly, Ile64Ala, Ile64Ala, Gln73Ala, Thr76Ala, Pro86Ala, Ala111Gly, Gly 122Ala, Tyr 134Ala, Lys 136Ala, Gly 141Ala, Val158Ala, Arg161Ala, Ala166Gly, and Thr177Ala. In some embodiments, the nucleic acid encoding NS3/4A peptide is joined to the nucleic acid encoding the peptide immunogen. In yet other embodiments, the nucleic acid encoding NS3/4A peptide is not joined to the peptide immunogen.

In an alternative aspect, the composition further comprises the NS3/4A peptide. In some embodiments, the NS3/4A peptide comprises a mutation that enhances protease activity. In some embodiments, the mutation is selected from the group consisting of Tyr6Ala, Arg11Ala, Leu13Ala, Leu14Ala, Glu30Ala, Cys52Ala, Gly58Ala, Ala59Gly, Ile64Ala, Ile64Ala, Gln73Ala, Thr76Ala, Pro86Ala, Ala111Gly, Gly 122Ala, Tyr 134Ala, Lys 136Ala, Gly 141Ala, Val158Ala, Arg161Ala, Ala166Gly, and Thr177Ala. In some embodiment, the NS3/4A peptide is joined to the peptide immunogen. In some embodiments, the NS3/4A peptide is C-terminal with respect to the peptide immunogen. In other embodiments, the NS3/4A peptide is N-terminal with respect to the peptide immunogen. In still other embodiments, the NS3/4A peptide is inserted within the peptide immunogen. In other embodiments, the peptide immunogen is inserted within the NS3/4A peptide. In yet other embodiments, the NS3/4A peptide is not joined to the peptide immunogen.

It has been discovered that certain mutations in the NS3 domain of HCV allow for protease cleavage of some substrates but not others. More particularly, it was found that alanine substitution at positions 1050 and 1060 of the NS3 protease created protease molecules with altered substrate specificity. The HCV NS3 mutants V1050A and Q1060A were found to cleave at the NS3-NS4A junction but were unable to cleave the cellular substrate IPS-1/Cardif/MAVS/VISA. Since cleavage of IPS-1/Cardif/MAVS/VISA by wild-type NS3 reduces the response to the toll-like receptors (TLR-3) and the RIG-1 pathway, which in turn impairs interferon (IFN) alpha and beta signaling, it is contemplated that the HCV NS3 V1055A and Q1060A mutants allow for cleavage of the NS3-4A junction without reducing interferon alpha and beta signaling. Type I interferons are central mediators for antiviral responses. Interferon-promoter stimulator 1 (IPS-1) contains an N-terminal CARD-like structure that mediates interaction with the CARD of RIG-I and Mda5, which are cytoplasmic RNA helicases that sense viral infection. 'Knockdown' of IPS-1 by small interfering RNA blocks interferon induction by virus infection. Thus, IPS-1 is an adaptor involved in RIG-1- and Mda5-mediated antiviral immune responses.

Accordingly, HCV NS3 mutants V1055A and Q1060A, protease active fragments of these molecules containing said mutations, and nucleic acids encoding these molecules are therefore useful in the HCV immunogen fusion proteins or vaccines described herein for induction of an immune response against HCV when elevated interferon alpha and beta signaling (e.g., amounts of IFN-alpha or IFN-beta commensurate with amounts of IFN-alpha or IFN-beta in uninfected cells or an infected individual) is desired. Additionally, the HCV NS3 mutants V1050A and Q1060A, protease active fragments of these molecules containing said mutations, and nucleic acids encoding these molecules are useful as platforms for incorporation or attachment of heterologous peptides to which an immune response is desired when elevated interferon alpha and beta signaling (e.g., amounts of IFN-alpha or IFN-beta commensurate with amounts of IFN-alpha or IFN-beta in uninfected cells or an infected individual) is preferred. Furthermore, HCV NS3 mutants V1050A and Q1060A, protease active fragments of these molecules containing said mutations, and nucleic acids encoding these molecules can be provided in combination with other immunogenic peptides or nucleic acids encoding immunogenic peptides so as induce an adjuvant activity toward said immunogenic peptides or to otherwise induce an immune response characterized by interferon alpha and beta signaling commensurate with that observed in uninfected cells or an uninfected individual.

Embodiments comprise, consist, or consist essentially of the peptides (SEQ. ID. NOS.:68, 73, and 1329) or fragments thereof that retain protease activity, nucleic acids encoding these molecules, vectors having said nucleic acids, and cells having said vectors, nucleic acids, or peptides. Additional embodiments include an NS3 or NS3/4A encoding nucleic acid or fragment thereof or corresponding peptide, which comprise a sequence that was optimized for codons most frequently used in humans. That is, more embodiments comprise, consist, or consist essentially of nucleic acids that have been codon optimized for expression in humans, which encode the mutant HCV peptides described herein (e.g., SEQ. ID. NOS.:68, 73, and 1329) or fragments thereof that retain protease activity. Vectors having said codon-optimized nucleic acids, immunogenic preparations, and vaccines having said codon-optimized nucleic acids and vectors and cells having said vectors are also embodiments. Preferred embodiments include DNA immunogens that comprise, consist, or consist essentially of nucleic acids encoding SEQ. ID. NOS 68, 73, and 1329 or a fragment thereof that retain protease activity. These DNA immunogens can be provided to cells by transfection, injection, electroporation, needle electroporation (e.g., Medpulsar or Elgin), gene gun, transdermal application, or intranasal application.

In one embodiment, specific mutations of the NS3 protease domain can be made and screened to find specific mutants that have little effect, no effect, or heightened effect on protease cleavage at the NS3-NS4a cleavage site while losing the ability to cleave IPS-1 to ΔIPS-1. In a preferred embodiment, amino acids 1053 through 1062 of the NS3/4A gene, corresponding to amino acids 27 through 36 of SEQ ID NOs.: 1330-1339 have been identified as affecting the specificity of the NS3 protease domain. Accordingly, mutations in this region of the NS3/4A or fragments containing mutations in this region can be selected for their ability to cleave the NS3-NS4A cleavage site while being unable to cleave IPS-1 to ΔIPS-1.

A large scale mutational analysis of HCV NS3 domain was undertaken. This project produced a variety of truncated versions of the NS3/4A peptide (e.g., SEQ. ID. NOs.: 12 and 13) and mutants that lacked a proteolytic cleavage site (e.g., SEQ. ID. NOs.: 3-11). Other HCV NS3 mutants were found to have altered protease activity (e.g., SEQ ID NOs: 40-220). For example, some mutants, which have an alanine substitution or a glycine substitution in the NS3 protease domain were found to have an abolished, reduced, enhanced, or greatly enhanced protease activity. Exemplary mutants include SEQ ID NO: 40, SEQ ID NO: 41, SEQ ID NO: 42, SEQ ID NO:43, SEQ ID NO: 44, SEQ ID NO: 45, SEQ ID NO: 46, SEQ ID NO: 47, SEQ ID NO:48, SEQ ID NO: 49, SEQ ID NO: 50, SEQ ID NO: 51, SEQ ID NO: 52, SEQ ID NO; 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO; 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, or SEQ ID NO: 220. Accordingly, regions of the NS3 domain, which retained protease activity was carefully mapped by mutational analysis. Surprisingly, approximately 87% of the protease residues could be replaced and protease activity was retained.

Aspects of the present invention include compositions that comprise, consist, or consist essentially of the nucleic acid sequence provided by the sequence of SEQ. ID. NO.: 35 and/or the peptide sequence provided by the sequence of SEQ. ID. NO.: 36. Preferred embodiments, for example, include compositions that comprise, consist or consist essentially of any number of consecutive nucleotides between at least 12-2112 nucleotides of SEQ. ID. NO.: 35 or a complement thereof (e.g., 12-15, 15-20, 20-30, 30-50, 50-100, 100-200, 200-500, 500-1000, 1000-1500, 1500-2079, or 1500-2112 consecutive nucleotides). Preferred embodiments also include compositions that comprise, consist or consist essentially of any number of consecutive nucleotides between at least 12-2112 nucleotides of SEQ. ID. NO.: 35 or a complement thereof (e.g., at least 3, 4, 6, 8, 10, 12, 15, 20, 30, 40, 50, 60, 70, 80, 90, or 100 consecutive nucleotides acids of SEQ. ID. NO.: 35). Additional embodiments include nucleic acids that comprise, consist, or consist essentially of a sequence that encodes SEQ. ID. NO.: 36 or a fragment thereof, that is, any number of consecutive amino acids between at least 3-50 amino acids of SEQ. ID. NO.: 36 (e.g., 3, 4, 6, 8, 10, 12, 15, 20, 25, 30, 35, 40, 45, or 50 consecutive amino acids). Still more embodiments include peptides that comprises, consist, or consist essentially of the sequence of SEQ. ID. NO.: 36 or a fragment thereof, that is, any number of consecutive amino acids between at least 3-50 amino acids of SEQ. ID. NO.: 36 (e.g., 3, 4, 6, 8, 10, 12, 15, 20, 25, 30, 35, 40, 45, or 50 consecutive amino acids).

Other preferred embodiments include compositions that comprise, consist, or consist essentially of any number of consecutive nucleotides between at least 12-2112 nucleotides that encode the polypeptides of SEQ ID NO: 40, SEQ ID NO: 41, SEQ ID NO: 42, SEQ ID NO:43, SEQ ID NO: 44, SEQ ID NO: 45, SEQ ID NO: 46, SEQ ID NO: 47, SEQ ID NO:48, SEQ ID NO: 49, SEQ ID NO: 50, SEQ ID NO: 51, SEQ ID NO: 52, SEQ ID NO; 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO; 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO:

144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, or SEQ ID NO: 220, wherein the nucleic acid includes the coding sequence for the mutation in the NS3 protease domain of the above NS3/NS4A polypeptides, or a complement thereof, (e.g., 12-15, 15-20, 20-30, 30-50, 50-100, 100-200, 200-500, 500-1000, 1000-1500, 1500-2079, or 1500-2112 consecutive nucleotides).

Methods of making and using the compositions described herein are also provided. In addition to methods of making the embodied nucleic acids and peptides, other embodiments include methods of making immunogens and/or vaccine compositions that can be used to treat or prevent HCV infection. Some methods are practiced, for example, by mixing an adjuvant with a peptide or nucleic acid antigen (e.g., an HCV peptide or HCV nucleic acid), as described above, so as to formulate a single composition (e.g., a vaccine composition). Preferred methods involve the mixing of ribavirin with an HCV gene or antigen disclosed herein.

Preferred methods of using the compositions described herein involve providing an animal in need of an immune response to HCV with a sufficient amount of one or more of the nucleic acid or peptide embodiments described herein. By one approach, for example, an animal in need of an immune response to HCV (e.g., an animal at risk or already infected with HCV, such as a human) is identified and said animal is provided an amount of NS3/4A (SEQ. ID. NO.: 2 or SEQ. ID. NO.: 36), a mutant NS3/4A (SEQ. ID. NOs.: 3-13), a fragment thereof (e.g., SEQ. ID. NOs.: 14-26) or a nucleic acid encoding said molecules that is effective to enhance or facilitate an immune response to the hepatitis viral antigen. Additional methods are practiced by identifying an animal in need of a potent immune response to HCV and providing said animal a composition comprising a peptide comprising an antigen or epitope present on SEQ. ID. NOs.: 2-27 or SEQ. ID. NO.: 36 or a nucleic acid encoding said peptides. Particularly preferred methods involve the identification of an animal in need of an immune response to HCV and providing said animal a composition comprising an amount of HCV antigen (e.g., NS3/4A (SEQ. ID. NO.: 2 or SEQ. ID. NO.: 36)), mutant NS3/4A (SEQ. ID. NOs.: 3-13), a fragment thereof containing any number of consecutive amino acids between at least 3-50 amino acids (e.g., 3, 4, 6, 8, 10, 12, 15, 20, 25, 30, 35, 40, 45, or 50 consecutive amino acids) of SEQ. ID. NO.: 2 or SEQ. ID. NO.: 36 (e.g., SEQ. ID. NOs.: 14-26) or a nucleic acid encoding one or more of these molecules that is sufficient to enhance or facilitate an immune response to said antigen. In some embodiments, the composition described above also contains an amount of ribavirin that provides an adjuvant effect.

Other approaches concern identifying an animal in need of an immune response to HCV and providing an amount of NS3/4A polypeptides with altered protease activity, or mutations in the NS3 protease domain (e.g., SEQ. ID. NO SEQ ID NO: 40, SEQ ID NO: 41, SEQ ID NO: 42, SEQ ID NO:43, SEQ ID NO: 44, SEQ ID NO: 45, SEQ ID NO: 46, SEQ ID NO: 47, SEQ ID NO:48, SEQ ID NO: 49, SEQ ID NO: 50, SEQ ID NO: 51, SEQ ID NO: 52, SEQ ID NO; 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO; 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, or SEQ ID NO: 220, a fragment thereof, or a nucleic acid encoding said molecules that is effective to enhance or facilitate an immune response to the hepatitis viral antigen. Additional methods are practiced by identifying an animal in need of a potent immune response to HCV and providing said animal a composition comprising a peptide comprising an antigen or epitope present on SEQ. ID. NO SEQ ID NO: 40, SEQ ID NO: 41, SEQ ID NO: 42, SEQ ID NO:43, SEQ ID NO: 44, SEQ ID NO: 45, SEQ ID NO: 46, SEQ ID NO: 47, SEQ ID NO:48, SEQ ID NO: 49, SEQ ID NO: 50, SEQ ID NO: 51, SEQ ID NO: 52, SEQ ID NO; 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO; 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, or SEQ ID NO: 220 or a nucleic acid encoding said peptides. Particularly preferred methods involve the identification of an animal in need of an immune response to HCV and providing said animal a composition comprising an amount of HCV antigen (e.g. SEQ. ID. NO SEQ ID NO: 40, SEQ ID NO: 41, SEQ ID NO: 42, SEQ ID NO:43, SEQ ID NO: 44, SEQ ID NO: 45, SEQ ID NO: 46, SEQ ID NO: 47, SEQ ID NO:48, SEQ ID NO: 49, SEQ ID NO: 50, SEQ ID NO: 51, SEQ ID NO: 52, SEQ ID NO; 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO; 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220), a fragment thereof containing any number of consecutive amino acids between at least 3-50 amino acids, wherein the fragment includes the mutation in the NS3 protease domain, (e.g., 3, 4, 6, 8, 10, 12, 15, 20, 25, 30, 35, 40, 45, or 50 consecutive amino acids), or a nucleic acid encoding one or more of these molecules that is sufficient to enhance or facilitate an immune response to said antigen. In some embodiments, the composition described above also contains an amount of ribavirin that provides an adjuvant effect.

In still more embodiments, for example, a gene gun is used to administer an HCV nucleic acid described herein (e.g., SEQ. ID. NO.: 35 or fragment thereof, as described above) to a mammalian subject in need of an immune response to HCV. In some embodiments, an amount of ribavirin is mixed with the DNA immunogen prior to delivery with the gene gun. In other embodiments, the DNA immunogen is provided by gene gun shortly before or after administration of ribavirin at or near the same site of DNA inoculation. For example, in some embodiments, a gene gun or a transdermal delivery system is used to administer HCV nucleic acids including nucleic acids encoding the NS3/NS4A polypeptides with altered protease activity. Accordingly, a gene gun or a transdermal delivery system is used to deliver nucleotides encoding the NS3/NS4A polypeptides of SEQ ID NO: 40, SEQ ID NO: 41, SEQ ID NO: 42, SEQ ID NO:43, SEQ ID NO: 44, SEQ ID NO: 45, SEQ ID NO: 46, SEQ ID NO: 47, SEQ ID NO:48, SEQ ID NO: 49, SEQ ID NO: 50, SEQ ID NO: 51, SEQ ID NO: 52, SEQ ID NO; 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO; 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, and SEQ ID NO: 220, or fragments thereof that contain the mutation in the NS3 protease domain, either with or without ribavirin.

In still other embodiments, transdermal delivery systems are used to deliver an HCV polypeptide described herein to a mammalian subject in need of an immune response to HCV. In some embodiments, an amount of ribavirin is mixed and delivered transdermally with the HCV polypeptide. In other embodiments, an amount of ribavirin is transdermally delivered to a mammal shortly before or shortly after transdermal delivery of the HCV polypeptide, at or near the same site as the polypeptide. For example, embodiments include transdermal delivery of NS3/NS4A polypeptides having altered protease activity. Thus, in some embodiments, the NS3/NS4A polypeptides of SEQ ID NO: 40, SEQ ID NO: 41, SEQ ID NO: 42, SEQ ID NO:43, SEQ ID NO: 44, SEQ ID NO: 45, SEQ ID NO: 46, SEQ ID NO: 47, SEQ ID NO:48, SEQ ID NO: 49, SEQ ID NO: 50, SEQ ID NO: 51, SEQ ID NO: 52, SEQ ID NO; 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO; 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, and SEQ ID NO: 220 are delivered transdermally to a mammalian subject in need of an immune response to HCV, either with or without ribavirin.

Some embodiments relate to methods of inducing an immune response to Hepatitis C Virus using any of the peptides, nucleic acids, nucleic acids encoding said peptides, peptide fragments, or nucleic acids encoding said peptide fragments described herein.

Other embodiments relate to methods of inducing an immune response to heterologous antigen joined to or co-administered with the peptides, nucleic acids, nucleic acids encoding said peptides, peptide fragments, or nucleic acids encoding said peptide fragments described herein. In some aspects the heterologous antigen is chemically fused to the peptides, nucleic acids, nucleic acids encoding said peptides, peptide fragments, or nucleic acids encoding said peptide fragments described herein. In other aspects the heterologous antigen is co-administered to the peptides, nucleic acids, nucleic acids encoding said peptides, peptide fragments, or nucleic acids encoding said peptide fragments described herein. In still other aspects the heterologous antigen is administered before administration of the peptides, nucleic acids, nucleic acids encoding said peptides, peptide fragments, or nucleic acids encoding said peptide fragments described herein. In other aspects the heterologous antigen is administered after administration of the peptides, nucleic acids, nucleic acids encoding said peptides, peptide fragments, or nucleic acids encoding said peptide fragments described herein.

In some aspects, nucleic acids encoding heterologous antigens described herein that are joined to or co-administered with the nucleic acids, nucleic acids encoding said peptides, peptide fragments, or nucleic acids encoding said peptide fragments described herein are at least, at least about, less than, or less than about 3 nucleotides, 4 nucleotides, 5 nucleotides, 6 nucleotides, 7 nucleotides, 8 nucleotides, 9 nucleotides, 10 nucleotides, 11 nucleotides, 12 nucleotides, 13 nucleotides, 14 nucleotides, 15 nucleotides, 16 nucleotides, 17 nucleotides, 18 nucleotides, 19 nucleotides, 20 nucleotides, 21 nucleotides, 22 nucleotides, 23 nucleotides, 24 nucleotides, 25 nucleotides, 26 nucleotides, 27 nucleotides, 28 nucleotides, 29 nucleotides, 30 nucleotides, 31 nucleotides, 32 nucleotides, 33 nucleotides, 34 nucleotides, 35 nucleotides, 36 nucleotides, 37 nucleotides, 38 nucleotides, 39 nucleotides, 40 nucleotides, 41 nucleotides, 42 nucleotides, 43 nucleotides, 44 nucleotides, 45 nucleotides, 46 nucleotides, 47 nucleotides, 48 nucleotides, 49 nucleotides, 50 nucleotides, 55 nucleotides, 60 nucleotides, 65 nucleotides, 70 nucleotides, 75 nucleotides, 80 nucleotides, 85 nucleotides, 90 nucleotides, 95 nucleotides, 100 nucleotides, 110 nucleotides, 120 nucleotides, 130 nucleotides, 140 nucleotides, 150 nucleotides, 160 nucleotides, 170 nucleotides, 180 nucleotides, 190 nucleotides, 200 nucleotides, 250 nucleotides, 300 nucleotides, 350 nucleotides, 400 nucleotides, 450 nucleotides, 500 nucleotides, 550 nucleotides, 600 nucleotides, 650 nucleotides, 700 nucleotides, 750 nucleotides, 800 nucleotides, 850 nucleotides, 900 nucleotides, 950 nucleotides, 1000 nucleotides, 1100 nucleotides, 1200 nucleotides, 1300 nucleotides, 1400 nucleotides, 1500 nucleotides, 1600 nucleotides, 1700 nucleotides, 1800 nucleotides, 1900 nucleotides, 2000 nucleotides, 2500 nucleotides, 3000 nucleotides, 3500 nucleotides, 4000 nucleotides, 4500 nucleotides, 5000 nucleotides, 6000 nucleotides, 7000 nucleotides, 8000 nucleotides, 9000 nucleotides, 10,000 nucleotides in length.

In some aspects, heterologous antigens described herein that are joined to or co-administered with the nucleic acids, nucleic acids encoding said peptides, peptide fragments, or nucleic acids encoding said peptide fragments described herein are at least, at least about, less than, or less than about 3 amino acids, 4 amino acids, 5 amino acids, 6 amino acids, 7 amino acids, 8 amino acids, 9 amino acids, 10 amino acids, 11 amino acids, 12 amino acids, 13 amino acids, 14 amino acids, 15 amino acids, 16 amino acids, 17 amino acids, 18 amino acids, 19 amino acids, 20 amino acids, 21 amino acids, 22 amino acids, 23 amino acids, 24 amino acids, 25 amino acids, 26 amino acids, 27 amino acids, 28 amino acids, 29 amino acids, 30 amino acids, 31 amino acids, 32 amino acids, 33 amino acids, 34 amino acids, 35 amino acids, 36 amino acids, 37 amino acids, 38 amino acids, 39 amino acids, 40 amino acids, 41 amino acids, 42 amino acids, 43 amino acids, 44 amino acids, 45 amino acids, 46 amino acids, 47 amino acids, 48 amino acids, 49 amino acids, 50 amino acids, 55 amino acids, 60 amino acids, 65 amino acids, 70 amino acids, 75 amino acids, 80 amino acids, 85 amino acids, 90 amino acids, 95 amino acids, 100 amino acids, 110 amino acids, 120 amino acids, 130 amino acids, 140 amino acids, 150 amino acids, 160 amino acids, 170 amino acids, 180 amino acids, 190 amino acids, 200 amino acids, 250 amino acids, 300 amino acids, 350 amino acids, 400 amino acids, 450 amino acids, 500 amino acids, 550 amino acids, 600 amino acids, 650 amino acids, 700 amino acids, 750 amino acids, 800 amino acids, 850 amino acids, 900 amino acids, 950 amino acids, 1000 amino acids, 1100 amino acids, 1200 amino acids, 1300 amino acids, 1400 amino acids, 1500 amino acids, 1600 amino acids, 1700 amino acids, 1800 amino acids, 1900 amino acids, 2000 amino acids, 2500 amino acids, 3000 amino acids, 3500 amino acids, 4000 amino acids, 4500 amino acids, 5000 amino acids, 6000 amino acids, 7000 amino acids, 8000 amino acids, 9000 amino acids, 10,000 amino acids in length.

Still other embodiments relate to methods of inducing an immune response as described herein when cleavage of IPS-1 to Δ IPS-1 is not desired.

Other embodiments relate to methods of inducing an immune response as described herein wherein repression of IFNα and/or IFNβ is not desired. This is particularly useful when raising an immune response to HCV because HCV NS3/4A represses IFNα and IFNβ expression through proteolytic cleavage of IPS-1.

One embodiment relates to a method of enhancing an immune response to a hepatitis C antigen comprising identifying an animal in need of an enhanced immune response to a hepatitis C antigen and providing to said animal a composition comprising a nucleic acid sequence that encodes a peptide comprising an NS3 protease domain that cleaves NS3-NS4A cleavage site but does not cleave IPS-1 to ΔIPS-1.

Another embodiment relates to a method of enhancing an immune response to a hepatitis C antigen comprising identifying an animal in need of an enhanced immune response to a hepatitis C antigen and providing to said animal a peptide that comprises an NS3 protease domain that cleaves NS3-NS4A cleavage site but does not cleave IPS-1 to ΔIPS-1. In one aspect of the embodiments, the composition further comprises ribavirin. In another aspect of the embodiments, the peptide used is selected from the group consisting of SEQ ID NO: 68, SEQ ID NO: 73, SEQ ID NO: 1329, SEQ ID NO: 1330, SEQ ID NO: 1331, SEQ ID NO: 1332, SEQ ID NO: 1333, SEQ ID NO: 1334, SEQ ID NO: 1335, SEQ ID NO: 1336, SEQ ID NO: 1337, SEQ ID NO: 1338, and SEQ ID NO: 1339.

Another embodiment relates to a method of enhancing an immune response to a hepatitis C antigen comprising identifying an animal in need of an enhanced immune response to a hepatitis C antigen and providing to said animal a composition comprising at least 100 consecutive nucleotides of a nucleic acid sequence that encodes a peptide comprising an NS3 protease domain that cleaves NS3-NS4A cleavage site but does not cleave IPS-1 to ΔIPS-1, wherein said nucleic acid codes for a peptide fragment that retains the ability to cleave the NS3-NS4A cleavage site but not cleave IPS-1 to ΔIPS-1.

Still another embodiment relates to a method of enhancing an immune response to a hepatitis C antigen comprising identifying an animal in need of an enhanced immune response to a hepatitis C antigen and providing to said animal a composition comprising a peptide comprising at least 34 amino acids of an NS3 protease domain that cleaves NS3-NS4A cleavage site but does not cleave IPS-1 to ΔIPS-1, wherein said peptide fragment retains the ability to cleave the NS3-NS4A cleavage site but not cleave IPS-1 to ΔIPS-1.

One embodiments relates to a purified or isolated nucleic acid encoding a polypeptide comprising an NS3/NS4A polypeptide that cleaves NS3-NS4A cleavage site but cannot cleave IPS-1 to ΔIPS-1 wherein the polypeptide is SEQ ID NO. 1329.

In one aspect, the mutant NS3/4A peptide has altered cleavage specificity for host proteins. In another aspect, the nucleic acid is part of a composition. In some aspects, the composition further comprises ribavirin.

One embodiment relates to a purified or isolated nucleic acid encoding a mutant NS/4A peptide with retained protease activity, wherein said mutant NS3/4A peptide has altered cleavage specificity for host proteins.

One embodiment relates to a method of enhancing an immune response to a hepatitis C antigen comprising identifying an animal in need of an enhanced immune response to a hepatitis C antigen; and administering to said animal a composition a purified or isolated nucleic acid encoding a mutant NS/4A peptide with retained protease activity, wherein said mutant NS3/4A peptide has altered cleavage specificity for host proteins. In one aspect, the composition further comprises ribavirin. In another aspect of the method, ribavirin is co-administered. In yet another aspect, the co-administration of ribavirin is immediately before or immediately after the administration of said composition. In yet another aspect of the embodiments described herein, the site of said administration, or a region proximal to said site of administration, is contacted with an electrode configured for electroporation of a nucleic acid.

Vectors that include the isolated nucleic acids or that encode the isolated polypeptides described herein are also embodiments. Compositions that include the nucleic acids, polypeptides, and vectors described herein (e.g., vials, tubes, hypodermic needles, electroporation devices, oils, and transdermal delivery compositions) are also embodiments. Cells that include these vectors are also provided herein. For example, in some embodiments, the nucleic acids described herein are inserted into an expression vector such as a pVAX™ expression vector or are inserted into a Semliki forest virus vector and these expression constructs are provided to a subject in need of an immune response to the antigen.

Stated differently, several embodiments described herein concern nucleic acids that encode a recombinant HCV NS3/4A chimeric molecule, wherein the nucleic acid encodes four domains (domain W, domain X, domain Y, and domain Z). Domain W can encode an NS3 protease domain prepared as described herein (e.g., a mutant or modified version), or fragment thereof, domain X can encode an NS3 helicase domain, or a fragment thereof, and domain Y can encode an NS4A co-factor domain, or a fragment thereof. Domain Z can encode an antigen, an epitope of a pathogen, a TCE, and/or the aforementioned molecules with or without a linker and/or adjuvant sequence. In preferred embodiments, the recombinant HCV NS3/4A chimeric polypeptide retains catalytic activity (e.g., protease, helicase, or protease and helicase activity). In preferred embodiments, domain Z is in a position within the recombinant nucleic acid and encoded chimeric polypeptide, which is non-naturally-occurring (e.g., when Z encodes an HCV antigen).

In some embodiments, the W domain comprises the nucleic acid sequence of residues 1-551 of an NS3/4A sequence such as SEQ ID NOs: 1 or 35, or an analogous sequence of any NS3/4A nucleic acid, or a fragment thereof (e.g., said fragment can comprise, consist of, or consist essentially of about at least, equal to, greater than, less than, or any number in between 9, 15, 30, 50, 75, 100, 125, 150, 175, 200, 250, or 300 consecutive nucleotides of the protease domain of SEQ. ID. Nos. 1 or 35). In some embodiments, the X domain can comprise the nucleic acid sequence of residues 218-1568 of SEQ ID NOs: 1 or 35, or an analogous sequence of any NS3/4A nucleic acid, or a fragment thereof (e.g., said fragment can comprise, consist of, or consist essentially of about at least, equal to, greater than, less than, or any number in between 9, 15, 30, 50, 75, 100, 125, 150, 175, 200, 250, or 300 consecutive nucleotides of the helicase domain of SEQ. ID. Nos. 1 or 35). In some embodiments, the Y domain can comprise the nucleic acid sequence of residues 1569-2069 of SEQ ID NOs: 1 or 35, or an analogous sequence of any NS3/4A nucleic acid, or a fragment thereof (e.g., said fragment can comprise, consist of, or consist essentially of about at least, equal to, greater than, less than, or any number in between 9, 15, 30, 50, 75, 100, 125, 150, 175, 200, 250, 300, or 350 consecutive nucleotides of the NS4A domain of SEQ. ID. Nos. 1 or 35). In preferred embodiments, the Z domain can comprise the nucleic acid sequence of an antigen, preferably a TCE, and more preferably a sequence selected from the group consisting of SEQ ID NOs: 221-571 and SEQ ID NOs:809-1011 and SEQ ID NO:1014.

In some embodiments, the Z domain is located within or flanking (e.g., juxtaposed or immediately adjacent to) said W domain. For example, the nucleic acid encoding the Z domain can place the encoded antigen between or next to amino acids 1 and 2, 2 and 3, 3 and 4, 4 and 5, 5 and 6, 6 and 7, 7 and 8, 8 and 9, 9 and 10, 10 and 11, 11 and 12, 12 and 13, 13 and 14, 14 and 15, 15 and 16, 16 and 17, 17 and 18, 18 and 19, 19 and 20, and 21, 21 and 22, 22 and 23, 23 and 24, 24 and 25, 25 and 26, 26 and 27, 27 and 28, 28 and 29, 29 and 30, 30 and 31, 31 and 32, 32 and 33, 33 and 34, 34 and 35, 35 and 36, 36 and 37, 37 and 38, 38 and 39, 39 and 40, 40 and 41, 41 and 42, 42 and 43, 43 and 44, 44 and 45, 45 and 46, 46 and 47, 47 and 48, 48 and 49, 49 and 50, 50 and 51, 51 and 52, 52 and 53, 53 and 54, 54 and 55, 55 and 56, 56 and 57, 57 and 58, 58 and 59, 59 and 60, 60 and 61, 61 and 62, 62 and 63, 63 and 64, 64 and 65, 65 and 66, 66 and 67, 67 and 68, 68 and 69, 69 and 70, 70 and 71, 71 and 72, 72 and 73, 73 and 74, 74 and 75, 75 and 76, 76 and 77, 77 and 78, 78 and 79, 79 and 80, 80 and 81, 81 and 82, 82 and 83, 83 and 84, 84 and 85, 85 and 86, 86 and 87, 87 and 88, 88 and 89, 89 and 90, 90 and 91, 91 and 92, 92 and 93, 93 and 94, 94 and 95, 95 and 96, 96 and 97, 97 and 98, 98 and 99, 99 and 100, 100 and 101, 101 and 102, 102 and 103, 103 and 104, 104 and 105, 105 and 106, 106 and 107, 107 and 108, 108 and 109, 109 and 110, 110 and 111, 111 and 112, 112 and 113, 113 and 114, 114 and 115, 115 and 116, 116 and 117, 117 and 118, 118 and 119, 119 and 120, 120 and 121, 121 and 122, 122 and 123, 123 and 124, 124 and 125, 125 and 126, 126 and 127, 127 and 128, 128 and 129, 129 and 130, 130 and 131, 131 and 132, 132 and 133, 133 and 134, 134 and 135, 135 and 136, 136 and 137, 137 and 138, 138 and 139, 139 and 140, 140 and 141, 141 and 142, 142 and 143, 143 and 144, 144 and 145, 145 and 146, 146 and 147, 147 and 148, 148 and 149, 149 and 150, 150 and 151, 151 and 152, 152 and 153, 153 and 154, 154 and 155, 155 and 156, 156 and 157, 157 and 158, 158 and 159, 159 and 160, 160 and 161, 161 and 162, 162 and 163, 163 and 164, 164 and 165, 165 and 166, 166 and 167, 167 and 168, 168 and 169, 169 and 170, 170 and 171, 171 and 172, 172 and 173, 173 and 174, 174 and 175, 175 and 176, 176 and 177, 177 and 178, 178 and 179, 179 and 180, or 180 and 181 of said W domain of said chimeric polypeptide.

In some embodiments, the Z domain is located within or flanking (e.g., juxtaposed or immediately adjacent to) the X domain. For example, the Z domain can place the encoded antigen between or next to amino acids 1 and 2, 2 and 3, 3 and 4, 4 and 5, 5 and 6, 6 and 7, 7 and 8, 8 and 9, 9 and 10, 10 and 11, 11 and 12, 12 and 13, 13 and 14, 14 and 15, and 16, 16 and 17, 17 and 18, 18 and 19, 19 and 20, 20 and 21, 21 and 22, 22 and 23, 23 and 24, 24 and 25, 25 and 26, 26 and 27, 27 and 28, 28 and 29, 29 and 30, 30 and 31, 31 and 32, 32 and 33, 33 and 34, 34 and 35, 35 and 36, 36 and 37, 37 and 38, 38 and 39, 39 and 40, 40 and 41, 41 and 42, 42 and 43, 43 and 44, 44 and 45, 45 and 46, 46 and 47, 47 and 48, 48 and 49, 49 and 50, 50 and 51, 51 and 52, 52 and 53, 53 and 54, 54 and 55, 55 and 56, 56 and 57, 57 and 58, 58 and 59, 59 and 60, 60 and 61, 61 and 62, 62 and 63, 63 and 64, 64 and 65, 65 and 66, 66 and 67, 67 and 68, 68 and 69, 69 and 70, 70 and 71, 71 and 72, 72 and 73, 73 and 74, 74 and 75, 75 and 76, 76 and 77, 77 and 78, 78 and 79, 79 and 80, 80 and 81, 81 and 82, 82 and 83, 83 and 84, 84 and 85, 85 and 86, 86 and 87, 87 and 88, 88 and 89, 89 and 90, 90 and 91, 91 and 92, 92 and 93, 93 and 94, 94 and 95, 95 and 96, 96 and 97, 97 and 98, 98 and 99, 99 and 100, 100 and 101, 101 and 102, 102 and 103, 103 and 104, 104 and 105, 105 and 106, 106 and 107, 107 and 108, 108 and 109, 109 and 110, 110 and 111, 111 and 112, 112 and 113, 113 and 114, 114 and 115, 115 and 116, 116 and 117, 117 and 118, 118 and 119, 119 and 120, 120 and 121, 121 and 122, 122 and 123, 123 and 124, 124 and 125, 125 and 126, 126 and 127, 127 and 128, 128 and 129, 129 and 130, 130 and 131, 131 and 132, 132 and 133, 133 and 134, 134 and 135, 135 and 136, 136 and 137, 137 and 138, 138 and 139, 139 and 140, 140 and 141, 141 and 142, 142 and 143, 143 and 144, 144 and 145, 145 and 146, 146 and 147, 147 and 148, 148 and 149, 149 and 150, 150 and 151, 151 and 152, 152 and 153, 153 and 154, 154 and 155, 155 and 156, 156 and 157, 157 and 158, 158 and 159, 159 and 160, 160 and 161, 161 and 162, 162 and 163, 163 and 164, 164 and 165, 165 and 166, 166 and 167, 167 and 168, 168 and 169, 169 and 170, 170 and 171, 171 and 172, 172 and 173, 173 and 174, 174 and 175, 175 and 176, 176 and 177, 177 and 178, 178 and 179, 179 and 180, 180 and 181, 181 and 182, 182 and 183, 183 and 184, 184 and 185, 185 and 186, 186 and 187, 187 and 188, 188 and 189, 189 and 190, 190 and 191, 191 and 192, 192 and 193, 193 and 194, 194 and 195, 195 and 196, 196 and 197, 197 and 198, 198 and 199, 199 and 200, 200 and 201, 201 and 202, 202 and 203, 203 and 204, 204 and 205, 205 and 206, 206 and 207, 207 and 208, 208 and 209, 209 and 210, 210 and 211, 211 and 212, 212 and 213, 213 and 214, 214 and 215, 215 and 216, 216 and 217, 217 and 218, 218 and 219, 219 and 220, 220 and 221, 221 and 222, 222 and 223, 223 and 224, 224 and 225, 225, and 226, 226 and 227, 227 and 228, 228 and 229, 229 and 230, 230 and 231, 231 and 232, 232 and 233, 233 and 234, 234 and 235, 235 and 236, 236 and 237, 237 and 238, 238 and 239, 239 and 240, 240 and 241, 241 and 242, 242 and 243, 243 and 244, 244 and 245, 245 and 246, 246 and 247, 247 and 248, 248 and 249, 249 and 250, 250 and 251, 251 and 252, 252 and 253, 253 and 254, 254 and 255, 255 and 256, 256 and 257, 257 and 258, 258 and 259, 259 and 260, 260 and 261, 261 and 262, 262 and 263, 263 and 264, 264 and 265, 265 and 266, 266 and 267, 267 and 268, 268 and 269, 269 and 270, 270 and 271, 271 and 272, 272 and 273, 273 and 274, 274 and 275, 275 and 276, 276 and 277, 277 and 278, 278 and 279, 279 and 280, 280 and 281, 281 and 282, 282 and 283, 283 and 284, 284 and 285, 285 and 286, 286 and 287, 287 and 288, 288 and 289, 289 and 290, 290 and 291, 291 and 292, 292 and 293, 293 and 294, 294 and 295, 295 and 296, 296 and 297, 297 and 298, 298 and 299, 299 and 300, 300 and 201, 301 and 302, 302 and 303, 303 and 304, 304 and 305, 305 and 306, 306 and 307, 307 and 308, 308 and 309, 309 and 310, 310 and 311, 311 and 312, 312 and 313, 313 and 314, 314 and 315, 315 and 316, 316 and 317, 317 and 318, 318 and 319, 319 and 320, 320 and 321, 321, and 322, 322 and 323, 323 and 324, 324 and 325, 325, and 326, 326 and 327, 327 and 328, 328 and 329, 329 and 330, 330 and 331, 331 and 332, 332 and 333, 333 and 334, 334 and 335, 335 and 336, 336 and 337, 337 and 338, 338 and 339, 339 and 340, 340 and 341, 341 and 342, 342 and 343, 343 and 344, 344 and 345, 345 and 346, 346 and 347, 347 and 348, 348 and 349, 349 and 350, 350 and 351, 351 and 352, 352 and 353, 353 and 354, 354 and 355, 355 and 356, 356 and 357, 357 and 358, 358 and 359, 359 and 360, 360 and 361, 361 and 362, 362 and 363, 363 and 364, 364 and 365, 365 and 366, 366 and 367, 367 and 368, 368 and 369, 369 and 370, 370 and 371, 371 and 372, 372 and 373, 373 and 374, 374 and 375, 375 and 376, 376 and 377, 377 and 378, 378 and 379, 379 and 380, 380 and 381, 381 and 382, 382 and 383, 383 and 384, 384 and 385, 385 and 386, 386 and 387, 387 and 388, 388 and 389, 389 and 390, 390 and 391, 391 and 392, 392 and 393, 393 and 394, 394 and 395, 395 and 396, 396 and 397, 397 and 398, 398 and 399, 399 and 400, 401 and 402, 402 and 403, 403 and 404, 404 and 405, 405 and 406, 406 and 407, 407 and 408, 408 and 409, 409 and 410, 410 and 411, 411 and 412, 412 and 413, 413 and 414, 414 and 415, 415 and 416, 416 and 417, 417 and 418, 418 and 419, 419 and 420, 420 and 421, 421 and 422, 422 and 423, 423 and 424, 424 and 425, 425 and 426, 426 and 427, 427 and 428, 428 and 429, 429 and 430, 430 and 431, 431 and 432, 432 and 433, 433 and 434, 434 and 435, 435 and 436, 436 and 437, 437 and 438, 438 and 439, 439 and 440, 440 and 441, 441 and 442, 442 and 443, 443 and 444, 444 and 445, 445 and 446, 446 and 447, 447 and 448, 448 and 449, or 449 and 450 of the X domain of the chimeric polypeptide. Preferably, the Z domain is located between amino acids 383 and 450 of said X domain.

Optionally, the Z domain is located within or flanking (e.g., juxtaposed or immediately adjacent to) said Y domain. For example, the Z domain can place the encoded antigen between or next to amino acids 1 and 2, 2 and 3, 3 and 4, 4 and 5, 5 and 6, 6 and 7, 7 and 8, 8 and 9, 9 and 10, 10 and 11, 11 and 12, 12 and 13, 13 and 14, 14 and 15, 15 and 16, 16 and 17, 17 and 18, 18 and 19, 19 and 20, 20 and 21, 21 and 22, 22 and 23, 23 and 24, 24 and 25, 25 and 26, 26 and 27, 27 and 28, 28 and 29, 29 and 30, 30 and 31, 31 and 32, 32 and 33, 33 and 34, 34 and 35, 35 and 36, 36 and 37, 37 and 38, 38 and 39, 39 and 40, 40 and 41, 41 and 42, 42 and 43, 43 and 44, 44 and 45, 45 and 46, 46 and 47, 47 and 48, 48 and 49, 49 and 50, 50 and 51, 51 and 52, 52 and 53, or 53 and 54 of the Y domain of the chimeric polypeptide.

That is, aspects of the invention concern a composition that comprises, consists of, or consists essentially of an isolated nucleic acid provided by the formula:

WXYZ wherein:

W encodes a protease domain (e.g., an HCV NS3 protease domain prepared as described herein, such as a mutant with enhanced or altered protease activity or substrate specificity) or a fragment thereof, wherein said fragment comprises, consists of, or consists essentially of about at least, equal to, greater than, less than, or any number in between 9, 15, 30, 50, 75, 100, 125, 150, 175, 200, 250, or 300 consecutive nucleotides of the protease domain of SEQ. ID. Nos. 1 or 35 (e.g., residues 1-551 of SEQ ID NO:35, or an analogous position in any NS3/4A nucleic acid);

X encodes a helicase domain (e.g., an HCV helicase domain) or a fragment thereof, wherein said fragment comprises, consists of, or consists essentially of about at least, equal to, greater than, less than, or any number in between 9, 15, 30, 50, 75, 100, 125, 150, 175, 200, 250, or 300 consecutive nucleotides of the helicase domain of SEQ. ID. Nos. 1 or 35 (e.g., residues 218-1568 of SEQ ID NO:35, or an analogous position in any NS3/4A nucleic acid);

Y encodes an enhancer domain (e.g., an HCV NS4A domain) or a fragment thereof, wherein said fragment comprises, consists of, or consists essentially of about at least, equal to, greater than, less than, or any number in between 9, 15, 30, 50, 75, 100, 125, 150, 175, 200, 250, or 300 consecutive nucleotides of the NS4A domain of SEQ. ID. Nos. 1 or 35 (e.g., residues 1569-2069 of SEQ ID NO:35, or an analogous position in any NS3/4A nucleic acid); and Z encodes an antigen (e.g., an antigen of a virus, bacteria, toxin, or cancer cell, such as a TCE provided by a sequence selected from the group consisting of SEQ ID NOs: 221-571, SEQ ID NOs:809-1011, SEQ ID NO:1014, SEQ ID NOs: 1016-1034, SEQ ID NOs: 1146-1173, and SEQ ID NOs: 1210-1328), with the proviso that Z is not in a position that is naturally occurring in HCV (e.g., when Z is an HCV antigen, the antigen is inserted at a position that is not naturally occurring in HCV).

Aspects of the invention also concern a composition that comprises, consists of, or consists essentially of an isolated nucleic acid provided by the formula:

ZWXY wherein:

W encodes a protease domain (e.g., an HCV NS3 protease domain prepared as described herein, such as a mutant with enhanced or altered protease activity or substrate specificity) or a fragment thereof, wherein said fragment comprises, consists of, or consists essentially of about at least, equal to, greater than, less than, or any number in between 9, 15, 30, 50, 75, 100, 125, 150, 175, 200, 250, or 300 consecutive nucleotides of the protease domain of SEQ. ID. Nos. 1 or 35 (e.g., residues 1-551 of SEQ ID NO:35, or an analogous position in any NS3/4A nucleic acid);

X encodes a helicase domain (e.g., an HCV helicase domain) or a fragment thereof, wherein said fragment comprises, consists of, or consists essentially of about at least, equal to, greater than, less than, or any number in between 9, 15, 30, 50, 75, 100, 125, 150, 175, 200, 250, or 300 consecutive nucleotides of the helicase domain of SEQ. ID. Nos. 1 or 35 (e.g., residues 218-1568 of SEQ ID NO:35, or an analogous position in any NS3/4A nucleic acid);

Y encodes an enhancer domain (e.g., an HCV NS4A domain) or a fragment thereof, wherein said fragment comprises, consists of, or consists essentially of about at least, equal to, greater than, less than, or any number in between 9, 15, 30, 50, 75, 100, 125, 150, 175, 200, 250, or 300 consecutive nucleotides of the NS4A domain of SEQ. ID. Nos. 1 or 35 (e.g., residues 1569-2069 of SEQ ID NO:35, or an analogous position in any NS3/4A nucleic acid); and Z encodes an antigen (e.g., an antigen of a virus, bacteria, toxin, or cancer cell, such as a TCE provided by a sequence selected from the group consisting of SEQ ID NOs: 221-571, SEQ ID NOs:809-1011, SEQ ID NO:1014, SEQ ID NOs: 1016-1034, SEQ ID NOs: 1146-1173, and SEQ ID NOs: 1210-1328), with the proviso that Z is not in a position that is naturally occurring in HCV (e.g., when Z is an HCV antigen, the antigen is inserted at a position that is not naturally occurring in HCV).

Aspects of the invention also concern a composition that comprises, consists of, or consists essentially of an isolated nucleic acid provided by the formula:

WZXY wherein:

W encodes a protease domain (e.g., an HCV NS3 protease domain prepared as described herein, such as a mutant with enhanced or altered protease activity or substrate specificity) or a fragment thereof, wherein said fragment comprises, consists of, or consists essentially of about at least, equal to, greater than, less than, or any number in between 9, 15, 30, 50, 75, 100, 125, 150, 175, 200, 250, or 300 consecutive nucleotides of the protease domain of SEQ. ID. Nos. 1 or 35 (e.g., residues 1-551 of SEQ ID NO:35, or an analogous position in any NS3/4A nucleic acid);

X encodes a helicase domain (e.g., an HCV helicase domain) or a fragment thereof, wherein said fragment comprises, consists of, or consists essentially of about at least, equal to, greater than, less than, or any number in between 9, 15, 30, 50, 75, 100, 125, 150, 175, 200, 250, or 300 consecutive nucleotides of the helicase domain of SEQ. ID. Nos. 1 or 35 (e.g., residues 218-1568 of SEQ ID NO:35, or an analogous position in any NS3/4A nucleic acid);

Y encodes an enhancer domain (e.g., an HCV NS4A domain) or a fragment thereof, wherein said fragment comprises, consists of, or consists essentially of about at least, equal to, greater than, less than, or any number in between 9, 15, 30, 50, 75, 100, 125, 150, 175, 200, 250, or 300 consecutive nucleotides of the NS4A domain of SEQ. ID. Nos. 1 or 35

(e.g., residues 1569-2069 of SEQ ID NO:35, or an analogous position in any NS3/4A nucleic acid); and Z encodes an antigen (e.g., an antigen of a virus, bacteria, toxin, or cancer cell, such as a TCE provided by a sequence selected from the group consisting of SEQ ID NOs: 221-571, SEQ ID NOs:809-1011, SEQ ID NO:1014, SEQ ID NOs: 1016-1034, SEQ ID NOs: 1146-1173, and SEQ ID NOs: 1210-1328)

with the proviso that Z is not in a position that is naturally occurring in HCV (e.g., when Z is an HCV antigen, the antigen is inserted at a position that is not naturally occurring in HCV).

Aspects of the invention also concern a composition that comprises, consists of, or consists essentially of an isolated nucleic acid provided by the formula:

WXZY wherein:

W encodes a protease domain (e.g., an HCV NS3 protease domain prepared as described herein, such as a mutant with enhanced or altered protease activity or substrate specificity) or a fragment thereof, wherein said fragment comprises, consists of, or consists essentially of about at least, equal to, greater than, less than, or any number in between 9, 15, 30, 50, 75, 100, 125, 150, 175, 200, 250, or 300 consecutive nucleotides of the protease domain of SEQ. ID. Nos. 1 or 35 (e.g., residues 1-551 of SEQ ID NO:35, or an analogous position in any NS3/4A nucleic acid);

X encodes a helicase domain (e.g., an HCV helicase domain) or a fragment thereof, wherein said fragment comprises, consists of, or consists essentially of about at least, equal to, greater than, less than, or any number in between 9, 15, 30, 50, 75, 100, 125, 150, 175, 200, 250, or 300 consecutive nucleotides of the helicase domain of SEQ. ID. Nos. 1 or 35 (e.g., residues 218-1568 of SEQ ID NO:35, or an analogous position in any NS3/4A nucleic acid);

Y encodes an enhancer domain (e.g., an HCV NS4A domain) or a fragment thereof, wherein said fragment comprises, consists of, or consists essentially of about at least, equal to, greater than, less than, or any number in between 9, 15, 30, 50, 75, 100, 125, 150, 175, 200, 250, or 300 consecutive nucleotides of the NS4A domain of SEQ. ID. Nos. 1 or 35 (e.g., residues 1569-2069 of SEQ ID NO:35, or an analogous position in any NS3/4A nucleic acid) and Z encodes an antigen (e.g., an antigen of a virus, bacteria, toxin, or cancer cell, such as a TCE provided by a sequence selected from the group consisting of SEQ ID NOs: 221-571, SEQ ID NOs:809-1011, SEQ ID NO:1014, SEQ ID NOs: 1016-1034, SEQ ID NOs: 1146-1173, and SEQ ID NOs: 1210-1328), with the proviso that Z is not in a position that is naturally occurring in HCV (e.g., when Z is an HCV antigen, the antigen is inserted at a position that is not naturally occurring in HCV).

Several other embodiments described herein concern recombinant HCV NS3/4A polypeptides, wherein the polypeptide comprises four domains (domain W, domain X, domain Y, and domain Z). Domain W can be an NS3 protease domain as described herein, or fragment thereof, domain X can be an NS3 helicase domain, or a fragment thereof, and domain Y can be an NS4A co-factor domain, or a fragment thereof. Domain Z can be an antigen, an epitope of a pathogen, a TCE, and/or the aforementioned molecules with or without a linker and/or adjuvant sequence. In preferred embodiments, the recombinant HCV NS3/4A chimeric polypeptide retains catalytic activity (e.g. protease, helicase, or protease and helicase activity) but may have altered activity or specificity. In preferred embodiments, domain Z is in a position within the recombinant chimeric polypeptide, which is non-naturally-occurring (e.g., when Z encodes an HCV antigen).

In some embodiments, the W domain comprises the polypeptide encoded nucleic acid sequence of residues 1-551 of an NS3/4A sequence such as SEQ ID NOs: 1 or 35, or an analogous sequence encoded by any NS3/4A nucleic acid, or a fragment thereof (e.g., said fragment can comprise, consist of, or consist essentially of a polypeptide encoded by about at least, equal to, greater than, less than, or any number in between 9, 15, 30, 50, 75, 100, 125, 150, 175, 200, 250, or 300 consecutive nucleotides of the protease domain of SEQ. ID. Nos. 1 or 35). In some embodiments, the X domain can comprise the polypeptide encoded by the nucleic acid sequence of residues 218-1568 of SEQ ID NOs: 1 or 35, or encoded by an analogous sequence of any NS3/4A nucleic acid, or a fragment thereof (e.g., said encoding fragment can comprise, consist of, or consist essentially of about at least, equal to, greater than, less than, or any number in between 9, 15, 30, 50, 75, 100, 125, 150, 175, 200, 250, or 300 consecutive nucleotides of the helicase domain of SEQ. ID. Nos. 1 or 35). In some embodiments, the Y domain can comprise a polypeptide encoded by the nucleic acid sequence of residues 1569-2069 of SEQ ID NOs: 1 or 35, or encoded by an analogous sequence of any NS3/4A nucleic acid, or a fragment thereof (e.g., said fragment can comprise, consist of, or consist essentially of a polypeptide encoded by about at least, equal to, greater than, less than, or any number in between 9, 15, 30, 50, 75, 100, 125, 150, 175, 200, 250, 300, or 350 consecutive nucleotides of the NS4A domain of SEQ. ID. Nos. 1 or 35). In preferred embodiments, the Z domain can comprise a polypeptide encoded by the nucleic acid sequence of an antigen, preferably a TCE, and more preferably a sequence selected from the group consisting of SEQ ID NOs: 221-571 and SEQ ID NOs:809-1011 and SEQ ID NO:1014, SEQ ID NOs: 1016-1034, SEQ ID NOs: 1146-1173 and SEQ ID NOs: 1210-1328.

In some embodiments, the Z domain is located within or flanking (e.g., juxtaposed or immediately adjacent to) said W domain. For example, the nucleic acid encoding the Z domain can place the encoded antigen between or next to amino acids 1 and 2, 2 and 3, 3 and 4, 4 and 5, 5 and 6, 6 and 7, 7 and 8, 8 and 9, 9 and 10, 10 and 11, 11 and 12, 12 and 13, 13 and 14, 14 and 15, 15 and 16, 16 and 17, 17 and 18, 18 and 19, 19 and 20, 20 and 21, 21 and 22, 22 and 23, 23 and 24, 24 and 25, 25 and 26, 26 and 27, 27 and 28, 28 and 29, 29 and 30, 30 and 31, 31 and 32, 32 and 33, 33 and 34, 34 and 35, 35 and 36, 36 and 37, 37 and 38, 38 and 39, 39 and 40, 40 and 41, 41 and 42, 42 and 43, 43 and 44, 44 and 45, 45 and 46, 46 and 47, 47 and 48, 48 and 49, 49 and 50, 50 and 51, 51 and 52, 52 and 53, 53 and 54, 54 and 55, 55 and 56, 56 and 57, 57 and 58, 58 and 59, 59 and 60, 60 and 61, 61 and 62, 62 and 63, 63 and 64, 64 and 65, 65 and 66, 66 and 67, 67 and 68, 68 and 69, 69 and 70, 70 and 71, 71 and 72, 72 and 73, 73 and 74, 74 and 75, 75 and 76, 76 and 77, 77 and 78, 78 and 79, 79 and 80, 80 and 81, 81 and 82, 82 and 83, 83 and 84, 84 and 85, 85 and 86, 86 and 87, 87 and 88, 88 and 89, 89 and 90, 90 and 91, 91 and 92, 92 and 93, 93 and 94, 94 and 95, 95 and 96, 96 and 97, 97 and 98, 98 and 99, 99 and 100, 100 and 101, 101 and 102, 102 and 103, 103 and 104, 104 and 105, 105 and 106, 106 and 107, 107 and 108, 108 and 109, 109 and 110, 110 and 111, 111 and 112, 112 and 113, 113 and 114, 114 and 115, 115 and 1116, 116 and 117, 117 and 118, 118 and 119, 119 and 120, 120 and 121, 121 and 122, 122 and 123, 123 and 124, 124 and 125, 125 and 126, 126 and 127, 127 and 128, 128 and 129, 129 and 130, 130 and 131, 131 and 132, 132 and 133, 133 and 134, 134 and 135, 135 and 136, 136 and 137, 137 and 138, 138 and 139, 139 and 140, 140 and 141, 141 and 142, 142 and 143, 143 and 144, 144 and 145, 145 and 146, 146 and 147, 147 and 148, 148 and 149, 149 and 150, 150 and 151, 151 and 152, 152 and 153, 153 and 154, 154 and 155, 155 and 156, 156 and 157, 157 and 158, 158 and 159, 159 and 160, 160 and 161, 161 and 162, 162 and 163, 163 and 164, 164 and 165, 165 and 166, 166 and 167, 167 and 168, 168 and 169, 169 and 170, 170 and 171, 171 and 172, 172 and 173, 173 and 174, 174 and 175, 175 and 176, 176 and 177, 177 and 178, 178 and 179, 179 and 180, or 180 and 181 of said W domain of said chimeric polypeptide.

In some embodiments, the Z domain is located within or flanking (e.g., juxtaposed or immediately adjacent to) the X domain. For example, the Z domain can place the antigen between or next to amino acids 1 and 2, 2 and 3, 3 and 4, 4 and 5, 5 and 6, 6 and 7, 7 and 8, 8 and 9, 9 and 10, 10 and 11, 11 and 12, 12 and 13, 13 and 14, 14 and 15, 15 and 16, 16 and 17, 17 and 18, 18 and 19, 19 and 20, 20 and 21, 21 and 22, 22 and 23, 23 and 24, 24 and 25, 25 and 26, 26 and 27, 27 and 28, 28 and 29, 29 and 30, 30 and 31, 31 and 32, 32 and 33, 33 and 34, 34 and 35, 35 and 36, 36 and 37, 37 and 38, 38 and 39, 39 and 40, 40 and 41, 41 and 42, 42 and 43, 43 and 44, 44 and 45, 45 and 46, 46 and 47, 47 and 48, 48 and 49, 49 and 50, 50 and 51, 51 and 52, 52 and 53, 53 and 54, 54 and 55, 55 and 56, 56 and 57, 57 and 58, 58 and 59, 59 and 60, 60 and 61, 61 and 62, 62 and 63, 63 and 64, 64 and 65, 65 and 66, 66 and 67, 67 and 68, 68 and 69, 69 and 70, 70 and 71, 71 and 72, 72 and 73, 73 and 74, 74 and 75, 75 and 76, 76 and 77, 77 and 78, 78 and 79, 79 and 80, 80 and 81, 81 and 82, 82 and 83, 83 and 84, 84 and 85, 85 and 86, 86 and 87, 87 and 88, 88 and 89, 89 and 90, 90 and 91, 91 and 92, 92 and 93, 93 and 94, 94 and 95, 95 and 96, 96 and 97, 97 and 98, 98 and 99, 99 and 100, 100 and 101, 101 and 102, 102 and 103, 103 and 104, 104 and 105, 105 and 106, 106 and 107, 107 and 108, 108 and 109, 109 and 110, 110 and 111, 111 and 112, 112 and 113, 113 and 114, 114 and 115, 115 and 116, 116 and 117, 117 and 118, 118 and 119, 119 and 120, 120 and 121, 121 and 122, 122 and 123, 123 and 124, 124 and 125, 125 and 126, 126 and 127, 127 and 128, 128 and 129, 129 and 130, 130 and 131, 131 and 132, 132 and 133, 133 and 134, 134 and 135, 135 and 136, 136 and 137, 137 and 138, 138 and 139, 139 and 140, 140 and 141, 141 and 142, 142 and 143, 143 and 144, 144 and 145, 145 and 146, 146 and 147, 147 and 148, 148 and 149, 149 and 150, 150 and 151, 151 and 152, 152 and 153, 153 and 154, 154 and 155, 155 and 156, 156 and 157, 157 and 158, 158 and 159, 159 and 160, 160 and 161, 161 and 162, 162 and 163, 163 and 164, 164 and 165, 165 and 166, 166 and 167, 167 and 168, 168 and 169, 169 and 170, 170 and 171, 171 and 172, 172 and 173, 173 and 174, 174 and 175, 175 and 176, 176 and 177, 177 and 178, 178 and 179, 179 and 180, 180 and 181, 181 and 182, 182 and 183, 183 and 184, 184 and 185, 185 and 186, 186 and 187, 187 and 188, 188 and 189, 189 and 190, 190 and 191, 191 and 192, 192 and 193, 193 and 194, 194 and 195, 195 and 196, 196 and 197, 197 and 198, 198 and 199, 199 and 200, 200 and 201, 201 and 202, 202 and 203, 203 and 204, 204 and 205, 205 and 206, 206 and 207, 207 and 208, 208 and 209, 209 and 210, 210 and 211, 211 and 212, 212 and 213, 213 and 214, 214 and 215, 215 and 216, 216 and 217, 217 and 218, 218 and 219, 219 and 220, 220 and 221, 221 and 222, 222 and 223, 223 and 224, 224 and 225, 225, and 226, 226 and 227, 227 and 228, 228 and 229, 229 and 230, 230 and 231, 231 and 232, 232 and 233, 233 and 234, 234 and 235, 235 and 236, 236 and 237, 237 and 238, 238 and 239, 239 and 240, 240 and 241, 241 and 242, 242 and 243, 243 and 244, 244 and 245, 245 and 246, 246 and 247, 247 and 248, 248 and 249, 249 and 250, 250 and 251, 251 and 252, 252 and 253, 253 and 254, 254 and 255, 255 and 256, 256 and 257, 257 and 258, 258 and 259, 259 and 260, 260 and 261, 261 and 262, 262 and 263, 263 and 264, 264 and 265, 265 and 266, 266 and 267, 267 and 268, 268 and 269, 269 and 270, 270 and 271, 271 and 272, 272 and 273, 273 and 274, 274 and 275, 275 and 276, 276 and 277, 277 and 278, 278 and 279, 279 and 280, 280 and 281, 281 and 282, 282 and 283, 283 and 284, 284 and 285, 285 and 286, 286 and 287, 287 and 288, 288 and 289, 289 and 290, 290 and 291, 291 and 292, 292 and 293, 293 and 294, 294 and 295, 295 and 296, 296 and 297, 297 and 298, 298 and 299, 299 and 300, 300 and 201, 301 and 302, 302 and 303, 303 and 304, 304 and 305, 305 and 306, 306 and 307, 307 and 308, 308 and 309, 309 and 310, 310 and 311, 311 and 312, 312 and 313, 313 and 314, 314 and 315, 315 and 316, 316 and 317, 317 and 318, 318 and 319, 319 and 320, 320 and 321, 321, and 322, 322 and 323, 323 and 324, 324 and 325, 325, and 326, 326 and 327, 327 and 328, 328 and 329, 329 and 330, 330 and 331, 331 and 332, 332 and 333, 333 and 334, 334 and 335, 335 and 336, 336 and 337, 337 and 338, 338 and 339, 339 and 340, 340 and 341, 341 and 342, 342 and 343, 343 and 344, 344 and 345, 345 and 346, 346 and 347, 347 and 348, 348 and 349, 349 and 350, 350 and 351, 351 and 352, 352 and 353, 353 and 354, 354 and 355, 355 and 356, 356 and 357, 357 and 358, 358 and 359, 359 and 360, 360 and 361, 361 and 362, 362 and 363, 363 and 364, 364 and 365, 365 and 366, 366 and 367, 367 and 368, 368 and 369, 369 and 370, 370 and 371, 371 and 372, 372 and 373, 373 and 374, 374 and 375, 375 and 376, 376 and 377, 377 and 378, 378 and 379, 379 and 380, 380 and 381, 381 and 382, 382 and 383, 383 and 384, 384 and 385, 385 and 386, 386 and 387, 387 and 388, 388 and 389, 389 and 390, 390 and 391, 391 and 392, 392 and 393, 393 and 394, 394 and 395, 395 and 396, 396 and 397, 397 and 398, 398 and 399, 399 and 400, 401 and 402, 402 and 403, 403 and 404, 404 and 405, 405 and 406, 406 and 407, 407 and 408, 408 and 409, 409 and 410, 410 and 411, 411 and 412, 412 and 413, 413 and 414, 414 and 415, 415 and 416, 416 and 417, 417 and 418, 418 and 419, 419 and 420, 420 and 421, 421 and 422, 422 and 423, 423 and 424, 424 and 425, 425 and 426, 426 and 427, 427 and 428, 428 and 429, 429 and 430, 430 and 431, 431 and 432, 432 and 433, 433 and 434, 434 and 435, 435 and 436, 436 and 437, 437 and 438, 438 and 439, 439 and 440, 440 and 441, 441 and 442, 442 and 443, 443 and 444, 444 and 445, 445 and 446, 446 and 447, 447 and 448, 448 and 449, or 449 and 450 of the X domain of the chimeric polypeptide. Preferably, the Z domain is located between amino acids 383 and 450 of said X domain.

Optionally, the Z domain is located within or flanking (e.g., juxtaposed or immediately adjacent to) said Y domain. For example, the Z domain can place the antigen between or next to amino acids 1 and 2, 2 and 3, 3 and 4, 4 and 5, 5 and 6, 6 and 7, 7 and 8, 8 and 9, 9 and 10, 10 and 11, 11 and 12, 12 and 13, 13 and 14, 14 and 15, 15 and 16, 16 and 17, 17 and 18, 18 and 19, 19 and 20, 20 and 21, 21 and 22, 22 and 23, 23 and 24, 24 and 25, and 26, 26 and 27, 27 and 28, 28 and 29, 29 and 30, 30 and 31, 31 and 32, 32 and 33, 33 and 34, 34 and 35, 35 and 36, 36 and 37, 37 and 38, 38 and 39, 39 and 40, 40 and 41, 41 and 42, 42 and 43, 43 and 44, 44 and 45, 45 and 46, 46 and 47, 47 and 48, 48 and 49, 49 and 50, 50 and 51, 51 and 52, 52 and 53, or 53 and 54 of the Y domain of the chimeric polypeptide.

That is, aspects of the invention concern a composition that comprises, consists of, or consists essentially of an isolated polypeptide provided by the formula:

WXYZ wherein:

W represents a protease domain (e.g., an HCV NS3 protease domain prepared as described herein, such as a mutant with enhanced or altered protease activity or substrate specificity) or a fragment thereof, wherein said fragment comprises, consists of, or consists essentially of about at least, equal to, greater than, less than, or any number in between 9, 15, 30, 50, 75, 100, 125, 150, or 175 consecutive amino acids of the protease domain of SEQ. ID. Nos. 2 or 36 (e.g., residues 1-181 of SEQ ID NO:36, or an analogous position in any NS3/4A polypeptide);

X represents a helicase domain (e.g., an HCV helicase domain) or a fragment thereof, wherein said fragment comprises, consists of, or consists essentially of about at least, equal to, greater than, less than, or any number in between 9, 15, 30, 50, 75, 100, 125, 150, 175, 200, 250, or 300 consecutive amino acids of the helicase domain of SEQ. ID. Nos. 2 or 36 (e.g., residues 70-596 of SEQ ID NO:36, or an analogous position in any NS3/4A polypeptide);

Y represents an enhancer domain (e.g., an HCV NS4A domain) or a fragment thereof, wherein said fragment comprises, consists of, or consists essentially of about at least, equal to, greater than, less than, or any number in between 9, 15, 30, 50, 75, 100, 125, 150, 175, 200, 250, or 300 consecutive amino acids of the NS4A domain of SEQ. ID. Nos. 1 or 35 (e.g., residues 597-686 of SEQ ID NO:36), or an analogous position in any NS3/4A polypeptide); and Z represents an antigen (e.g., an antigen of a virus, bacteria, toxin, or cancer cell, such as a TCE provided by a sequence selected from the group consisting of SEQ ID NOs: 221-571, SEQ ID NOs:809-1011, SEQ ID NO:1014, SEQ ID NOs: 1016-1034, SEQ ID NOs: 1146-1173, and SEQ ID NOs: 1210-1328), with the proviso that Z is not in a position that is naturally occurring in HCV (e.g., when Z is an HCV antigen, the antigen is inserted at a position that is not naturally occurring in HCV).

Aspects of the invention also concern a composition that comprises, consists of, or consists essentially of an isolated polypeptide encoded by a nucleic acid provided by the formula:

ZWXY wherein:

W represents a protease domain (e.g., an HCV NS3 protease domain prepared as described herein, such as a mutant with enhanced or altered protease activity or substrate specificity) or a fragment thereof, wherein said fragment comprises, consists of, or consists essentially of about at least, equal to, greater than, less than, or any number in between 9, 15, 30, 50, 75, 100, 125, 150, 175, 200, 250, or 300 consecutive nucleotides of the protease domain of SEQ. ID. Nos. 1 or 35 (e.g., residues 1-551 of SEQ ID NO:35, or an analogous position in any NS3/4A nucleic acid);

X represents a helicase domain (e.g., an HCV helicase domain) or a fragment thereof, wherein said fragment comprises, consists of, or consists essentially of a polypeptide encoded by about at least, equal to, greater than, less than, or any number in between 9, 15, 30, 50, 75, 100, 125, 150, 175, 200, 250, or 300 consecutive nucleotides of the helicase domain of SEQ. ID. Nos. 1 or 35 (e.g., residues 218-1568 of SEQ ID NO:35, or an analogous position in any NS3/4A nucleic acid);

Y represents an enhancer domain (e.g., an HCV NS4A domain) or a fragment thereof, wherein said fragment comprises, consists of, or consists essentially of a polypeptide encoded by about at least, equal to, greater than, less than, or any number in between 9, 15, 30, 50, 75, 100, 125, 150, 175, 200, 250, or 300 consecutive nucleotides of the NS4A domain of SEQ. ID. Nos. 1 or 35 (e.g., residues 1569-2069 of SEQ ID NO:35, or an analogous position in any NS3/4A nucleic acid); and Z represents an antigen (e.g., an antigen of a virus, bacteria, toxin, or cancer cell, such as a TCE provided by a sequence selected from the group consisting of SEQ ID NOs: 221-571, SEQ ID NOs:809-1011, SEQ ID NO:1014, SEQ ID Nos: 1016-1034, SEQ ID NOs: 1146-1173, and SEQ ID NOs: 1210-1328), with the proviso that Z is not in a position that is naturally occurring in HCV (e.g., when Z is an HCV antigen, the antigen is inserted at a position that is not naturally occurring in HCV)

Aspects of the invention also concern a composition that comprises, consists of, or consists essentially of an isolated polypeptide encoded by a nucleic acid provided by the formula:

WZXY wherein:

W encodes a protease domain (e.g., an HCV NS3 protease domain prepared as described herein, such as a mutant with enhanced or altered protease activity or substrate specificity) or a fragment thereof, wherein said fragment comprises, consists of, or consists essentially of about at least, equal to, greater than, less than, or any number in between 9, 15, 30, 50, 75, 100, 125, 150, 175, 200, 250, or 300 consecutive nucleotides of the protease domain of SEQ. ID. Nos. 1 or 35 (e.g., residues 1-551 of SEQ ID NO:35, or an analogous position in any NS3/4A nucleic acid);

X encodes a helicase domain (e.g., an HCV helicase domain) or a fragment thereof, wherein said fragment comprises, consists of, or consists essentially of about at least, equal to, greater than, less than, or any number in between 9, 15, 30, 50, 75, 100, 125, 150, 175, 200, 250, or 300 consecutive nucleotides of the helicase domain of SEQ. ID. Nos. 1 or 35 (e.g., residues 218-1568 of SEQ ID NO:35, or an analogous position in any NS3/4A nucleic acid);

Y encodes an enhancer domain (e.g., an HCV NS4A domain) or a fragment thereof, wherein said fragment comprises, consists of, or consists essentially of about at least, equal to, greater than, less than, or any number in between 9, 15, 30, 50, 75, 100, 125, 150, 175, 200, 250, or 300 consecutive nucleotides of the NS4A domain of SEQ. ID. Nos. 1 or 35 (e.g., residues 1569-2069 of SEQ ID NO:35, or an analogous position in any NS3/4A nucleic acid); and Z encodes an antigen (e.g., an antigen of a virus, bacteria, toxin, or cancer cell, such as a TCE provided by a sequence selected from the group consisting of SEQ ID NOs: 221-571, SEQ ID NOs:809-1011, SEQ ID NO:1014, SEQ ID NOs: 1016-1034, SEQ ID NOs: 1146-1173, and SEQ ID NOs: 1210-1328), with the proviso that Z is not in a position that is naturally occurring in HCV (e.g., when Z is an HCV antigen, the antigen is inserted at a position that is not naturally occurring in HCV).

Aspects of the invention also concern a composition that comprises, consists of, or consists essentially of an isolated polypeptide encoded by a nucleic acid provided by the formula:

WZXY wherein:

W encodes a protease domain (e.g., an HCV NS3 protease domain prepared as described herein, such as a mutant with enhanced or altered protease activity or substrate specificity) or a fragment thereof, wherein said fragment comprises, consists of, or consists essentially of about at least, equal to, greater than, less than, or any number in between 9, 15, 30, 50, 75, 100, 125, 150, 175, 200, 250, or 300 consecutive nucleotides of the protease domain of SEQ. ID. Nos. 1 or 35 (e.g., residues 1-551 of SEQ ID NO:35, or an analogous position in any NS3/4A nucleic acid);

X encodes a helicase domain (e.g., an HCV helicase domain) or a fragment thereof, wherein said fragment comprises, consists of, or consists essentially of about at least, equal to, greater than, less than, or any number in between 9, 15, 30, 50, 75, 100, 125, 150, 175, 200, 250, or 300 consecutive nucleotides of the helicase domain of SEQ. ID. Nos. 1 or 35 (e.g., residues 218-1568 of SEQ ID NO:35, or an analogous position in any NS3/4A nucleic acid);

Y encodes an enhancer domain (e.g., an HCV NS4A domain) or a fragment thereof, wherein said fragment comprises, consists of, or consists essentially of about at least, equal to, greater than, less than, or any number in between 9, 15, 30, 50, 75, 100, 125, 150, 175, 200, 250, or 300 consecutive nucleotides of the NS4A domain of SEQ. ID. Nos. 1 or 35 (e.g., residues 1569-2069 of SEQ ID NO:35, or an analogous position in any NS3/4A nucleic acid); and Z encodes an antigen (e.g., an antigen of a virus, bacteria, toxin, or cancer cell, such as a TCE provided by a sequence selected from the group consisting of SEQ ID NOs: 221-571, SEQ ID NOs:809-1011, SEQ ID NO:1014, SEQ ID NOs: 1016-1034, SEQ ID NOs: 1146-1173, and SEQ ID NOs: 1210-1328), with the proviso that Z is not in a position that is naturally occurring in HCV (e.g., when Z is an HCV antigen, the antigen is inserted at a position that is not naturally occurring in HCV).

Aspects of the invention also concern a composition that comprises, consists of, or consists essentially of an isolated polypeptide encoded by a nucleic acid provided by the formula:

WXZY wherein:

W encodes a protease domain (e.g., an HCV NS3 protease domain prepared as described herein, such as a mutant with enhanced or altered protease activity or substrate specificity) or a fragment thereof, wherein said fragment comprises, consists of, or consists essentially of about at least, equal to, greater than, less than, or any number in between 9, 15, 30, 50, 75, 100, 125, 150, 175, 200, 250, or 300 consecutive nucleotides of the protease domain of SEQ. ID. Nos. 1 or 35 (e.g., residues 1-551 of SEQ ID NO:35, or an analogous position in any NS3/4A nucleic acid);

X encodes a helicase domain (e.g., an HCV helicase domain) or a fragment thereof, wherein said fragment comprises, consists of, or consists essentially of about at least, equal to, greater than, less than, or any number in between 9, 15, 30, 50, 75, 100, 125, 150, 175, 200, 250, or 300 consecutive nucleotides of the helicase domain of SEQ. ID. Nos. 1 or 35 (e.g., residues 218-1568 of SEQ ID NO:35, or an analogous position in any NS3/4A nucleic acid);

Y encodes an enhancer domain (e.g., an HCV NS4A domain) or a fragment thereof, wherein said fragment comprises, consists of, or consists essentially of about at least, equal to, greater than, less than, or any number in between 9, 15, 30, 50, 75, 100, 125, 150, 175, 200, 250, or 300 consecutive nucleotides of the NS4A domain of SEQ. ID. Nos. 1 or 35 (e.g., residues 1569-2069 of SEQ ID NO:35, or an analogous position in any NS3/4A nucleic acid) and Z encodes an antigen (e.g., an antigen of a virus, bacteria, toxin, or cancer cell, such as a TCE provided by a sequence selected from the group consisting of SEQ ID NOs: 221-571, SEQ ID NOs:809-1011, SEQ ID NO:1014, SEQ ID NOs: 1016-1034, SEQ ID NOs: 1146-1173 and SEQ ID NOs: 1210-1328), with the proviso that Z is not in a position that is naturally occurring in HCV (e.g., when Z is an HCV antigen, the antigen is inserted at a position that is not naturally occurring in HCV).

Methods of making and using the compositions described herein are also provided. In addition to methods of making the embodied nucleic acids and polypeptides, other embodiments include method of making immunogens and/or vaccine compositions. Preferably immunogenic compositions or vaccine compositions comprise a pharmaceutically acceptable carrier in addition to the nucleic acids and/or polypeptides described herein. Some methods are practiced, for example, by mixing an adjuvant with a nucleic acid or polypeptide as described above, so as to formulate a single composition (e.g. an immunogenic composition or a vaccine). Preferred methods involve the mixing of ribavirin with the nucleic acids or encoded polypeptides described herein. (See e.g., U.S. Pat. Nos. 6,680,059, and 6,858,590, hereby expressly incorporated by reference in their entirety.)

Preferred methods of using the compositions described herein involve providing an animal (e.g., a mammal such as a human or a domestic animal) in need of an immune response to an antigen with a sufficient amount of one or more of the nucleic acid and/or polypeptide compositions described herein, wherein the TCE or antigen present in the composition is derived from said antigen/target (e.g., an antigen present on a pathogen, such as a virus like hepatitis, HIV, or the flu). In some embodiments, the animal, preferably a mammal, collectively referred to as a subject, is identified as a subject in need of an immune response to an antigen or a pathogen comprising an antigen, and said identified subject is provided a therapeutically effective amount of one or more of the NS3/4A platforms comprising said antigen. Optionally, the immune response of said identified subject to said platform comprising said antigen is measured.

In still more embodiments, a gene gun or electroporation device (e.g., Medpulsar™) is used to introduce the nucleic acids described herein to a mammalian subject in need of an immune response to an agent, wherein the nucleic acids encode a TCE specific to the agent. In some embodiments, an amount of an adjuvant, such as ribavirin, is mixed with the nucleic acid immunogen prior to delivery. In other embodiments, the nucleic acid immunogen is provided shortly before or after administration of ribavirin or at the same site of nucleic acid inoculation. Other embodiments relate to an isolated nucleic acid comprising a nucleic acid sequence encoding a TCE, wherein said nucleic acid sequence encoding said TCE is inserted within a nucleic acid sequence comprising, consisting essentially of, or consisting of one of the following SEQ ID NOs: 1, 35, or 573-806, and wherein said isolated nucleic acid operably encodes a polypeptide that retains catalytic activity. These embodiments can be delivered using electroporation methods, as described above, with or without an adjuvant, such as ribavirin.

SEQ ID NOs: 1174-1198 correspond to nucleic acid and peptide constructs of fragments of the HBcAg with or without NS3 protease cleavage sites joined to the NS3/4A platform. SEQ ID NOs: 1174-1198 initially correspond to all parts of possible constructs presented therein, including the amino acid sequence for HBcAg, the NS3/4A protease cleavage site, the NS4A/B protease cleavage site, and the NS3/4A platform.

SEQ ID NOs: 1181-1182 correspond to a functional NS3 protease joined to NS4A via a mutant NS3/4A protease cleavage site. The NS3/4A platform is joined to the HBcAg without any NS3 protease cleavage sites. SEQ ID NOs: 1181-1182, corresponding to FIG. 1A, will have an active protease (NS3) that is unable to cleave itself.

SEQ ID NOs: 1183-1184 correspond to a mutant non-functional NS3 protease joined to NS4A via an NS3/4A protease cleavage site. The NS3/4A platform is joined to the HBcAg without any NS3 protease cleavage sites. SEQ ID NOs: 1183-1184, corresponding to FIG. 1B, will have an inactive protease (NS3) that is unable to cleave itself through the functional protease cleavage site.

SEQ ID NOs: 1185-1186 correspond to a functional NS3 protease joined to NS4A via an NS3/4A protease cleavage site. The NS3/4A platform is joined to the HBcAg without any NS3 protease cleavage sites. SEQ ID NOs: 1185-1186, corresponding to FIG. 1C, will have an active protease (NS3) that is able to cleave itself but will not cleave any other portion of the peptide as there are no other protease cleavage sites available. Accordingly, the products created by NS3 cleavage include the NS3 protein and the NS4A joined to the HBcAg.

SEQ ID NOs: 1187-1188 correspond to a functional NS3 protease joined to NS4A via an NS3/4A protease cleavage site. The NS3/4A platform is joined to the HBcAg via an NS4A/B protease cleavage site. SEQ ID NOs: 1187-1188, corresponding to FIG. 1D, will have an active protease (NS3) that is able to cleave itself and cleave the NS4A from the HBcAg via the NS4A/B protease cleavage site. Accordingly, the products created by NS3 cleavage include the NS3 protein, the NS4A protein, and the HBcAg peptide.

SEQ ID NOs: 1189-1190 correspond to a functional NS3 protease joined to NS4A via an NS3/4A protease cleavage site. The NS3/4A platform is joined to the HBcAg via an NS4A/B protease cleavage site. The HBcAg contains NS3/4A protease cleavage sites within the peptide, particularly between amino acids 44 and 45, between amino acids 87 and 88, as well as between amino acids 141 and 142. SEQ ID NOs: 1189-1190, corresponding to FIG. 1E, will have an active protease (NS3) that is able to cleave itself and cleave the NS4A from the HBcAg via the NS4A/B protease cleavage site. Additionally, the NS3 protease will cleave the HBcAg between amino acids 44 and 45, between amino acids 87 and 88, as well as between amino acids 141 and 142 via the NS3/4A protease cleavage site. Accordingly, the products created by NS3 cleavage include the NS3 protein, the NS4A protein, and the fragments of the HBcAg peptide corresponding to amino acids 1-44, amino acids 45-87, amino acids 88-141, and amino acids 142-183.

SEQ ID NOs: 1191-1198 correspond to a functional NS3 protease joined to NS4A via an NS3/4A protease cleavage site. The NS3/4A platform is joined to the HBcAg via an NS4A/B protease cleavage site. The HBcAg is shuffled with NS3/4A protease cleavage sites separating the shuffled fragments. SEQ ID NOs: 1191-1198, corresponding to FIGS. 1F-1I, will have an active protease (NS3) that is able to cleave itself and cleave the NS4A from the HBcAg via the NS4A/B protease cleavage site. Additionally, the NS3 protease will cleave the HBcAg shuffled fragments at the site of the NS3/4A protease cleavage site. Accordingly, the products created by NS3 cleavage include the NS3 protein, the NS4A protein, and the fragments of the HBcAg peptide.

SEQ ID NOs: 1016-1034, SEQ ID NOs: 1146-1173 and SEQ ID NOs: 1210-1328 correspond to antigenic peptide sequences from allergens and infectious diseases. The peptides represented can be used as part of an immunogenic composition designed to raise an immune response against the antigen from which they originate. In another embodiment, the nucleic acids coding for the antigenic peptide sequence can be used as part of DNA vaccine designed to raise an immune response against the antigen from which they originate after administration.

SEQ ID NOs: 1122-1145 correspond to antigenic peptide sequences containing the NS3/4A protease cleavage site inserted at various sites within the peptide sequence. Although the SEQ ID NOs: 1122-1145 recite only the NS3/4A protease cleavage site, any NS3 protease cleavage site (e.g., NS4A/B protease cleavage site) can be used. The protease cleavage sites are cleaved by an NS3 peptide, which can be administered in peptide or nucleic acid form pre-administration, post-administration, or peri-administration of the antigenic sequence containing the NS3 protease cleavage site(s). The protease cleavage sites improve antigen processing within antigen presenting cells and facilitate a heightened cell-mediated immune response. Although the antigenic sequences of SEQ ID NOs: 1122-1145 contain naturally-ordered antigen fragments separated by an NS3 protease cleavage site, the antigenic fragments can be ordered randomly as in the shuffled fragments of HBcAg separated by NS3 protease cleavage sites seen in SEQ ID NOs: 1174-1198.

SEQ ID NOs: 1098-1121 correspond to the codon-optimized (human) nucleic acid sequence encoding antigenic peptide sequences containing the NS3/4A protease cleavage site inserted at various sites within the peptide sequence. Although SEQ ID NOs: 1098-1121 encode only the NS3/4A protease cleavage site, any NS3 protease cleavage site (e.g., NS4A/B, NS4B/5A, and NS5A/5B protease cleavage sites) can be used. The protease cleavage sites are cleaved by an NS3 peptide, which can be administered as a peptide or nucleic acid pre-administration, post-administration, or peri-administration of the codon optimized nucleic acid coding the antigenic sequence containing the NS3 protease cleavage site(s). The protease cleavage sites improve antigen processing within antigen presenting cells and facilitate a heightened cell-mediated immune response. Although the codon optimized nucleic acids corresponding to SEQ ID NOs: 1098-1121 encode antigenic sequences containing naturally-ordered antigen fragments separated by an NS3 protease cleavage site, the antigenic fragments can be ordered randomly as in the shuffled fragments of HBcAg separated by NS3 protease cleavage sites seen in SEQ ID NOs: 1174-1198.

SEQ ID NOs: 1059-1097 correspond to the NS3/4A peptide linked to antigenic peptide sequences containing NS3/4A protease cleavage site inserted at various sites within the peptide sequence. Although SEQ ID NOs: 1059-1097 encode only the NS3/4A protease cleavage site, any NS3 protease cleavage site (e.g., NS4A/B, NS4B/5A, and NS5A/5B protease cleavage sites) can be used. The protease cleavage sites improve antigen processing within antigen presenting cells and facilitate a heightened cell-mediated immune response. Although the antigenic sequences of SEQ ID NOs: 1059-1097 contain naturally-ordered antigen fragments separated by an NS3 protease cleavage site, the antigenic fragments can be ordered randomly as in the shuffled fragments of HBcAg separated by NS3 protease cleavage sites seen in SEQ ID NOs: 1174-1198.

SEQ ID NOs: 1035-1058 correspond to the codon-optimized (human) nucleic acid sequence encoding NS3/4A peptide linked to antigenic peptide sequences containing the NS3/4A protease cleavage site inserted at various sites within the peptide sequence. Although SEQ ID NOs: 1035-1058 encode only the NS3/4A protease cleavage site, any NS3 protease cleavage site (e.g., NS4A/B, NS4B/5A, and NS5A/5B protease cleavage sites) can be used. The protease cleavage sites improve antigen processing within antigen presenting cells and facilitate a heightened cell-mediated immune response. Although the codon optimized nucleic acids presented in SEQ ID NOs: 1035-1058 encode antigenic sequences containing naturally-ordered antigen fragments separated by an NS3 protease cleavage site, the antigenic fragments can be ordered randomly as in the shuffled fragments of HBcAg separated by NS3 protease cleavage sites seen in SEQ ID NOs: 1174-1198.

SEQ ID NO: 1175 corresponds to the wild type sequence of HBcAg and SEQ ID NO: 1176 corresponds to the codon optimized sequence of HBcAg. SEQ ID NOs: 1199-1209 correspond to mutant NS3/4A peptides having altered substrate specificity.

BRIEF DESCRIPTION OF THE DRAWINGS

FIGS. 1A-1I depict various constructs containing the NS3/4A platform and the HBcAg containing NS3 protease cleavage sites.

FIG. 2 is a graph showing the antibody titer in H-$2^d$ mice against NS3 as a function of time after the first intra muscular immunization. Diamonds denote antibody titer in mice immunized with NS3/4A-pVAX and squares denote antibody titer in mice immunized with NS3-pVAX.

FIGS. 3A and 3B show the mean NS3-specific antibody responses primed by gene gun immunisations with 4 μg wtNS3/4A-pVAX1 and coNS3/4A-pVAX1, or s.c. injection of $10^7$ wtNS3/4A-SFV particles in groups of ten H-$2^d$ mice (FIG. 3A). All mice were immunized at weeks zero and four. Values are given as mean end-point antibody titres (±SD.). Also shown FIG. 3B are the IgG subclass patterns from groups of five mice immunized twice with wtNS3/4A-pVAX1 given i.m., coNS3/4A-pVAX1 given i.m. or by gene gun (gg), and wtNS3/4A-SFV given s.c. Values are given as mean end-point antibody titres (±SD.). A "**" sign indicates a statistical difference of $p<0.01$, a "*" sign indicates a difference of $p<0.05$, and NS (not significant) indicates no statistical difference (Mann-Whitney). Also given is the titer ratio obtained by dividing the mean endpont titre of IgG2a antibodies to NS3 by the mean endpont titre IgG1 antibodies to NS3. A high ratio (>3) indicates a Th1-like response and a low ratio (<0.3) indicates a Th2-like response, whereas values within a three-fold difference from 1 (0.3 to 3) indicates a mixed Th1/Th2 response.

FIG. 4A shows the in vivo protection conferred by one gene gun immunization of NS3/4A-pVAX1 (4 μg) or MSLF1-pVAX1 (4 μg). Mice were immunized with the respective plasmid and 14 days later the mice were challenged with an NS3/4A expressing SP2/0 cell line (approximately $10^6$ cells/mouse). Tumor size was then measured through the skin daily following day 6 post-challenge and the data plotted. FIG. 4B shows the in vivo protection conferred by two gene gun immunizations of NS3/4A-pVAX1 (4 μg) or MSLF1-pVAX1 (4 μg). Mice were immunized with the respective plasmid at weeks zero and week four and, 14 days after the last immunization, the mice were challenged with an NS3/4A expressing SP2/0 cell line (approximately $10^6$ cells/mouse). Tumor size was then measured through the skin daily following day 6 post-challenge and the data plotted.

FIG. 5 shows the in vivo protection conferred by three gene gun immunizations of NS3/4A-pVAX1 (4 μg) or MSLF1-pVAX1 (4 μg). Mice were immunized with the respective plasmid at weeks zero, week four, and week eight and, 14 days after the last immunization, the mice were challenged with an NS3/4A expressing SP2/0 cell line (approximately $10^6$ cells/mouse). Tumor size was then measured through the skin daily following day 6 post-challenge and the data plotted.

FIG. 6A is a graph showing the percentage of specific CTL-mediated lysis of SP2/0 target cells as a function of the effector to target ratio. Phosphate Buffered Saline (PBS) was used as a control immunogen.

FIG. 6B is a graph showing the percentage specific CTL-mediated lysis of SP2/0 target cells as a function of the effector to target ratio. Plasmid NS3/4A-pVAX was used as the immunogen.

FIG. 7A is a graph showing the response of naive splenic T cells that were stimulated with peptide coated RMA-S cells. The naive splenic T cells were obtained from C57/BL6 mice.

FIG. 7B is a graph showing the response of splenic T cells that were restimulated with peptide coated RMA-S cells. The splenic T cells were obtained from C57/BL6 mice that were provided a single 4 μg dose of MSLF1-pVAX1.

FIG. 7C is a graph showing the response of splenic T cells that were restimulated with peptide coated RMA-S cells. The splenic T cells were obtained from C57/BL6 mice that were provided a single 4 μg dose of NS3/4A-pVAX1.

FIG. 7D is a graph showing the response of naive splenic T cells that were stimulated with peptide coated RMA-S cells. The naive splenic T cells were obtained from C57/BL6 mice.

FIG. 7E is a graph showing the response of splenic T cells that were restimulated with peptide coated RMA-S cells. The splenic T cells were obtained from C57/BL6 mice that were provided two 4 μg doses of MSLF1-pVAX1.

FIG. 7F is a graph showing the response of splenic T cells that were restimulated with peptide coated RMA-S cells. The splenic T cells were obtained from C57/BL6 mice that were provided two 4 μg doses of NS3/4A-pVAX1.

FIG. 7G is a graph showing the response of naive splenic T cells that were stimulated with NS3/4A expressing EL-4 cells. The naive splenic T cells were obtained from C57/BL6 mice.

FIG. 7H is a graph showing the response of splenic T cells that were restimulated with NS3/4A expressing EL-4 cells. The splenic T cells were obtained from C57/BL6 mice that were provided a single 4 μg dose of MSLF1-pVAX1.

FIG. 7I is a graph showing the response of splenic T cells that were restimulated with NS3/4A expressing EL-4 cells. The splenic T cells were obtained from C57/BL6 mice that were provided a single 4 μg dose of NS3/4A-pVAX1.

FIG. 7J is a graph showing the response of naive splenic T cells that were stimulated with NS3/4A expressing EL-4 cells. The naive splenic T cells were obtained from C57/BL6 mice.

FIG. 7K is a graph showing the response of splenic T cells that were restimulated with NS3/4A expressing EL-4 cells. The splenic T cells were obtained from C57/BL6 mice that were provided two 4 μg doses of MSLF1-pVAX1.

FIG. 7L is a graph showing the response of splenic T cells that were restimulated with NS3/4A expressing EL-4 cells. The splenic T cells were obtained from C57/BL6 mice that were provided two 4 μg doses of NS3/4A-pVAX1.

FIG. 8A shows a flow cytometric quantification of the precursor frequency of NS3/4A-specific CD8+ T cells using peptide-loaded H-2 $D^b$:Ig fusion protein. In a) the mean % NS3-specific CD8+ T cells from groups of five mice immunized twice with wtNS3-pVAX1, wtNS3/4A-pVAX1, or coNS3/4A-pVAX1 using gene gun is shown. A "*" sign indicates a difference of $p<0.05$, and NS (not significant) indicates no statistical difference (Mann-Whitney). FIG. 8B, also shown, represents the raw data from representative individual mice from the groups listed above (e, f, and h), as well as from individual mice immunized once with coNS3/4A-pVAX1 (b) or wtNS3/4A-SFV (c). In (d) and (g), non-immunized control mice from the different experiments have been given. In (i)

and (j) the splenocytes were restimulated for five days with the NS3-peptides prior to analysis. A total of 150,000-200,000 data points were collected and the percentage of CD8+ cells stained for H-2D$^b$:Ig are indicated in the parentheses in each dot-plot.

FIGS. 9A and 9B show the priming of in vitro detectable CTLs in H-2$^b$ mice by gene gun immunization of the wtNS3-pVAX1, wtNS3/4A, and coNS3/4A plasmids, or s.c. injection of wtNS3/4A-SFV particles. Groups of five to 10H-2$^b$ mice were immunized once (FIG. 9A) or twice (FIG. 9B). The percent specific lysis corresponds to the percent lysis obtained with either NS3-peptide coated RMA-S cells (upper panel in (FIG. 9A) and (FIG. 9B) or NS3/4A-expressing EL-4 cells (lower panel in a and b) minus the percent lysis obtained with unloaded or non-transfected EL-4 cells. Values have been given for effector to target (E:T) cell ratios of 60:1, 20:1 and 7:1. Each line indicates an individual mouse.

FIG. 10A shows the specificity of tumor inhibiting immune responses primed by gene gun immunization. Groups of ten C57BL/6 mice were either left untreated or were given two monthly immunizations with 4 µg of coNS3/4A-pVAX1. Two weeks after last immunization, mice were injected sub cutaneously with the parental EL-4 cell line or 10$^6$ NS3/4A-expressing EL-4 cells. Tumor sizes were measured through the skin at days 6, 7, 10, 11, 12, and 14 after tumour injection. In FIG. 10B the in vivo functional effector cell population was determined in groups of 10 C57BL/6 mice immunized twice with the coNS3/4A-pVAX1 plasmid using gene gun. In two groups either CD4+ or CD8+ T cells were depleted by administration of monoclonal antibodies one week prior to, and during, challenge with the NS3/4A-expressing EL-4 cell line. Tumor sizes were measured through the skin at days 5, 6, 8, 11, 13, 14, and 15 after tumour injection. Values have been given as the mean tumor size ± standard error. A "**" sign indicates a statistical difference of $p<0.01$, a "*" sign indicates a difference of $p<0.05$, and NS (not significant) indicates no statistical difference (area under the curve values compared by ANOVA).

FIG. 11 shows an evaluation of the ability of different immunogens to prime HCV NS3/4A-specific tumor-inhibiting responses after a single immunization. Groups of ten C57BL/6 mice were either left untreated or were given one immunization with the indicated immunogen (4 µg DNA using gene gun in (a), (b), (c), (g), and (h); 10$^7$ SFV particles s.c. in d; 100 µg peptide in CFA s.c. in (e); and 20 µg rNS3 in CFA s.c. in (f). Two weeks after last immunization, mice were injected sub cutaneously with 10$^6$ NS3/4A-expressing EL-4 cells. Tumor sizes were measured through the skin at days 6 to 19 after tumor injection. Values have been given as the mean tumor size ± standard error. In (a) to (e), as a negative control the mean data from the group immunized with the empty pVAX plasmid by gene gun has been plotted in each graph. In (f) to (h) the negative controls were non-immunized mice. Also given is the p value obtained from the statistical comparison of the control with each curve using the area under the curve and ANOVA.

FIGS. 12A, 12B, and 12C show the comparative efficiency of gene gun delivered wtNS3/4A-pVAX1 and coNS3/4A-pVAX1 plasmids in priming tumor inhibiting immune responses. Groups of ten BALB/c mice were either left untreated or were given one (FIG. 12A), two (FIG. 12B) or three (FIG. 12C) monthly immunisations with 4 µg of plasmid. Two weeks after last immunization, mice were injected sub cutaneously with 10$^6$ NS3/4A-expressing SP2/0 cells. Tumor sizes were measured through the skin at days 6, 8, 10, 11, 12, 13, and 14 after tumor injection. Values have been given as the mean tumor size ± standard error. A "**" sign indicates a statistical difference of $p<0.01$, a "*" sign indicates a difference of $p<0.05$, and NS (not significant) indicates no statistical difference (area under the curve values compared by ANOVA).

FIG. 13 shows the effect of therapeutic vaccination with the coNS3/4A plasmid using the gene gun. Groups of ten C57BL/6 mice were inoculated with 10$^6$ NS3/4A-EL4 cells. One group had been immunized once with 4 µg coNS3/4A DNA using a gene gun two weeks prior to challenge (positive control), one group was immunized the same way six days after tumor inoculation, and one group was immunized 12 days after tumor inoculation. One group was not immunized (negative control). Tumor sizes were measured through the skin at days 6, 10, 11, 12, 13, 14, 18, 19, and 20 after tumour injection. Values have been given as the mean tumor size ± standard error. A "**" sign indicates a statistical difference of $p<0.01$, a "*" sign indicates a difference of $p<0.05$, and NS (not significant) indicates no statistical difference (area under the curve values compared by ANOVA).

Figure 17:
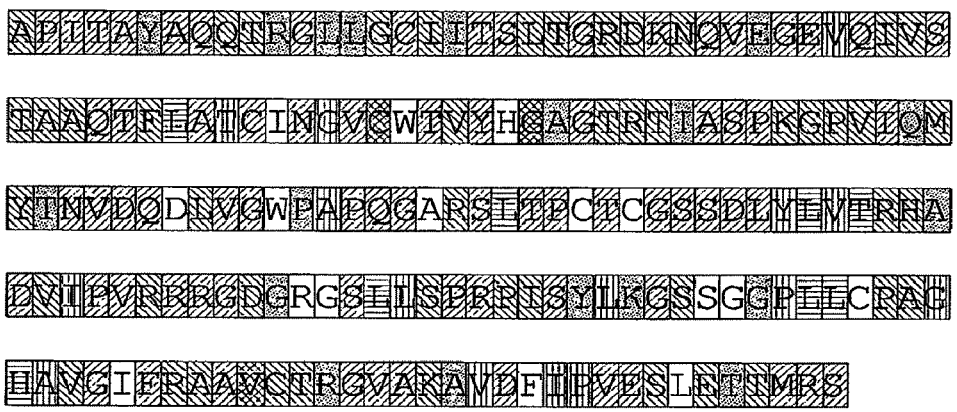

FIG. 17 shows the location of amino acid residues in the NS3A protease that affect protease cleavage. Versions of NS3/NS4A-pVAX were constructed to encode proteins in which each amino acid of the shown sequence other than the alanine residues was substituted with an alanine residue. Each alanine residue was substituted with a glycine residue. The encoded proteins were analyzed for protease activity. The red color indicates the 16 mutations which resulted in a protein that lacked all protease activity. The dark blue color indicates the 3 mutations which resulted in a protein that exhibited greatly enhanced protease activity compared to wtNS3/NS4A.

Figure 18:
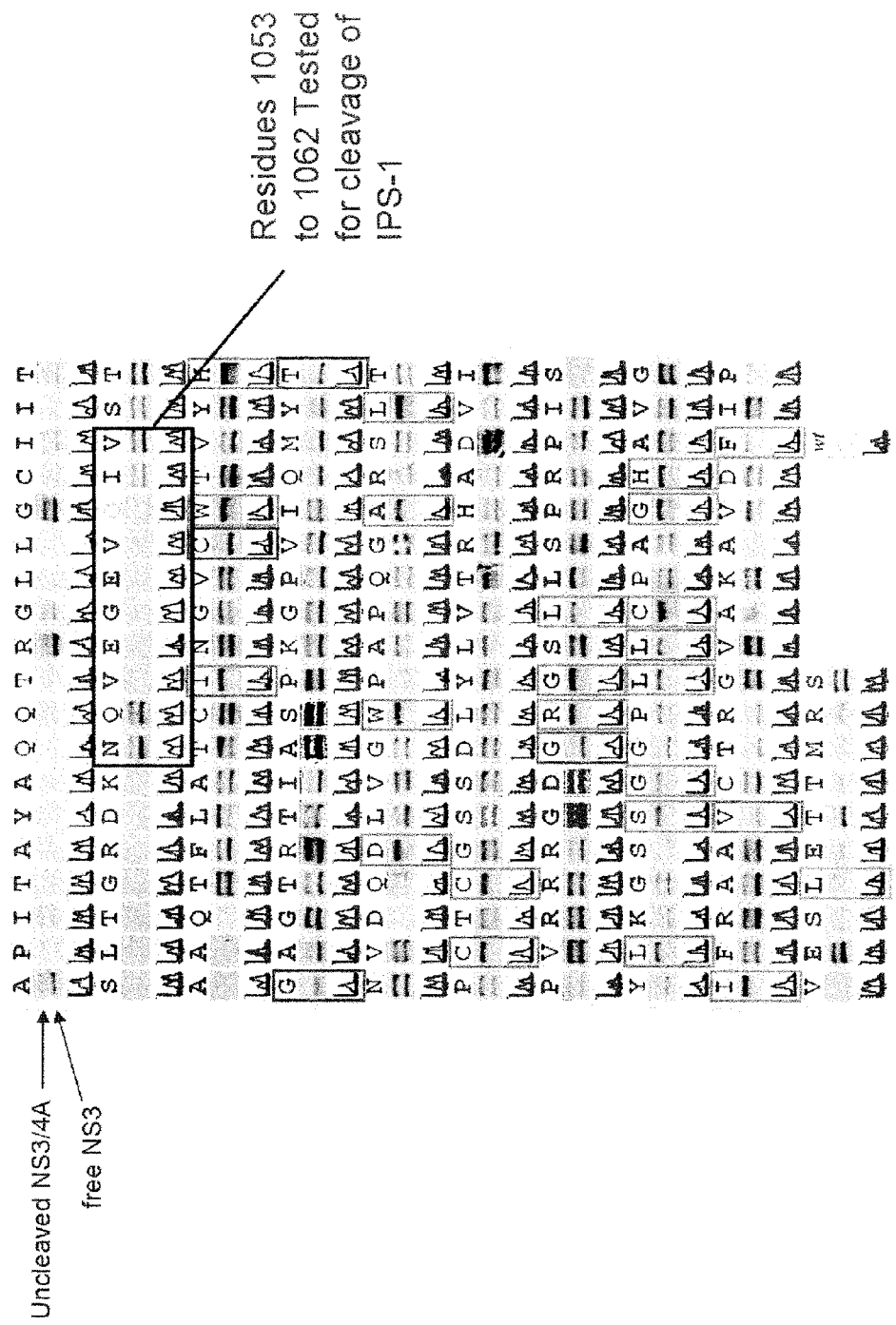

FIG. 18 depicts the protease activity of the NS3 protease domain in which alanine or glycine was substituted for each protease-domain residue. Each mutant was tested for protease activity after translation. The upper band corresponds to the noncleaved NS3/4A fusion protein and the lower band corresponds to the free NS3 protein. A single or clearly dominant peak indicates destroyed or enhanced protease activity, compared with the dual peak appearance of the wt NS3/4A gene.

Figures 19A, 19B:
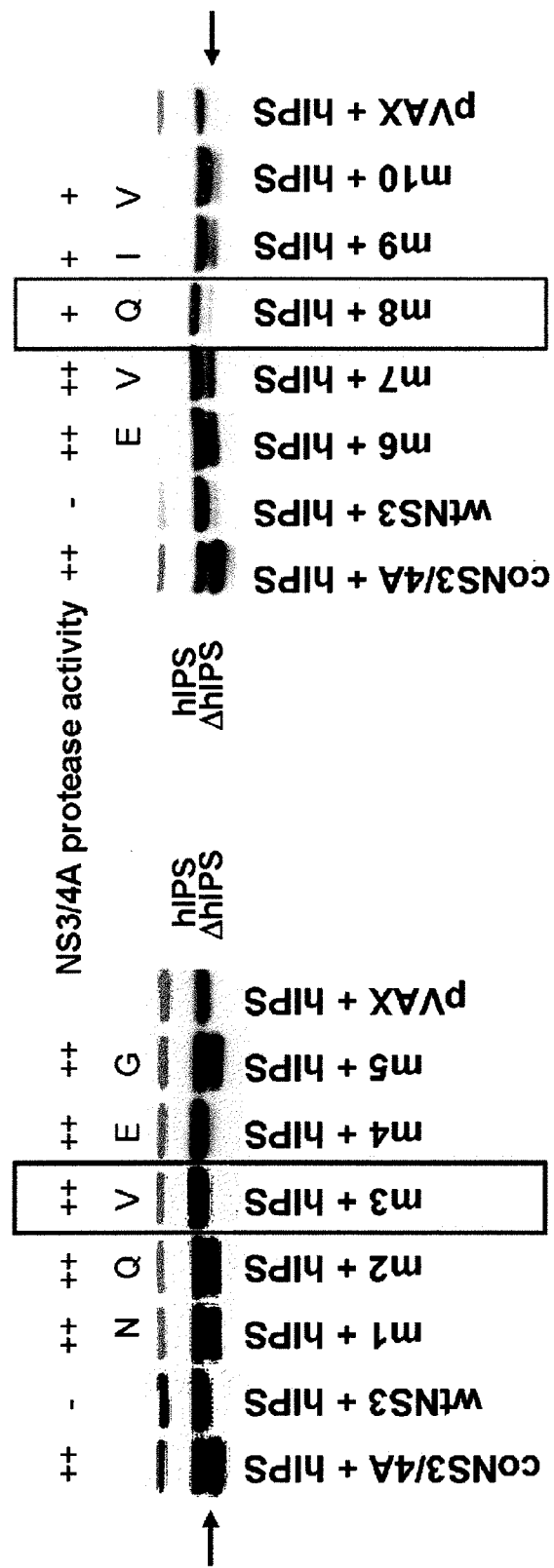

FIGS. 19A and B depict SDS Page gels where IPS-1 cleavage by particular mutants are visualized.

Figure 20A:
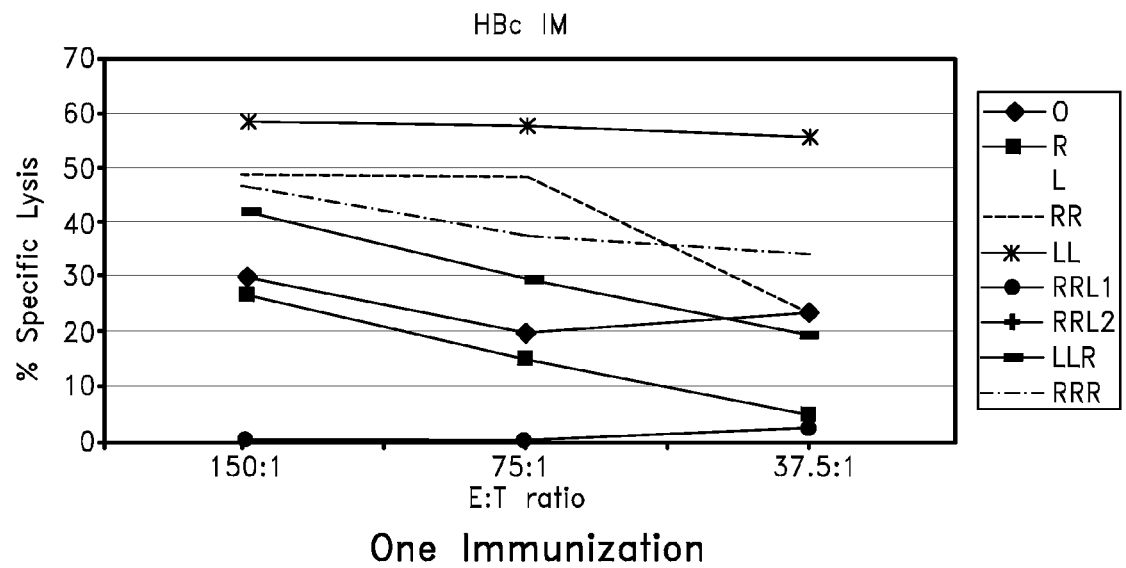
Figure 20A:
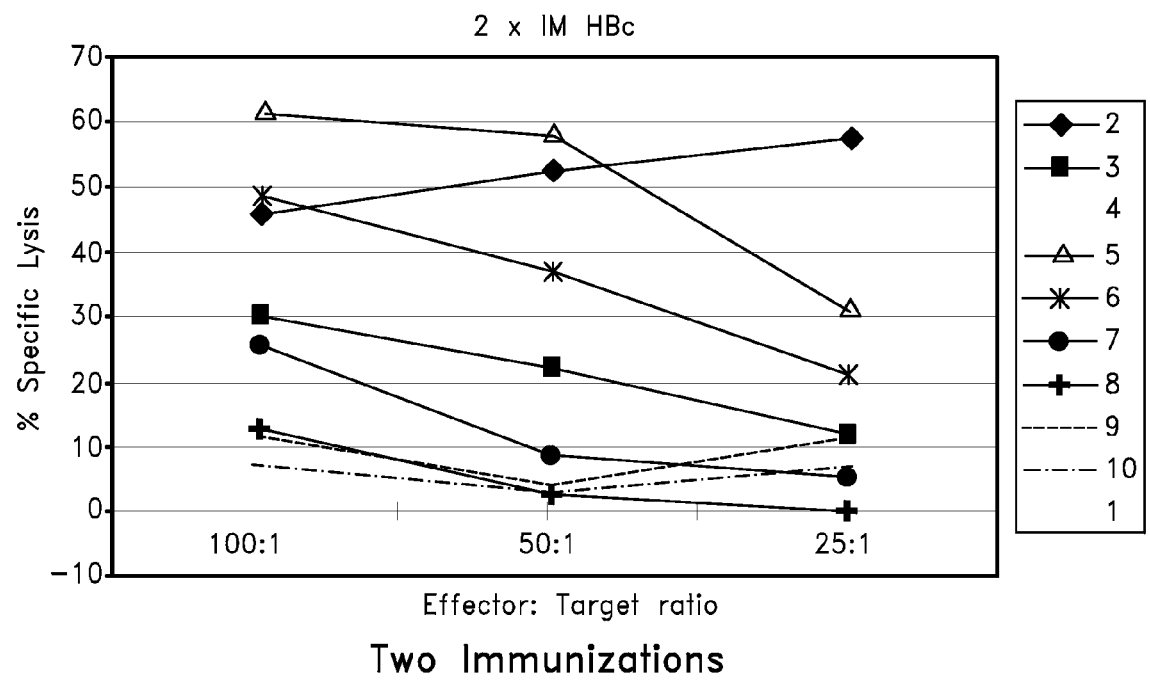

FIG. 20A is a graph showing the response of splenic T cells that were restimulated with peptide coated RMA-S cells. The splenic T cells were obtained from C57/BL6 mice that were provided a single 100 µg dose of HBcAg-pVAX1 intramuscularly at week 0 and week 4, as indicated.

Figure 20B:
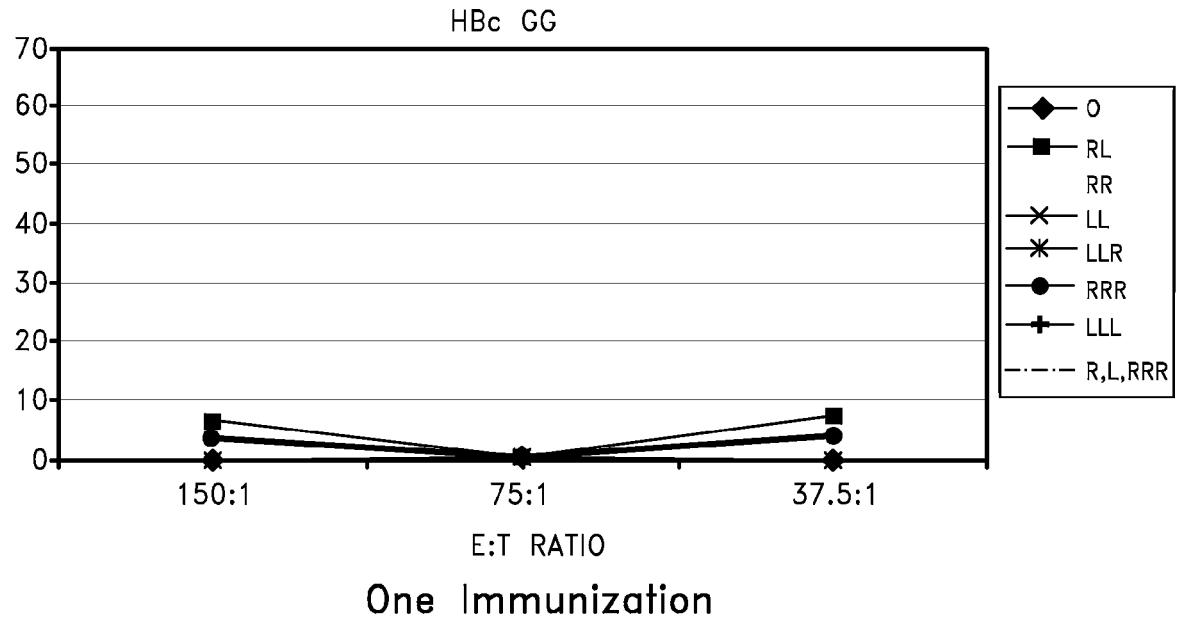
Figure 20B:
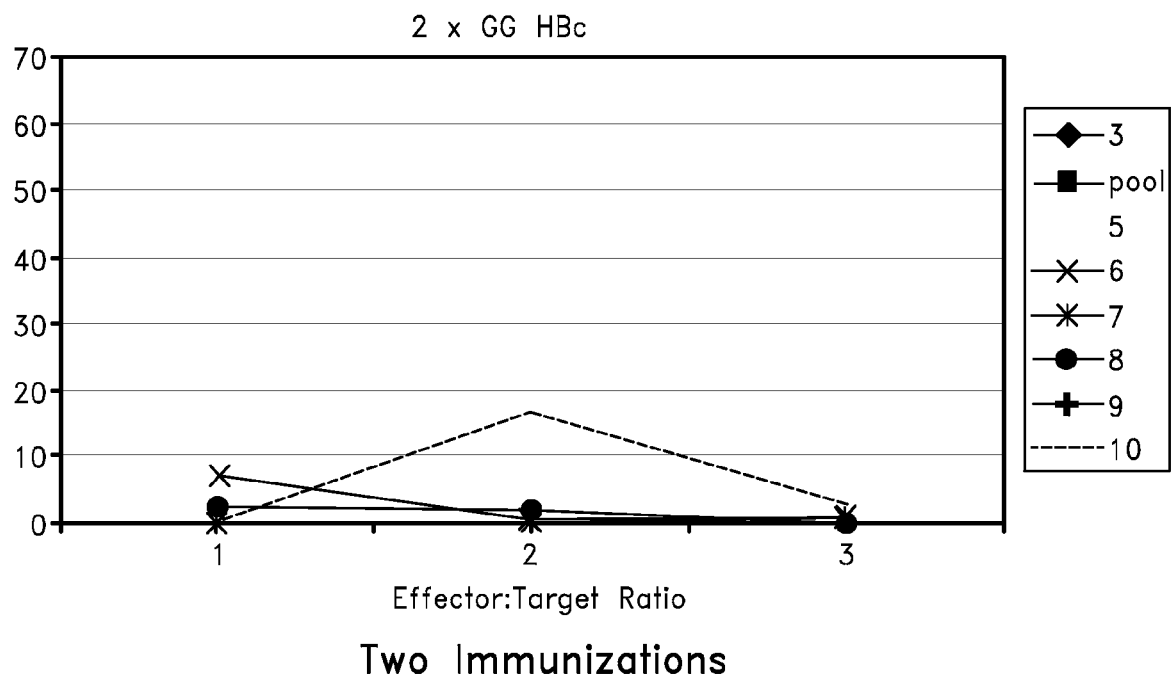

FIG. 20B is a graph showing the response of splenic T cells that were restimulated with peptide coated RMA-S cells. The splenic T cells were obtained from C57/BL6 mice that were provided a single 4 µg dose of HBcAg-pVAX1 with a gene gun at week 0 and week 4, as indicated.

Figure 21:
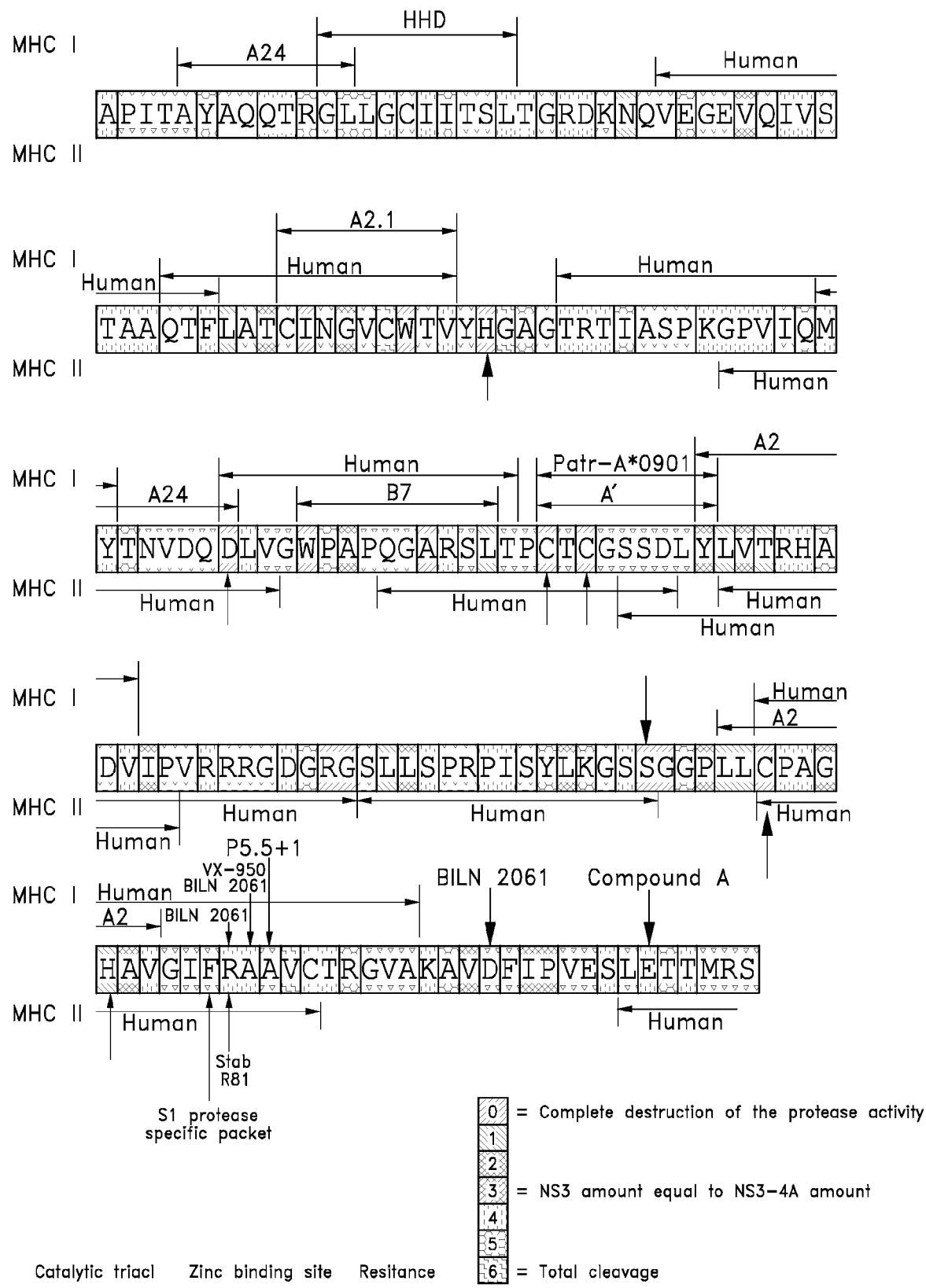

FIG. 21 shows the location of amino acid residues in the HCV NS3 protease that affect protease cleavage. Versions of NS3/4A-pVAX were constructed to encode proteins in which each amino acid of the shown sequence other than the alanine residues was substituted with an alanine residue. Each alanine residue was substituted with a glycine residue. The encoded polypeptides were analyzed for protease activity. The red color indicates the 16 mutations which resulted in a protein that lacked all protease activity. The dark blue color indicates the 3 mutations which resulted in a protein that exhibited greatly enhanced protease activity compared to wtNS3/4A.

Figure 22:
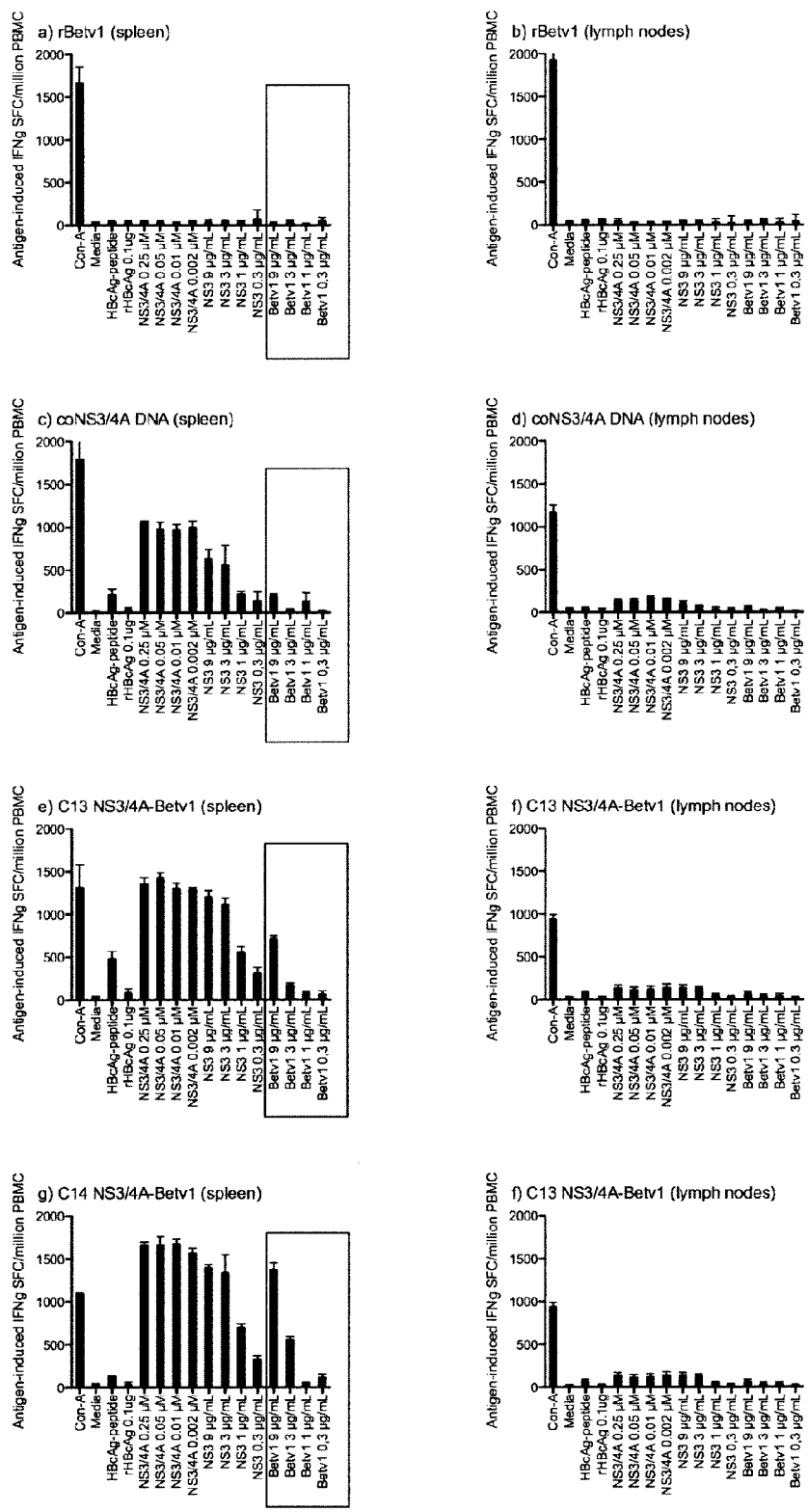

FIG. 22 shows the production of IFN-γ by splenocytes of mice immunized with various DNA and peptide antigens when primed with various antigen.

Figure 23:
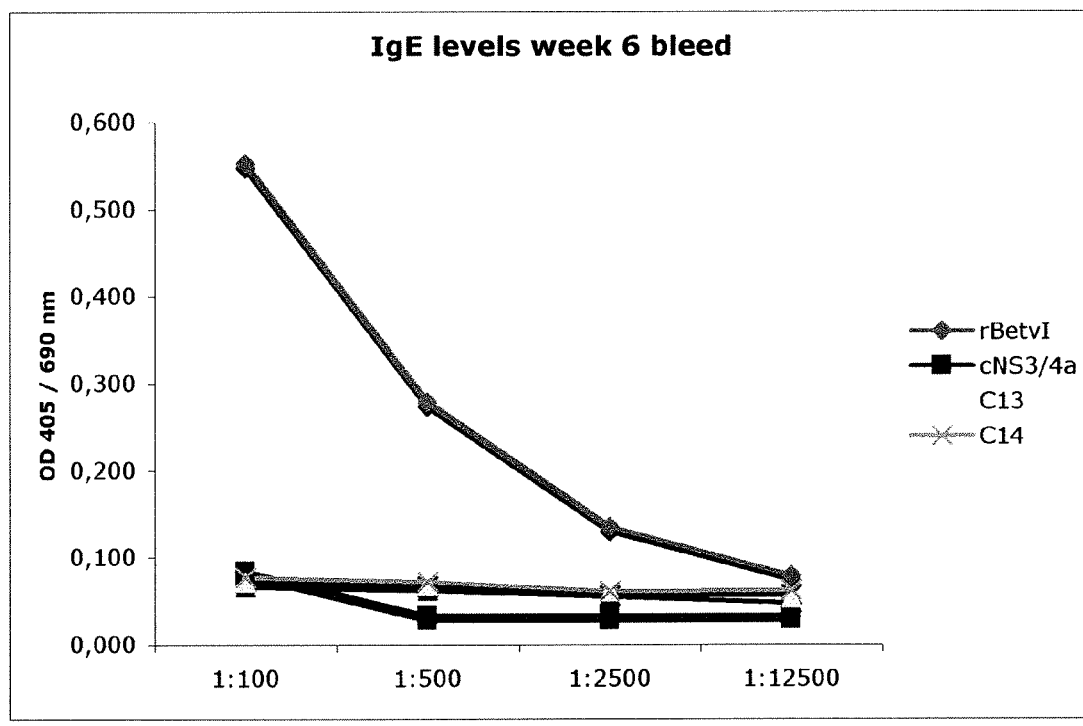

FIG. 23 shows the level of IgE production by mice immunized with either recombinant birch or a DNA construct containing a birch-NS3/4A fusion gene.

Figures 1, 24:
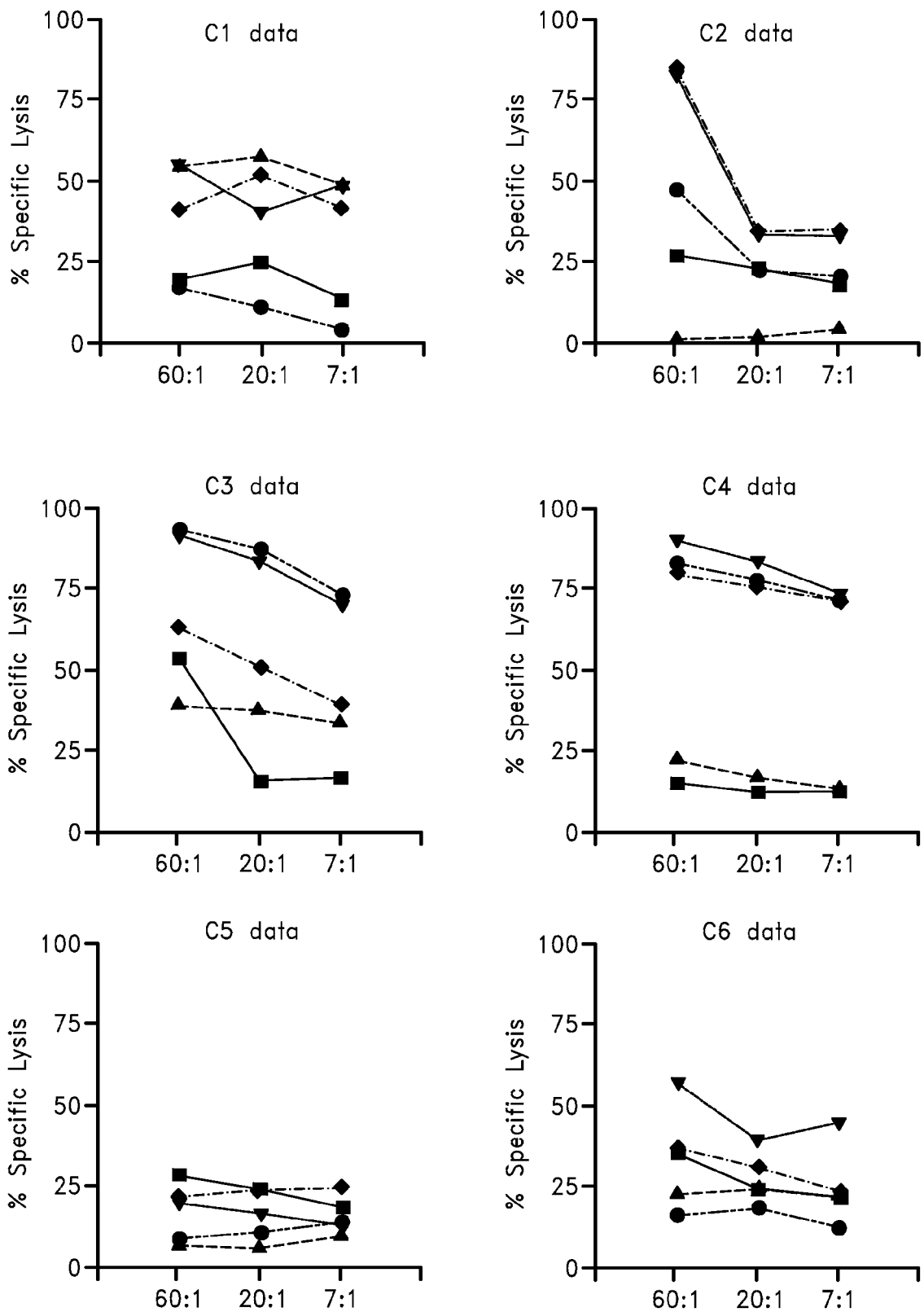
Figures 2, 24:
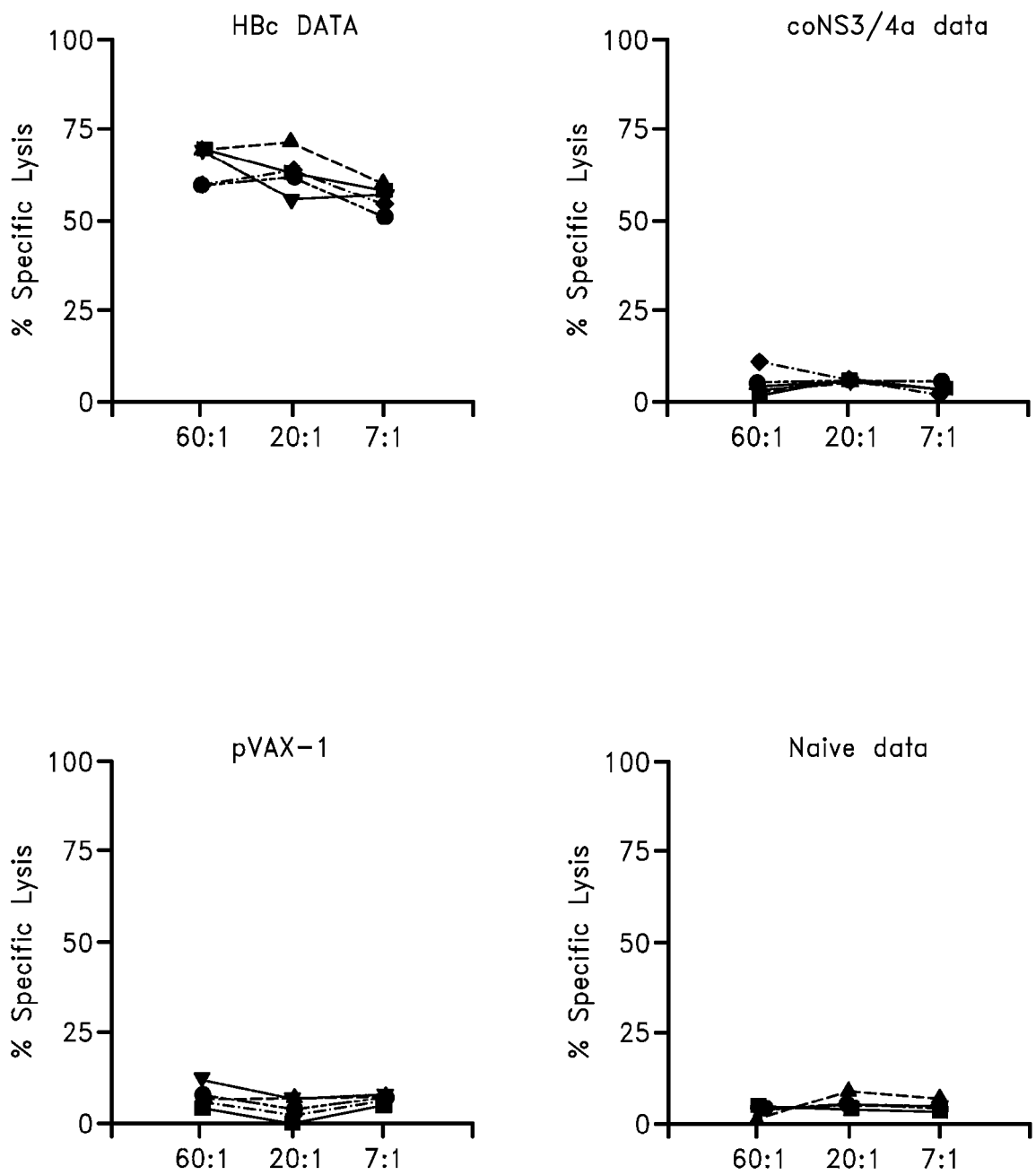

FIG. 24 shows the lysis of peptide loaded RMA-S cells.

DETAILED DESCRIPTION OF THE PREFERRED EMBODIMENT

Several of the embodiments described herein concern compositions and methods that are useful for generating, enhancing, or improving an immune response to an epitope of a target antigen. Disclosed herein are compositions relating to genetic constructs that include sequences from the Hepatitis C virus (HCV) and sequences encoding T-cell epitopes (TCEs), and methods of generating or enhancing an immune response using the genetic constructs and polypeptides encoded by the genetic constructs. Several embodiments disclosed herein provide nucleic acids that encode chimeric HCV NS3/4A polypeptides or fragments thereof of at least 3 amino acids in length. For example, the NS3/4A sequence or a fragment thereof can comprise at least, equal to, greater than, or less than, or any number in between 3, 5, 10, 20, 50, 100, 150, 200, 250, 300, 350, 400, 500, 700, 1000, 1200, or 1500 consecutive amino acids of a natural or synthetic NS3/4A polypeptide (e.g., a naturally occurring isotype or a codon-optimized or otherwise modified NS3/4A polypeptide). Exemplary NS3/4a sequences are disclosed in U.S. Pat. No. 6,960,569, hereby expressly incorporated by reference in its entirety. Exemplary codon-optimized sequences are disclosed in U.S. Patent Application Publication No. 2003/0206919, hereby expressly incorporated by reference in its entirety, and in SEQ ID NOs: 35 and 36. That is, the nucleic acid encoding the NS3/4A sequence or a fragment thereof can comprise at least, equal to, greater than, less than, or any number in between 9, 15, 30, 50, 75, 100, 125, 150, 175, 200, 250, 300, 400, 500, 600, 700, 800, 900, 1000, 1200, 1500, or 2000 consecutive nucleotides of a nucleic acid sequence that encodes a natural or synthetic NS3/4A polypeptide. Many of these embodiments also include a nucleic acid that encodes at least one TCE located within or flanking (e.g., juxtaposed to) the NS3/4A encoding fragment, such that the TCE is in a non-naturally occurring position. The encoded polypeptide retains catalytic activity (i.e., NS3 protease and/or NS3 helicase activity). Embodiments disclosed herein also provide chimeric NS3/4A polypeptides or fragments thereof of at least 3 amino acids in length, which include a TCE within or flanking (e.g., juxtaposed to) the NS3/4A sequences, such that the TCE is in a non-naturally-occurring position.

Generally, the generation, enhancement, or improvement of an immune response refers to an induction of a humoral (antibody) response and/or a cellular response. Most simply, an increase in the amount of antigen-specific antibodies (e.g., total IgG) can be seen by utilizing one or more of the embodiments described herein. Enhancement of an immune response refers to any statistically significant change in the level of one or more immune cells (T cells, B cells, antigen-presenting cells, dendritic cells and the like) or in the activity of one or more of these immune cells (cytotoxic T lymphocyte (CTL) activity, helper T lymphocyte (HTL) activity, cytokine secretion, change in profile of cytokine secretion). The skilled artisan will readily appreciate that several methods for establishing whether an immune response is generated, enhanced, or improved are available. A variety of methods for detecting the presence and levels of an immune response are available, for example. (See, e.g., Current Protocols in Immunology, Ed: John E. Coligan, et al. (2001) John Wiley & Sons, NY, N.Y.; Current Protocols in Molecular Biology, (2001), Greene Publ. Assoc. Inc. & John Wiley & Sons, NY, N.Y.; Ausubel et al. (2001) Current Protocols in Molecular Biology, Greene Publ. Assoc. Inc. & John Wiley & Sons, Inc., NY, N.Y.; Sambrook et al. (1989) Molecular Cloning, Second Ed., Cold Spring Harbor Laboratory, Plainview, N.Y.); Maniatis et al. (1982) Molecular Cloning, Cold Spring Harbor Laboratory, Plainview, N.Y.; and elsewhere). Illustrative methods useful in this context include intracellular cytokine staining (ICS), ELISPOT, proliferation assays, cytotoxic T cell assays including chromium release or equivalent assays, and gene expression analysis using any number of polymerase chain reaction (PCR) or RT-PCR based assays. For example, the number of $CD8^+$ T-cells specific for a particular antigen or TCE can be measured by flow cytometry. (See, e.g. Frelin et al. (2004) Gene Therapy 11:522-533). CTL priming can also be measured in vivo by, for example, a tumor inhibition model, in which the ability of an animal (e.g. mouse) to inhibit growth of tumors derived from tumor cells engineered to express the antigen of interest. Id.

In some embodiments, generation or enhancement of an immune response comprises an increase in target-specific CTL activity of between 1.5 and 5 fold in a subject that is provided a composition that comprises the nucleic acids or polypeptides disclosed herein (e.g. in the context of a chimeric NS3/4A nucleic acid or polypeptide), wherein the TCE is derived from the target, as compared to the same TCE that is not provided in the context of the compositions disclosed herein. In some embodiments, an enhancement of an immune response comprises an increase in target-specific CTL activity of about 2, 2.5, 3, 3.5, 4, 4.5, 5, 5.5, 6, 6.5, 7, 7.5, 8, 8.5, 9, 9.5, 10, 10.5, 11, 11.5, 12, 12.5, 15, 16, 17, 18, 19, 20, or more fold in a subject that is provided a composition that comprises a nucleic acid or a polypeptide disclosed herein (e.g. in the context of a chimeric NS3/4A nucleic acid or polypeptide), wherein the TCE is derived from the target, as compared to as compared to administration of the same TCE that is not provided in the context of the compositions disclosed herein.

In other embodiments, an alteration of an immune response comprises an increase in target-specific HTL activity, such as proliferation of helper T cells, of between 1.5 and 5 fold in a subject that is provided a composition that comprises a nucleic acid or polypeptide disclosed herein (e.g. in the context of a chimeric NS3/4A nucleic acid or polypeptide), wherein the TCE is derived from the target, as compared to the same TCE that is not provided in the context of the compositions disclosed herein. In some embodiments, alteration of an immune response comprises an increase in target-specific HTL activity of about 2, 2.5, 3, 3.5, 4, 4.5, 5, 5.5, 6, 6.5, 7, 7.5, 8, 8.5, 9, 9.5, 10, 10.5, 11, 11.5, 12, 12.5, 15, 16, 17, 18, 19, 20, or more fold in a subject that is provided a composition that comprises a nucleic acid or polypeptide disclosed herein (e.g. in the context of a chimeric NS3/4A nucleic acid or polypeptide), wherein the TCE is derived from the target, as compared to administration of the same TCE that is not provided in the context of the compositions disclosed herein. In this context, an enhancement in HTL activity may comprise an increase as described above, or decrease, in production of a particular cytokine, such as interferongamma (IFNγ), interleukin-1 (IL-1), IL-2, IL-3, IL-6, IL-7, IL-12, IL-15, tumor necrosis factor-alpha (TNFα), granulocyte macrophage colony-stimulating factor (GM-CSF), granulocyte-colony stimulating factor (G-CSF), or other cytokine. In this regard, generation or enhancement of an immune response may comprise a shift from a Th2 type response to a Th1 type response or in certain embodiments a shift from a Th1 type response, to a Th2 type response. In other embodiments, the generation or enhancement of an immune response may comprise the stimulation of a predominantly Th1 or a Th2 type response.

In still more embodiments, an increase in the amount of antibody specific for the antigen (e.g., total IgG) is increased. Some embodiments, for example, generate an increase in heterologous target-specific antibody production of between 1.5, 2, 3, 4, or 5 fold in a subject that is provided a composition comprising the nucleic acids or polypeptides disclosed herein, (e.g. in the context of a chimeric NS3/4A nucleic acid or polypeptide), wherein the TCE is derived from the target, as compared to the same TCE that is not present in the context of the compositions disclosed herein. In some embodiments, the increase in heterologous target-specific antibody production is about 2, 2.5, 3, 3.5, 4, 4.5, 5, 5.5, 6, 6.5, 7, 7.5, 8, 8.5, 9, 9.5, 10, 10.5, 11, 11.5, 12, 12.5, 15, 16, 17, 18, 19, 20, or more fold in a subject that is provided a composition that comprises a nucleic acid or polypeptide disclosed herein, (e.g. in the context of a chimeric NS3/4A nucleic acid or polypeptide), wherein the TCE is derived from the target, as compared to as compared to administration of the same TCE that is not present in the context of the compositions disclosed herein.

Generation or enhancement of a cellular immune response can also refer to the frequency of cytotoxic T lymphocytes (CTLs) specific for a desired antigen that are primed, or the rapidity of priming of cytotoxic T lymphocytes (CTLs) specific for a desired antigen, compared to the priming of CTLs specific for the desired epitope when the epitope is not presented in the context of the nucleic acids or peptides disclosed herein. The section below describes several of the NS3/4A sequences that can be used in the compositions and methods described herein.

HCV Sequences

Several embodiments described herein provide genetic constructs that contain HCV sequences from the NS3/NS4A region of HCV. The NS3/NS4A region of HCV has been studied extensively. NS3, due to its limited genetic variability and relatively large size (631 amino acids) has in itself been studied as an attractive target for generating immune responses against HCV. (See Bartenschlager R., et al. (1995) J. Virol. 67:3835-3844; Pang et al. (2002) EMBO J. 21:1168-1176). The fact that NS3 is a relatively large protein renders it less likely to exhibit genetic non-responder status at the T cell level. (See Frelin et al. (2003) Gene Therapy 10:689-699). Accordingly, it was contemplated that the NS3 region of HCV is useful in genetic constructs for generating or enhancing an immune response to an accompanied target antigen (e.g., in constructs that encode a TCE derived from a pathogen).

The catalytic activity of NS3 is known to affect a host's ability to mount an immune response to HCV. (See, e.g., Foy, et al. (2005), Proc. Nat. Acad. Sci. USA 102(8): 2986-2991; Meylan, et al. (2005) Nature 437(20)1167-1172; Li et al. (2005) Proc. Nat. Acad. Sci. USA 102(8): 2992-2997). Accordingly, embodiments described herein relate to genetic constructs encoding catalytically active NS3/4A polypeptide derivatives, or functional fragments thereof, as well as the polypeptides encoded by the genetic constructs. As used herein, the term "functional fragment" of a polypeptide refers to a variant of the polypeptide that is not full-length yet retains desired attributes, (e.g. NS3A protease and/or helicase activity, NS4A co-factor activity, or immunogenicity) of the full-length native sequence.

The NS3 protein of HCV possesses both protease and helicase activity. (See Liu, D. et al., (2001) J. Mol. Biol. 314:543-561). In preferred embodiments, compositions disclosed herein include sequences that retain NS3 protease and/or helicase activity. In addition to cleaving the HCV polypeptide, NS3 protease cleaves host proteins that normally function to activate the host's innate immune response. (See, e.g. Foy, et al. (2005), Proc. Nat. Acad. Sci. USA 102(8): 2986-2991; Meylan, et al. (2005) Nature 437(20)1167-1172; Li et al. (2005) Proc. Nat. Acad. Sci. USA 102(8): 2992-2997). Specifically, NS3 has been shown to cleave the Toll-like receptor 3 adaptor protein TRIF as well as Cardif Id. Accordingly, in some embodiments, the NS3/4A nucleic acid sequences encode a polypeptide that comprises an NS3 protease domain (e.g., a sequence that exhibits protease activity).

NS3 protease activity is localized within the first 181 amino acids of the of NS3/4A peptide. (See, Lin, C. et al., (1994) J. Virol. 68(12):8147-8157). The NS3 protease domain has a trypsin-like serine proteinase motif and a zinc binding site. (See, Love, R. (1996) Cell 87:331-342). Three residues, His57, Asp81 and Ser139 constitute a catalytic triad typical of the trypsin-like serine proteases that are strictly conserved in all HCV genotype sequences. Strict conservation of spacing and order of these residues is also seen. The active site also contains an oxyanion/stabilization loop. The zinc binding site of NS3 is located within amino acids Cys97, Cys99, Cys145 and His149. Id. The zinc binding site is more highly conserved than the active site and is responsible for stabilizing the structure of the active site. Id.

The crystal structure HCV NS3 with an NS4A polypeptide has been solved. (See Yao, et al. (1999), Structure 7:1353-1363). Thus, where the NS3 protease domain contains, for example, an alpha-helix or a beta-sheet structure, in some embodiments, variants or modified NS3/4A molecules comprise insertions of amino acids that maintain that specific structure. In addition to the structural information above, we describe herein experimental results in which each and every residue in the NS3 protease domain was systematically mutated and tested for protease activity, thus providing guidance in relation to NS3/4A variants, such as which amino acids in the NS3 protease domain are preferably preserved in embodiments that retain NS3 protease activity, as well as positions along the protease domain that can tolerate insertions of TCEs and/or TCEs and linkers, as discussed in more detail below.

As used herein the phrase "NS3 protease domain" refers to sequences encoding the NS3 protease domain from any or all HCV genotypes or isotypes now known or discovered in the future. Nucleic acids encoding NS3 protease domains include any nucleic acid, taking into account the degeneracy of the genetic code that encodes an NS3 protease domain, and also including codon-optimized NS3 sequences and modified NS3 sequences derived from naturally-occurring NS3 nucleic acids. Non-limiting examples of NS3/4A nucleic acid sequences that can be used with the embodiments described herein include SEQ ID NOs: 1, 35, and 572-808. By way of example, NS3 helicase domains can comprise nucleic acid residues 1-551 of SEQ ID NO:35, or analogous residues in any NS3/4A nucleic acid. SEQ ID NO: 35 is an exemplary codon-optimized sequence of a nucleic acid encoding an NS3/NS4A protein generated from an HCV isolate.

The NS3 helicase domain resides in the C terminal 450 amino acids of the protein. Yao et al. (1997) Nat. Struct. Biol. 4(6):463-467. The structure of the helicase domain by itself, in complex with single-stranded DNA, and in the bifunctional protease-helicase complexes with NS4A has been solved. (Id. and Kim et al. (1998), Structure 6:89-100). Previous studies have indicated that the protease domain of NS3 enhances the helicase activity of NS3. (See, Frick et al. (2004) J Biol Chem. 279(2):1269-1280). The available structural information above provide guidance as to the nature of NS3/4A variants, which include substitutions, insertions and deletions in the NS3 helicase domain that can be made without perturbing the catalytic activity of the helicase domain, for example in embodiments that retain NS3 helicase activity.

As used herein, the phrase "NS3 helicase domain" refers to sequences encoding an NS3 helicase domain from any or all HCV genotypes now known or discovered in the future. Nucleic acids encoding NS3 helicase domains include any nucleic acid, taking into account the degeneracy of the genetic code that encodes an NS3 polypeptide and also including codon-optimized NS3 helicase sequences and modified NS3 helicase sequences derived from naturally-occurring NS3 helicase nucleic acids. Non-limiting examples of NS3/4A nucleic acid sequences, including sequences of NS3 helicase domains, are SEQ ID NOs: 1, 35, and 572-808. By way of example, NS3 helicase domains can comprise nucleic acid residues 218-1568 of SEQ ID NO:35, or analogous residues in any NS3/4A nucleic acid. SEQ ID NO: 35 is an exemplary codon-optimized nucleic acid sequence of an NS3/NS4A peptide generated from an HCV isolate.

The NS4 polypeptide of HCV has been shown to increase the intracellular stability of NS3 and target NS3 to intracellular membranes, thereby potentially increasing the immunogenicity of NS3. (See, Wolk, B. et al. (2000). J. Virol. 74:2293-2304). We recently demonstrated that NS4A gene from HCV is an enhancer that increases transcription and immunogenicity of an associated gene or nucleic acid (e.g., NS3). (See, WO 04/048403, which designated the United States and was published in English, the disclosure of which is hereby expressly incorporated by reference in its entirety). The data illustrate that when HCV-1 NS3/4A was transfected into mammalian cells, vis a vis a eukaryotic expression vector, the expression level of NS3 was increased compared to the expression levels of NS3 alone (i.e., without NS4A). Further, immunization with an NS3/NS4A construct was shown to prime NS3-specific CTLs, when the construct was provided either i.m. or transdermally. Accordingly, embodiments disclosed herein include sequences encoding an NS4A polypeptide, variant, or functional fragment thereof.

As used herein, the term "NS4A" refers to either nucleic acid or amino acid sequences of the NS4A region from any and all HCV genotypes now known or discovered in the future. Nucleic acids encoding NS4A include any nucleic acid, taking into account the degeneracy of the genetic code, that encodes an NS4A domain and also includes codon-optimized NS4A sequences and modified NS4A sequences derived from naturally-occurring NS4A nucleic acids. Non-limiting examples of NS3/4A nucleic acid sequences, including sequences of NS4 co-factor domains, are SEQ ID NOs: 1, 35, 567-804. By way of example, NS3 helicase domains can comprise nucleic acid residues 1569-2069 of SEQ ID NO:35, or analogous residues in any NS3/4A nucleic acid. SEQ ID NO: 35 is an exemplary codon-optimized nucleic acid sequence of an NS3/NS4A peptide generated from an HCV isolate. SEQ ID NO:36 is an exemplary codon-optimized amino acid sequence of an NS3/4A peptide generated from an HCV isolate.

Current listings of exemplary HCV nucleic acid and polypeptide sequences, including NS3/NS4A, are publicly available at the Los Alamos National Laboratories worldwide web site. HCV NS3/4A nucleic acid sequences (including novel NS3/NS4A regions) can also be isolated from patients infected with HCV using the nucleic acids described herein. (See also, Example 1). RNA obtained from a patient infected with HCV can be reverse transcribed and the resultant cDNA can be amplified using PCR or another amplification technique. The primers are preferably obtained from the NS3/4A sequence of SEQ. ID. NO.: 1.

For a review of PCR technology, see Molecular Cloning to Genetic Engineering White, B. A. Ed. in *Methods in Molecular Biology* 67: Humana Press, Totowa (1997) and the publication entitled "PCR Methods and Applications" (1991, Cold Spring Harbor Laboratory Press). For amplification of mRNAs, it is within the scope of the invention to reverse transcribe mRNA into cDNA followed by PCR (RT-PCR); or, to use a single enzyme for both steps as described in U.S. Pat. No. 5,322,770. Another technique involves the use of Reverse Transcriptase Asymmetric Gap Ligase Chain Reaction (RT-AGLCR), as described by Marshall R. L. et al. (*PCR Methods and Applications* 4:80-84, 1994).

Briefly, RNA is isolated, following standard procedures. A reverse transcription reaction is performed on the RNA using an oligonucleotide primer specific for the most 5' end of the amplified fragment as a primer of first strand synthesis. The resulting RNA/DNA hybrid is then "tailed" with guanines using a standard terminal transferase reaction. The hybrid is then digested with RNAse H, and second strand synthesis is primed with a poly-C primer. Thus, cDNA sequences upstream of the amplified fragment are easily isolated. For a review of cloning strategies which can be used see e.g., Sambrook et al., 1989, supra.

In each of these amplification procedures, primers on either side of the sequence to be amplified are added to a suitably prepared nucleic acid sample along with dNTPs and a thermostable polymerase, such as Taq polymerase, Pfu polymerase, or Vent polymerase. The nucleic acid in the sample is denatured and the primers are specifically hybridized to complementary nucleic acid sequences in the sample. The hybridized primers are then extended. Thereafter, another cycle of denaturation, hybridization, and extension is initiated. The cycles are repeated multiple times to produce an amplified fragment containing the nucleic acid sequence between the primer sites. PCR has further been described in several patents including U.S. Pat. Nos. 4,683,195, 4,683,202 and 4,965,188.

The primers are selected to be substantially complementary to a portion of the nucleic acid sequence of (SEQ. ID. NO.: 1) that is unique to this NS3/4A molecule, thereby allowing the sequences between the primers to be amplified. Preferably, primers can be any number between at least 16-20, 20-25, or 25-30 nucleotides in length. The formation of stable hybrids depends on the melting temperature (Tm) of the DNA. The Tm depends on the length of the primer, the ionic strength of the solution and the G+C content. The higher the G+C content of the primer, the higher is the melting temperature because G:C pairs are held by three H bonds whereas A:T pairs have only two. The G+C content of the amplification primers described herein preferably range between 10% and 75%, more preferably between 35% and 60%, and most preferably between 40% and 55%. The appropriate length for primers under a particular set of assay conditions can be empirically determined by one of skill in the art.

The spacing of the primers relates to the length of the segment to be amplified. In the context of the embodiments described herein, amplified segments carrying nucleic acid sequence encoding HCV peptides can range in size from at least about 25 bp to the entire length of the HCV genome. Amplification fragments from 25-1000 bp are typical, fragments from 50-1000 bp are preferred and fragments from 100-600 bp are highly preferred. It will be appreciated that amplification primers can be of any sequence that allows for specific amplification of the NS3/4A region and can, for example, include modifications such as restriction sites to facilitate cloning.

The PCR product can be subcloned and sequenced to ensure that the amplified sequences represent the sequences of an HCV peptide. The PCR fragment can then be used to isolate a full length cDNA clone by a variety of methods. For example, the amplified fragment can be labeled and used to screen a cDNA library, such as a bacteriophage cDNA library. Alternatively, the labeled fragment can be used to isolate genomic clones via the screening of a genomic library. Additionally, an expression library can be constructed utilizing cDNA synthesized from, for example, RNA isolated from an infected patient. In this manner, HCV gene products can be isolated using standard antibody screening techniques in conjunction with antibodies raised against the HCV gene product. (For screening techniques, see, for example, Harlow, E. and Lane, eds., 1988, *Antibodies: A Laboratory Manual*, Cold Spring Harbor Press, Cold Spring Harbor).

NS3/NS4A Variant Sequences

A novel nucleic acid and protein corresponding to the NS3/4A domain of HCV was cloned from a patient infected with HCV (SEQ. ID. NO.: 1). A Genebank search revealed that the cloned sequence had the greatest homology to HCV sequences but was only 93% homologous to the closest HCV relative (accession no AJ 278830). This novel peptide (SEQ. ID. NO.: 2) and fragments thereof (e.g., SEQ. ID. NOs.: 14 and 15) that are any number of consecutive amino acids between at least 3-50 (e.g., 3, 4, 6, 8, 10, 12, 15, 20, 25, 30, 35, 40, 45, or 50 amino acids in length), nucleic acids encoding these molecules, vectors having said nucleic acids, and cells having said vectors, nucleic acids, or peptides are embodiments of the invention. It was also discovered that both the NS3/4A gene (SEQ. ID. NO.: 1) and corresponding peptide (SEQ. ID. NO.: 2) were immunogenic in vivo.

In certain embodiments, the NS3/4A nucleic acids and polypeptides of the compositions and methods disclosed herein include variations in nucleotide and/or amino acid sequences, compared to native NS3/4A sequences and are referred to as NS3/4A variants. As used herein, the term "native" refers to naturally occurring HCV sequences (e.g., available HCV isotypes). Variants may include a substitution, deletion or insertion of one or more nucleotides, amino acids, or codons encoding the NS3/4A sequences of the chimeric NS3/4A polypeptides, which results in a change in the amino acid sequence of the NS3/4A polypeptide, as compared with the native sequence. Variants can be engineered, for example, using any of the techniques and guidelines for conservative and non-conservative mutations set forth, for instance, in U.S. Pat. No. 5,364,934.

Mutants of the novel NS3/4A peptide were created. It was discovered that truncated mutants (e.g., SEQ. ID. NOs.: 12 and 13) and mutants that lack a proteolytic cleavage site (SEQ. ID. NOs.: 3-11), were also immunogenic in vivo. These novel peptides (SEQ. ID. NOs.: 3-13) and fragments thereof (e.g., SEQ. ID. NOs.: 16-26) that are any number of consecutive amino acids between at least 3-50 (e.g., 3, 4, 6, 8, 10, 12, 15, 20, 25, 30, 35, 40, 45, or 50 amino acids in length), nucleic acids encoding these molecules, vectors having said nucleic acids, and cells having said vectors, nucleic acids, or peptides are also embodiments of the invention.

A codon-optimized nucleic acid encoding NS3/4a was also created and was found to be immunogenic. The nucleic acid of SEQ. ID. NO.: 1 was analyzed for codon usage and the sequence was compared to the codons that are most commonly used in human cells. Because HCV is a human pathogen, it was unexpected to discover that the virus had not yet evolved to use codons that are most frequently found to encode human proteins (e.g., optimal human codons). A total of 435 nucleotides were replaced to generate the codon-optimized synthetic NS3/4A nucleic acid. The NS3/4A peptide encoded by the codon-optimized nucleic acid sequence (SEQ. ID. NO.: 36) was 98% homologous to HCV-1 and contained a total of 15 different amino acids.

The codon optimized nucleic acid (MSLF1 or coNS3/4A) (SEQ. ID. NO.: 35) was found to be more efficiently translated in vitro than the native NS3/4A and that mice immunized with the MSLF1 containing construct generated significantly more NS3/4A specific antibodies than mice immunized with a wild-type NS3/4A containing construct. Further, mice immunized with the MSLF1 containing construct were found to prime NS3-specific CTLs more effectively and exhibit better in vivo tumor inhibiting immune responses than mice immunized with wild-type NS3/4A containing constructs.

NS3/NS4A genes encoding polypeptides with alanine or glycine substitutions in the serine protease domain of NS3 (i.e., the first 181 amino acids) (SEQ ID NO's: 40 through 220 and 1329-1339) were found to have altered protease activity compared to the wtNS3/NS4A polypeptide.

The peptides and nucleic acids described above are useful as immunogens, which can be administered alone or in conjunction with an adjuvant. Preferred embodiments include compositions that comprise one or more of the nucleic acids and/or peptides described above with or without an adjuvant. That is, some of the compositions described herein are prepared with or without an adjuvant and comprise, consist, or consist essentially of a NS3/4A peptide (SEQ. ID. NO.: 2 or SEQ. ID. NO.: 36) or fragments thereof that are any number of consecutive amino acids between at least 3-50 (e.g., 3, 4, 6, 8, 10, 12, 15, 20, 25, 30, 35, 40, 45, or 50 amino acids in length) (e.g., SEQ. ID. NOs.: 14 and 15) or a nucleic acid encoding one or more of these molecules (e.g., SEQ. ID. NO.: 35) or a fragment thereof that is any number of consecutive nucleotides between at least 12-2112 (e.g., 12-15, 15-20, 20-30, 30-50, 50-100, 100-200, 200-500, 500-1000, 1000-1500, 1500-2079, or 1500-2112 consecutive nucleotides in length). Additional compositions are prepared with or without an adjuvant and comprise, consist, or consist essentially of one or more of the NS3/4A mutant peptides (SEQ. ID. NOs.: 3-13) and fragments thereof that are any number of consecutive amino acids between at least 3-50 (e.g., 3, 4, 6, 8, 10, 12, 15, 20, 25, 30, 35, 40, 45, or 50 amino acids in length). Some of the compositions described herein are prepared with or without an adjuvant and comprise, consist, or consist essentially of a mutant NS3/NS4A peptide (e.g., SEQ ID NO's: 40 through 220 and 1329-1339), or a nucleic acid encoding one or more of these molecules.

It was also discovered that compositions comprising ribavirin and an antigen (e.g., one or more of the previously described HCV peptides or nucleic acids) enhance and/or facilitate an animal's immune response to the antigen. That is, it was discovered that ribavirin is a very effective "adjuvant," which for the purposes of this disclosure, refers to a material that has the ability to enhance or facilitate an immune response to a particular antigen. The adjuvant activity of ribavirin was manifested by a significant increase in immune-mediated protection against the antigen, an increase in the titer of antibody raised to the antigen, and an increase in proliferative T cell responses.

Accordingly, compositions (e.g., vaccines and other medicaments) that comprise ribavirin and one or more of the peptides or nucleic acids described herein are embodiments of the invention. These compositions can vary according to the amount of ribavirin, the form of ribavirin, as well as the sequence of the HCV nucleic acid or peptide.

Embodiments of the invention also include methods of making and using the compositions above. Some methods involve the making of nucleic acids encoding NS3/4A, codon-optimized NS3/4A, mutant NS34A, fragments thereof that are any number of consecutive nucleotides between at least 9-100 (e.g., 9, 12, 15, 18, 21, 24, 27, 30, 50, 60, 75, 80, 90, or 100 consecutive nucleotides in length), peptides corresponding to said nucleic acids, constructs comprising said nucleic acids, and cells containing said compositions. Preferred methods, however, concern the making of vaccine compositions or immunogenic preparations that comprise, consist, or consist essentially of the newly discovered NS3/4A fragment, codon-optimized NS3/4A, or an NS3/4A mutant (e.g., a truncated mutant, a mutant lacking a proteolytic cleavage site, or a mutant having altered protease activity), or a fragment thereof or a nucleic acid encoding one or more of these molecules, as described above. Preferred fragments for use with the methods described herein include SEQ. ID. NOs.: 12-27 and fragments of SEQ. ID. NO.: 35 that contain at least 30 consecutive nucleotides. The compositions described above can be made by providing an adjuvant (e.g., ribavirin), providing an HCV antigen (e.g., a peptide comprising an HCV antigen such as (SEQ. ID. NOs.: 2-11, 36, or 40-220) or a fragment thereof such as, SEQ. ID. NOs.: 12-26 or a nucleic acid encoding one or more of said peptides), and mixing said adjuvant and said antigen so as to formulate a composition that can be used to enhance or facilitate an immune response in a subject to said antigen.

Methods of enhancing or promoting an immune response in an animal, including humans, to an antigen are also provided. Such methods can be practiced, for example, by identifying an animal in need of an immune response to HCV and providing said animal a composition comprising one or more of the nucleic acids or peptides above and an amount of adjuvant that is effective to enhance or facilitate an immune response to the antigen/epitope. In some embodiments, the antigen and the adjuvant are administered separately, instead of in a single mixture. Preferably, in this instance, the adjuvant is administered a short time before or a short time after administering the antigen. Preferred methods involve providing the animal in need with ribavirin and NS3/4A (e.g., SEQ. ID. NO.: 2), codon-optimized NS3/4A (e.g., SEQ. ID. NO.: 36), a mutant NS3/4A (e.g., SEQ. ID. NOs.: 3-13 or 40-220), a fragment thereof (e.g., SEQ. ID. NOs.: 14-26) containing any number of consecutive amino acids between at least 3-50 (e.g., 3, 4, 6, 8, 10, 12, 15, 20, 25, 30, 35, 40, 45, or 50 amino acids in length) or a nucleic acid encoding any one or more of said molecules.

Other embodiments concern methods of treating and preventing HCV infection. By one approach, an immunogen comprising one or more of the HCV nucleic acids or peptides described herein are used to prepare a medicament for the treatment and/or prevention of HCV infection. By another approach, an individual in need of a medicament that prevents and/or treats HCV infection is identified and said individual is provided a medicament comprising ribavirin and an HCV antigen such as NS3/4A (e.g., SEQ. ID. NO.: 2), codon-optimized NS3/4A (e.g., SEQ. ID. NO.: 36), or a mutant NS3/4A (e.g., SEQ. ID. NOs.: 3-13 or 40-220), a fragment thereof (e.g., SEQ. ID. NOs.: 14-26) containing any number of consecutive amino acids between at least 3-50 (e.g., 3, 4, 6, 8, 10, 12, 15, 20, 25, 30, 35, 40, 45, or 50 amino acids in length) or a nucleic acid encoding any one or more of these molecules.

The section below discusses the discovery of the novel NS3/4A gene, the codon-optimized NS3/4A gene, the creation of the NS3/4A mutants, and the characterization of the nucleic acids and peptides corresponding thereto.

NS3/4A, NS3/4A Mutants, and Codon-Optimized NS3/4A

A novel nucleic acid and protein corresponding to the NS3/4A domain of HCV was cloned from a patient infected with HCV (SEQ. ID. NOs.: 1 and 2). A Genebank search revealed that the cloned sequence had the greatest homology to HCV sequences but was only 93% homologous to the closest HCV relative (accession no AJ 278830). A truncated mutant of the novel NS3/4A peptide and NS3/4A mutants, which lack a proteolytic cleavage site, (as well as corresponding nucleic acids) were also created. Further, a human codon-optimized NS3/4A nucleic acid and peptide were created. It was discovered that these novel peptides and nucleic acids encoding said peptides were potent immunogens that can be mixed with adjuvants so as to make a composition that induces a recipient to provide an immune response to HCV. The cloning of the novel NS3/4A gene and the creation of the various NS3/4A mutants and codon optimized NS3/4A gene are described in the following example.

EXAMPLE 1

The NS3/4A sequence was amplified from the serum of an HCV-infected patient (HCV genotype 1a) using the Polymerase Chain Reaction (PCR). Total RNA was extracted from serum, and cDNA synthesis and PCR were performed according to standard protocols (Chen M et al., *J. Med. Virol.* 43:223-226 (1995)). The cDNA synthesis was initiated using the antisense primer "NS4KR" (5'-CCG TCT AGA TCA GCA CTC TTC CAT TTC ATC-3' (SEQ. ID. NO.: 28)). From this cDNA, a 2079 base pair DNA fragment of HCV, corresponding to amino acids 1007 to 1711, which encompasses the NS3 and NS4A genes, was amplified. A high fidelity polymerase (Expand High Fidelity PCR, Boehringer-Mannheim, Mannheim, Germany) was used with the "NS3KF" primer (5'-CCT GAA TTC ATG GCG CCT ATC ACG GCC TAT-3' (SEQ. ID. NO.: 29) and the NS4KR primer. The NS3KF primer contained a EcoRI restriction enzyme cleavage site and a start codon and the primer NS4KR contained a XbaI restriction enzyme cleavage site and a stop codon.

The amplified fragment was then sequenced (SEQ. ID. NO.: 1). Sequence comparison analysis revealed that the gene fragment was amplified from a viral strain of genotype 1a. A computerized BLAST search against the Genbank database using the NCBI website revealed that the closest HCV homologue was 93% identical in nucleotide sequence.

The amplified DNA fragment was then digested with EcoRI and XbaI, and was inserted into a pcDNA3.1/His plasmid (Invitrogen) digested with the same enzymes. The NS3/4A-pcDNA3.1 plasmid was then digested with EcoRI and Xba I and the insert was purified using the QiaQuick kit (Qiagen, Hamburg, Germany) and was ligated to a EcoRI/Xba I digested pVAX vector (Invitrogen) so as to generate the NS3/4A-pVAX plasmid.

The rNS3 truncated mutant was obtained by deleting NS4A sequence from the NS3/4A DNA. Accordingly, the NS3 gene sequence of NS3/4A-pVAX was PCR amplified using the primers NS3KF and 3'NotI (5'-CCA CGC GGC CGC GAC GAC CTA CAG-3' (SEQ. ID. NO.: 30)) containing EcoRI and Not I restriction sites, respectively. The NS3 fragment (1850 bp) was then ligated to a EcoRI and Not I digested pVAX plasmid to generate the NS3-pVAX vector. Plasmids were grown in BL21 *E. coli* cells. The plasmids were sequenced and were verified by restriction cleavage and the results were as to be expected based on the original sequence.

In some embodiments, nucleic acid sequences comprising, consisting essentially of, or consisting of sequences encoding TCEs are inserted within or flanking (e.g., juxtaposed to) the NS3/4A-encoding sequence described herein. In some embodiments, a linker or adjuvant sequence is also, optionally, inserted within or flanking (e.g., juxtaposed to) an NS3/4A native or variant sequence, or a native or variant TCE sequence. For example, the chimeric NS3/4A polypeptide encoded by the nucleic acids above can include sequences encoding a TCE, or a TCE flanked on one or both sides by linkers and/or adjuvant sequences, inserted between amino acids 1 and 2, 2 and 3, 3 and 4, 4 and 5, 5 and 6, 6 and 7, 7 and 8, 8 and 9, 9 and 10, 10 and 11, 11 and 12, 12 and 13, 13 and 14, 14 and 15, 15 and 16, 16 and 17, 17 and 18, 18 and 19, 19 and 20, 20 and 21, 21 and 22, 22 and 23, 23 and 24, 24 and 25, 25 and 26, 26 and 27, 27 and 28, 28 and 29, 29 and 30, 30 and 31, 31 and 32, 32 and 33, 33 and 34, 34 and 35, 35 and 36, 36 and 37, 37 and 38, 38 and 39, 39 and 40, 40 and 41, 41 and 42, 42 and 43, 43 and 44, 44 and 45, 45 and 46, 46 and 47, 47 and 48, 48 and 49, 49 and 50, 50 and 51, 51 and 52, 52 and 53, 53 and 54, 54 and 55, 55 and 56, 56 and 57, 57 and 58, 58 and 59, 59 and 60, 60 and 61, 61 and 62, 62 and 63, 63 and 64, 64 and 65, 65 and 66, 66 and 67, 67 and 68, 68 and 69, 69 and 70, 70 and 71, 71 and 72, 72 and 73, 73 and 74, 74 and 75, 75 and 76, 76 and 77, 77 and 78, 78 and 79, 79 and 80, 80 and 81, 81 and 82, 82 and 83, 83 and 84, 84 and 85, 85 and 86, 86 and 87, 87 and 88, 88 and 89, 89 and 90, 90 and 91, 91 and 92, 92 and 93, 93 and 94, 94 and 95, 95 and 96, 96 and 97, 97 and 98, 98 and 99, 99 and 100, 100 and 101, 101 and 102, 102 and 103, 103 and 104, 104 and 105, 105 and 106, 106 and 107, 107 and 108, 108 and 109, 109 and 110, 110 and 111, 111 and 112, 112 and 113, 113 and 114, 114 and 115, 115 and 116, 116 and 117, 117 and 118, 118 and 119, 119 and 120, 120 and 121, 121 and 122, 122 and 123, 123 and 124, 124 and 125, 125 and 126, 126 and 127, 127 and 128, 128 and 129, 129 and 130, 130 and 131, 131 and 132, 132 and 133, 133 and 134, 134 and 135, 135 and 136, 136 and 137, 137 and 138, 138 and 139, 139 and 140, 140 and 141, 141 and 142, 142 and 143, 143 and 144, 144 and 145, 145 and 146, 146 and 147, 147 and 148, 148 and 149, 149 and 150, 150 and 151, 151 and 152, 152 and 153, 153 and 154, 154 and 155, 155 and 156, 156 and 157, 157 and 158, 158 and 159, 159 and 160, 160 and 161, 161 and 162, 162 and 163, 163 and 164, 164 and 165, 165 and 166, 166 and 167, 167 and 168, 168 and 169, 169 and 170, 170 and 171, 171 and 172, 172 and 173, 173 and 174, 174 and 175, 175 and 176, 176 and 177, 177 and 178, 178 and 179, 179 and 180, 180 and 181, 181 and 182, 182 and 183, 183 and 184, 184 and 185, 185 and 186, 186 and 187, 187 and 188, 188 and 189, 189 and 190, 190 and 191, 191 and 192, 192 and 193, 193 and 194, 194 and 195, 195 and 196, 196 and 197, 197 and 198, 198 and 199, 199 and 200, 200 and 201, 201 and 202, 202 and 203, 203 and 204, 204 and 205, 205 and 206, 206 and 207, 207 and 208, 208 and 209, 209 and 210, 210 and 211, 211 and 212, 212 and 213, 213 and 214, 214 and 215, 215 and 216, 216 and 217, 217 and 218, 218 and 219, 219 and 220, 220 and 221, 221 and 222, 222 and 223, 223 and 224, 224 and 225, 225, and 226, 226 and 227, 227 and 228, 228 and 229, 229 and 230, 230 and 231, 231 and 232, 232 and 233, 233 and 234, 234 and 235, 235 and 236, 236 and 237, 237 and 238, 238 and 239, 239 and 240, 240 and 241, 241 and 242, 242 and 243, 243 and 244, 244 and 245, 245 and 246, 246 and 247, 247 and 248, 248 and 249, 249 and 250, 250 and 251, 251 and 252, 252 and 253, 253 and 254, 254 and 255, 255 and 256, 256 and 257, 257 and 258, 258 and 259, 259 and 260, 260 and 261, 261 and 262, 262 and 263, 263 and 264, 264 and 265, 265 and 266, 266 and 267, 267 and 268, 268 and 269, 269 and 270, 270 and 271, 271 and 272, 272 and 273, 273 and 274, 274 and 275, 275 and 276, 276 and 277, 277 and 278, 278 and 279, 279 and 280, 280 and 281, 281 and 282, 282 and 283, 283 and 284, 284 and 285, 285 and 286, 286 and 287, 287 and 288, 288 and 289, 289 and 290, 290 and 291, 291 and 292, 292 and 293, 293 and 294, 294 and 295, 295 and 296, 296 and 297, 297 and 298, 298 and 299, 299 and 300, 300 and 201, 301 and 302, 302 and 303, 303 and 304, 304 and 305, 305 and 306, 306 and 307, 307 and 308, 308 and 309, 309 and 310, 310 and 311, 311 and 312, 312 and 313, 313 and 314, 314 and 315, 315 and 316, 316 and 317, 317 and 318, 318 and 319, 319 and 320, 320 and 321, 321, and 322, 322 and 323, 323 and 324, 324 and 325, 325, and 326, 326 and 327, 327 and 328, 328 and 329, 329 and 330, 330 and 331, 331 and 332, 332 and 333, 333 and 334, 334 and 335, 335 and 336, 336 and 337, 337 and 338, 338 and 339, 339 and 340, 340 and 341, 341 and 342, 342 and 343, 343 and 344, 344 and 345, 345 and 346, 346 and 347, 347 and 348, 348 and 349, 349 and 350, 350 and 351, 351 and 352, 352 and 353, 353 and 354, 354 and 355, 355 and 356, 356 and 357, 357 and 358, 358 and 359, 359 and 360, 360 and 361, 361 and 362, 362 and 363, 363 and 364, 364 and 365, 365 and 366, 366 and 367, 367 and 368, 368 and 369, 369 and 370, 370 and 371, 371 and 372, 372 and 373, 373 and 374, 374 and 375, 375 and 376, 376 and 377, 377 and 378, 378 and 379, 379 and 380, 380 and 381, 381 and 382, 382 and 383, 383 and 384, 384 and 385, 385 and 386, 386 and 387, 387 and 388, 388 and 389, 389 and 390, 390 and 391, 391 and 392, 392 and 393, 393 and 394, 394 and 395, 395 and 396, 396 and 397, 397 and 398, 398 and 399, 399 and 400, 401 and 402, 402 and 403, 403 and 404, 404 and 405, 405 and 406, 406 and 407, 407 and 408, 408 and 409, 409 and 410, 410 and 411, 411 and 412, 412 and 413, 413 and 414, 414 and 415, 415 and 416, 416 and 417, 417 and 418, 418 and 419, 419 and 420, 420 and 421, 421 and 422, 422 and 423, 423 and 424, 424 and 425, 425 and 426, 426 and 427, 427 and 428, 428 and 429, 429 and 430, 430 and 431, 431 and 432, 432 and 433, 433 and 434, 434 and 435, 435 and 436, 436 and 437, 437 and 438, 438 and 439, 439 and 440, 440 and 441, 441 and 442, 442 and 443, 443 and 444, 444 and 445, 445 and 446, 446 and 447, 447 and 448, 448 and 449, 449 and 450, 450 and 451, 451 and 452, 452 and 453, 453 and 454, 454 and 455, 455 and 456, 456 and 457, 457 and 458, 458 and 459, 459 and 460, 460 and 461, 461 and 462, 462 and 463, 463 and 464, 464 and 465, 465 and 466, 466 and 467, 467 and 468, 468 and 469, 469 and 470, 470 and 471, 471 and 472, 472 and 473, 473 and 474, 474 and 475, 475 and 476, 476 and 477, 477 and 478, 478 and 479, 479 and 480, 480 and 481, 481 and 482, 482 and 483, 483 and 484, 484 and 485, 485 and 486, 486 and 487, 487 and 488, 488 and 489, 489 and 490, 490 and 491, 491 and 492, 492 and 493, 493 and 494, 494 and 495, 495 and 496, 496 and 497, 497 and 498, 498 and 499, 499 and 500, 501 and 502, 502 and 503, 503 and 504, 504 and 505, 505 and 506, 506 and 507, 507 and 508, 508 and 509, 509 and 510, 510 and 511, 511 and 512, 512 and 513, 513 and 514, 514 and 515, 515 and 516, 516 and 517, 517 and 518, 518 and 519, 519 and 520, 520 and 521, 521 and 522, 522 and 523, 523 and 524, 524 and 525, 525 and 526, 526 and 527, 527 and 528, 528 and 529, 529 and 530, 530 and 531, 531 and 532, 532 and 533, 533 and 534, 534 and 535, 535 and 536, 536 and 537, 537 and 538, 538 and 539, 539 and 540, 540 and 541, 541 and 542, 542 and 543, 543 and 544, 544 and 545, 545 and 546, 546 and 547, 547 and 548, 548 and 549, 549 and 550, 550 and 551, 551 and 552, 552 and 553, 553 and 554, 554 and 555, 555 and 556, 556 and 557, 557 and 558, 558 and 559, 559 and 560, 560 and 561, 561 and 562, 562 and 563, 563 and 564, 564 and 565, 565 and 566, 566 and 567, 567 and 568, 568 and 569, 569 and 570, 570 and 571, 571 and 572, 572 and 573, 573 and 574, 574 and 575, 575 and 576, 576 and 577, 577 and 578, 578 and 579, 579 and 580, 580 and 581, 581 and 582, 582 and 583, 583 and 584, 584 and 585, 585 and 586, 586 and 587, 587 and 588, 588 and 589, 589 and 590, 590 and 591, 591 and 592, 592 and 593, 593 and 594, 594 and 595, 595 and 596, 596 and 597, 597 and 598, 598 and 599, 599 and 600, 601 and 602, 602 and 603, 603 and 604, 604 and 605, 605 and 606, 606 and 607, 607 and 608, 608 and 609, 609 and 610, 610 and 611, 611 and 612, 612 and 613, 613 and 614, 614 and 615, 615 and 616, 616 and 617, 617 and 618, 618 and 619, 619 and 620, 620 and 621, 621 and 622, 622 and 623, 623 and 624, 624 and 625, 625 and 626, 626 and 627, 627 and 628, 628 and 629, 629 and 630, 630 and 631, 631 and 632, 632 and 633, 633 and 634, 634 and 635, 635 and 636, 636 and 637, 637 and 638, 638 and 639, 639 and 640, 640 and 641, 641 and 642, 642 and 643, 643 and 644, 644 and 645, 645 and 646, 646 and 647, 647 and 648, 648 and 649, 649 and 650, 650 and 651, 651 and 652, 652 and 653, 653 and 654, 654 and 655, 655 and 656, 656 and 657, 657 and 658, 658 and 659, 659 and 660, 660 and 661, 661 and 662, 662 and 663, 663 and 664, 664 and 665, 665 and 666, 666 and 667, 667 and 668, 668 and 669, 669 and 670, 670 and 671, 671 and 672, 72 and 673, 673 and 674, 674 and 675, 675 and 676, 676 and 677, 677 and 678, 678 and 679, 679 and 680, 680 and 681, 681 and 682, 682 and 683, 683 and 684, 684 and 685, or 685 and 686 of a variant NS3/4A polypeptide (e.g., SEQ ID NO: 36). For example, in preferred embodiments, the chimeric NS3/4A polypeptide encoded by the nucleic acids above can include sequences encoding a TCE, or a TCE flanked on one or both sides by linkers and/or adjuvant sequences, inserted between amino acids 453-513 of SEQ ID NO:36, or in an analogous position in any NS3/4A polypeptide. Embodiments also relate to the polypeptides encoded by said nucleic acids.

Accordingly, in some embodiments a nucleic acid encoding a TCE or a TCE and a linker(s) is inserted between the codons of an NS3/4A-encoding nucleic acid sequence. For example, in some embodiments, a nucleic acid encoding a TCE or a TCE and a linker(s) and/or an adjuvant sequence is inserted between nucleotides 3 and 4, 6 and 7, 9 and 10, 12 and 13, 15 and 16, 18 and 19, 21 and 22, 24 and 25, 27 and 28, 30 and 31, 33 and 34, 36 and 37, 39 and 40, 42 and 43, 45 and 46, 48 and 49, 51 and 52, 54 and 55, 57 and 58, 60 and 61, 63 and 64, 66 and 67, 69 and 70, 72 and 73, 75 and 76, 78 and 79, 81 and 82, 84 and 85, 87 and 88, 90 and 91, 93 and 94, 96 and 97, 99 and 100, 102 and 103, 105 and 106, 108 and 109, 111 and 112, 114 and 115, 117 and 118, 120 and 121, 123 and 124, 126 and 127, 129 and 130, 132 and 133, 125 and 136, 138 and 139, 141 and 142, 144 and 145, 147 and 148, 150 and 151, 153 and 154, 156 and 157, 159 and 160, 162 and 163, 165 and 166, 168 and 169, 171 and 172, 174 and 175, 177 and 178, 180 and 181, 183 and 184, 186 and 187, 189 and 19, 192 and 193, 195 and 196, 198 and 199, 201 and 202, 204 and 205, 207 and 208, 210 and 211, 213 and 214, 216 and 217, 219 and 220, 222 and 223, 225 and 226, 228 and 229, 231 and 232, 234 and 235, 237 and 238, 240 and 241, 243 and 244, 246 and 247, 249 and 250, 252 and 253, 255 and 256, 258 and 259, 261 and 262, 264 and 265, 267 and 268, 270 and 271, 273 and 274, 276 and 277, 279 and 280, 282 and 283, 285 and 286, 288 and 289, 291 and 292, 294 and 295, 297 and 298, 300 and 301, 303 and 304, 306 and 307, 309 and 310, 312 and 313, 315 and 316, 318 and 319, 321 and 322, 324 and 325, 327 and 328, 330 and 331, 333 and 334, 336 and 337, 339 and 340, 342 and 343, 345 and 346, 348 and 349, 351 and 352, 354 and 355, 357 and 358, 360 and 361, 363 and 364, 366 and 367, 369 and 370, 372 and 373, 375 and 376, 378 and 379, 381 and 382, 24 and 385, 387 and 388, 390 and 391, 393 and 394, 396 and 397, 399 and 400, 402 and 403, 405 and 406, 408 and 409, 411 and 412, 414 and 415, 417 and 418, 420 and 421, 423 and 424, 426 and 427, 429 and 430, 432 and 433, 435 and 436, 438 and 439, 441 and 442, 444 and 445, 447 and 448, 450 and 451, 453 and 454, 456 and 457, 459 and 460, 462 and 463, 465 and 466, 468 and 469, 471 and 472, 474 and 475, 477 and 478, 480 and 481, 483 and 484, 486 and 487, 489 and 490, 492 and 493, 495 and 496, 498 and 499, 501 and 502, 504 and 505, 507 and 508, 510 and 511, 513 and 514, 516 and 517, 519 and 520, 522 and 523, 525 and 526, 528 and 529, 531 and 532, 534 and 535, 537 and 538, 540 and 541, 543 and 544, 546 and 547, 549 and 550, 552 and 553, 555 and 556, 558 and 559, 561 and 562, 564 and 565, 567 and 568, 570 and 571, 573 and 574, 576 and 577, 579 and 580, 582 and 583, 585 and 586, 588 and 589, 591 and 592, 594 and 595, 597 and 598, 600 and 601, 603 and 604, 606 and 607, 609 and 610, 612 and 613, 615 and 616, 618 and 619, 621 and 622, 624 and 625, 627 and 628, 630 and 631, 633 and 634, 636 and 637, 639 and 640, 642 and 643, 645 and 646, 648 and 649, 651 and 652, 654 and 655, 657 and 658, 660 and 661, 663 and 664, 666 and 667, 669 and 670, 672 and 673, 675 and 676, 678 and 679, 681 and 682, 684 and 685, 687 and 688, 690 and 691, 693 and 694, 696 and 697, 699 and 700, 702 and 703, 705 and 706, 708 and 709, 711 and 712, 714 and 715, 717 and 718, 720 and 721, 723 and 724, 726 and 727, 729 and 730, 732 and 733, 735 and 736, 738 and 739, 741 and 742, 744 and 745, 747 and 748, 750 and 751, 753 and 754, 756 and 757, 759 and 760, 762 and 763, 765 and 766, 768 and 769, 771 and 772, 774 and 775, 777 and 778, 780 and 781, 783 and 784, 786 and 787, 789 and 790, 792 and 793, 795 and 796, 798 and 799, 801 and 802, 804 and 805, 807 and 808, 810 and 811, 813 and 814, 816 and 817, 819 and 820, 822 and 823, 825 and 826, 828 and 829, 831 and 832, 834 and 835, 837 and 838, 840 and 841, 843 and 844, 846 and 847, 849 and 850, 852 and 853, 855 and 856, 858 and 859, 861 and 862, 864 and 865, 867 and 868, 870 and 871, 873 and 874, 876 and 877, 879 and 880, 882 and 883, 885 and 886, 888 and 889, 891 and 892, 894 and 895, 897 and 898, 900 and 901, 903 and 904, 906 and 907, 909 and 910, 912 and 913, 915 and 916, 918 and 919, 921 and 922, 924 and 925, 927 and 928, 930 and 931, 933 and 934, 936 and 937, 939 and 940, 942 and 943, 945 and 946, 948 and 949, 951 and 952, 954 and 955, 957 and 958, 960 and 961, 963 and 964, 966 and 967, 969 and 970, 972 and 973, 975 and 976, 978 and 979, 981 and 982, 984 and 985, 987 and 988, 990 and 991, 993 and 994, 996 and 997, 999 and 1000, 1002 and 1003, 1005 and 1006, 1008 and 1009, 1011 and 1012, 1014 and 1015, 1017 and 1018, 1020 and 1021, 1023 and 1024, 1026 and 1027, 1029 and 1030, 1032 and 1033, 1025 and 1036, 1038 and 1039, 1041 and 1042, 1044 and 1045, 1047 and 1048, 1050 and 1051, 1053 and 1054, 1056 and 1057, 1059 and 1060, 1062 and 1063, 1065 and 1066, 1068 and 1069, 1071 and 1072, 1074 and 1075, 1077 and 1078, 1080 and 1081, 1083 and 1084, 1086 and 1087, 1089 and 1090, 1092 and 1093, 1095 and 1096, 1098 and 1099, 1101 and 1102, 1104 and 1105, 1107 and 1108, 1110 and 1111, 1113 and 1114, 1116 and 1117, 1119 and 1120, 1122 and 1123, 1125 and 1126, 1128 and 1129, 1131 and 1132, 1134 and 1135, 1137 and 1138, 1140 and 1141, 1143 and 1144, 1146 and 1147, 1149 and 1150, 1152 and 1153, 1155 and 1156, 1158 and 1159, 1161 and 1162, 1164 and 1165, 1167 and 1168, 1170 and 1171, 1173 and 1174, 1176 and 1177, 1179 and 1180, 1182 and 1183, 1185 and 1186, 1188 and 1189, 1191 and 1192, 1194 and 1195, 1197 and 1198, 1200 and 1201, 1203 and 1204, 1206 and 1207, 1209 and 1210, 1212 and 1213, 1215 and 1216, 1218 and 1219, 1221 and 1222, 1224 and 1225, 1227 and 1228, 1230 and 1231, 1233 and 1234, 1236 and 1237, 1239 and 1240, 1242 and 1243, 1245 and 1246, 248 and 1249, 1251 and 1252, 1254 and 1255, 1257 and 1258, 1260 and 1261, 1263 and 1264, 1266 and 1267, 1269 and 1270, 1272 and 1273, 1275 and 1276, 1278 and 1279, 1281 and 1282, 1284 and 1285, 1287 and 1288, 1290 and 1291, 1293 and 1294, 1296 and 1297, 1299 and 1300, 1302 and 1303, 1305 and 1306, 1308 and 1309, 1311 and 1312, 1314 and 1315, 1317 and 1318, 1320 and 1321, 1323 and 1324, 1326 and 1327, 1329 and 1330, 1332 and 1333, 1335 and 1336, 1338 and 1339, 1341 and 1342, 1344 and 1345, 1347 and 1348, 1350 and 1351, 1353 and 1354, 1356 and 1357, 1359 and 1360, 1362 and 1363, 1365 and 1366, 1368 and 1369, 1371 and 1372, 1374 and 1375, 1377 and 1378, 1380 and 1381, 1383 and 1384, 1386 and 1387, 1389 and 1390, 1392 and 1393, 1395 and 1396, 1398 and 1399, 1401 and 1402, 1404 and 1405, 1407 and 1408, 1410 and 1411, 1413 and 1414, 1416 and 1417, 1419 and 1420, 1422 and 1423, 1425 and 1426, 1428 and 1429, 1431 and 1432, 1434 and 1435, 1437 and 1438, 1440 and 1441, 1443 and 1444, 1446 and 1447, 1449 and 1450, 1452 and 1453, 1455 and 1456, 1458 and 1459, 1461 and 1462, 1464 and 1465, 1467 and 1468, 1470 and 1471, 1473 and 1474, 1476 and 1477, 1479 and 1480, 1482 and 1483, 1485 and 1486, 1488 and 1489, 1491 and 1492, 1494 and 1495, 1497 and 1498, 1500 and 1501, 1503 and 1504, 1506 and 1507, 1509 and 1510, 1512 and 1513, 1515 and 1516, 1518 and 1519, 1521 and 1522, 1524 and 1525, 1527 and 1528, 1530 and 1531, 1533 and 1534, 1536 and 1537, 1539 and 1540, 1542 and 1543, 1545 and 1546, 1548 and 1549, 1551 and 1552, 1554 and 1555, 1557 and 1558, 1560 and 1561, 1563 and 1564, 1566 and 1567, 1569 and 1570, 1572 and 1573, 1575 and 1576, 1578 and 1579, 1581 and 1582, 1584 and 15685, 1587 and 1588, 1590 and 1591, 1593 and 1594, 1596 and 1597, 1599 and 1600, 1602 and 1603, 1605 and 1606, 1608 and 1609, 1611 and 1612, 1614 and 1615, 1617 and 1618, 1620 and 1621, 1623 and 1624, 1626 and 1627, 1629 and 1630, 1632 and 1633, 1635 and 1636, 1638 and 1639, 1641 and 1642, 1644 and 1645, 1647 and 1648, 1650 and 1651, 1653 and 1654, 1656 and 1657, 1659 and 1660, 1662 and 1663, 1665 and 1666, 1668 and 1669, 1671 and 1672, 1674 and 1675, 1677 and 1678, 1680 and 1681, 1683 and 1684, 1686 and 1687, 1689 and 1690, 1692 and 1693, 1695 and 1696, 1698 and 1699, 1701 and 1702, 1704 and 1705, 1707 and 1708, 1710 and 1711, 1713 and 1714, 1716 and 1717, 1719 and 1720, 1722 and 1723, 1725 and 1726, 1728 and 1729, 1731 and 1732, 1734 and 1735, 1737 and 1738, 1740 and 1741, 1743 and 1744, 1746 and 1747, 1749 and 1750, 1752 and 1753, 1755 and 1756, 1758 and 1759, 1761 and 1762, 1764 and 1765, 1767 and 1768, 1770 and 1771, 1773 and 1774, 1776 and 1777, 1779 and 1780, 1782 and 1783, 1785 and 1786, 1788 and 1789, 1791 and 1792, 1794 and 1795, 1797 and 1798, 1800 and 1801, 1803 and 1804, 1806 and 1807, 1809 and 1810, 1812 and 1813, 1815 and 1816, 1818 and 1819, 1821 and 1822, 1824 and 1825, 1827 and 1828, 1830 and 1831, 1833 and 1834, 1836 and 1837, 1839 and 1840, 1842 and 1843, 1845 and 1846, 1848 and 1849, 1851 and 1852, 1854 and 1855, 1857 and 1858, 1860 and 1861, 1863 and 1864, 1866 and 1867, 1869 and 1870, 1872 and 1873, 1875 and 1876, 1878 and 1879, 1881 and 1882, 1884 and 1885, 1887 and 1888, 1890 and 1891, 1893 and 1894, 1896 and 1897, 1899 and 1900, 1902 and 1903, 1905 and 1906, 1908 and 1909, 1911 and 1912, 1914 and 1915, 1917 and 1918, 1920 and 1921, 1923 and 1924, 1926 and 1927, 1929 and 1930, 1932 and 1933, 1925 and 1936, 1938 and 1939, 1941 and 1942, 1944 and 1945, 1947 and 1948, 1950 and 1951, 1953 and 1954, 1956 and 157, 1959 and 1960, 1962 and 1963, 1965 and 1966, 1968 and 1969, 1971 and 1972, 1974 and 175, 1977 and 1978, 1980 and 1981, 1983 and 1984, 1986 and 1987, 1989 and 1999, 1992 and 1993, 1995 and 1996, 1998 and 1999, 2001 and 2002, 2004 and 2005, 2007 and 2008, 2010 and 2011, 2013 and 2014, 2016 and 2017, 2019 and 2020, 2022 and 2023, 2025 and 2026, 2028 and 2029, 2031 and 2032, 2034 and 2035, 2037 and 2038, 2040 and 2041, 2043 and 2044, 2046 and 2047, 2049 and 2050, 2052 and 2053, 2055 and 2056, or 2058 and 2059 of an NS3/4A nucleic acid sequence such as SEQ ID NO: 1, or between any of the codons of a nucleic acid sequence encoding an NS3/4A variant (e.g., SEQ ID NO: 35). For example, in some embodiments, a nucleic acid encoding a TCE or a TCE and a linker(s) and/or an adjuvant sequence is inserted between nucleotides 1370 and 1548 of SEQ ID NO:35, or in an analogous position in any NS3/4A nucleic acid. Embodiments also relate to polypeptides encoded by said nucleic acids.

In some embodiments, the nucleic acid sequences encoding the TCE or TCE and linker and/or adjuvant sequence portion of the chimeric NS3/4A polypeptide can be juxtaposed to the 5' end of the NS3/4A sequences, and encoding a chimeric NS3/4A polypeptide with a TCE or TCE and linker(s) and/or adjuvant sequence on the N-terminal end of the NS3/4A polypeptide. In some embodiments, the nucleic acid sequences encoding the TCE or TCE and linker(s) and/or adjuvant sequence polypeptide can be flanking (e.g., juxtaposed to) the 3' end of the NS3/4A sequences and encode a chimeric NS3/4A polypeptides with a TCE or TCE and linker(s) and/or adjuvant sequence on the C-terminal end of the NS3/4A polypeptide. In embodiments in which the chimeric NS3/4A polypeptide comprises more than one TCE or TCE and linker(s) and/or adjuvant sequence, the nucleic acids encoding the TCEs can be located different positions relative to the nucleic acids encoding the NS3/4A sequences (i.e., 5', within, or 3') and relative to each other. Optionally, NS3/4A variants include a substitution of at least one amino acid with any other amino acid in one or more of the domains of a different NS3/NS4A sequences. Embodiments also relate to polypeptides encoded by said nucleic acid sequences.

The skilled artisan will readily appreciate that a variety of techniques can be used to generate variants, such as the generation of insertions of desired sequences (e.g. TCEs and linkers) within NS3/4A nucleic acid and polypeptide sequences described herein. For example, overlapping PCR can be used to generate desired substitutions or insertions (e.g., a nucleic acid encoding a TCE, and/or linker sequences) within the NS3/4A sequences, or at the 3' or 5' ends of the NS3/4A sequences. (See, e.g. Ho et al. (1989), Gene 77(1): 51-9). Several commercially available kits are also available to facilitate site-directed mutagenesis, to facilitate the generation of NS3/4A variants, such as the recombinant nucleic acids and encoded polypeptides disclosed herein. An exemplary commercially available kit useful for generating chimeric NS3/4A polypeptides and chimeric NS3/4A polypeptide variants is the QUICKCHANGE® site directed mutagenesis kit (Stratagene, La Jolla, Calif.).

In preferred embodiments, the catalytic activity (e.g., the protease or helicase activity) of a chimeric NS3/4A or chimeric NS3/4A variant may be enhanced or unchanged, relative to the native polypeptide, or may be diminished by less than 50%, and preferably less than 20% relative to the native polypeptide. In some embodiments the protease activity of an NS3/4A chimeric polypeptide or chimeric polypeptide variant is diminished by less than 30%, 25%, 20%, 19%, 18%, 17%, 16%, 15%, 10%, 9%, 8%, 7%, 6%, 5%, 4%, 3%, 2%, 1%, or 0.5%, relative to the native polypeptide. In some embodiments the protease activity of an NS3/4A variant may be enhanced by at least 30%, 25%, 20%, 19%, 18%, 17%, 16%, 15%, 10%, 9%, 8%, 7%, 6%, 5%, 4%, 3%, 2%, 1%, or 0.5%, relative to the native polypeptide. Exemplary NS3/4A variants with altered protease activity are discussed in further detail herein.

In preferred embodiments, the NS3/4A chimeric polypeptide retains protease activity. Accordingly, in some embodiments, the nucleic acids encoding the chimeric NS3/4A polypeptide encode or the chimeric NS3/4A polypeptides comprise the native amino acid sequence at the following positions of the NS3/4A sequence: Leu44, Ile48, Trp53, His57, Asp81, Trp85, Ala91, Leu94, Cys97, Cys99, Leu106, Thr108, Arg123, Gly124, Leu126, Ser139, Gly140, Leu143, Leu144, Cys145, His149, Ile153, Phe169, and Leu175. That is, the aforementioned residues are unchanged in some embodiments or, in some embodiments, the nucleic acids encoding TCEs or TCEs and linkers and/or adjuvant sequence are not substituted for, inserted within, or inserted at positions adjacent to nucleic acid sequences encoding the following amino acids of NS3/4A sequences: Leu44, Ile48, Trp53, His57, Asp81, Trp85, Ala91, Leu94, Cys97, Cys99, Leu106, Thr108, Arg123, Gly124, Leu126, Ser139, Gly140, Leu143, Leu144, Cys145, His149, Ile153, Phe169, and Leu175.

In some embodiments, the chimeric NS3/4A variants exhibit enhanced protease activity. Embodiments disclosed herein provide NS3/4A chimeric polypeptides including one or more of the following amino acid substitutions in the NS3/4A sequence: Tyr6Ala, Arg11Ala, Leu13Ala, Leu14Ala, Glu30Ala, Cys52Ala, Gly58Ala, Ala59Gly, Ile64Ala, Ile64Ala, Gln73Ala, Thr76Ala, Pro86Ala, Ala111Gly, Gly 122Ala, Tyr 134Ala, Lys 136Ala, Gly 141Ala, Val158Ala, Arg161Ala, Ala166Gly, or Thr177Ala. That is, in some embodiments one or more of the following amino acid substitutions are included: Tyr6Ala, Arg11Ala, Leu13Ala, Leu14Ala, Glu30Ala, Cys52Ala, Gly58Ala, Ala59Gly, Ile64Ala, Ile64Ala, Gln73Ala, Thr76Ala, Pro86Ala, Ala111Gly, Gly 122Ala, Tyr 134Ala, Lys 136Ala, Gly 141Ala, Val158Ala, Arg161Ala, Ala166Gly, or Thr177Ala.

In some embodiments, NS3/4A variant sequences used in the embodiments disclosed herein lack a proteolytic cleavage site, such as SEQ. ID. NOs.: 14 and 16-26. In some embodiments, fragments of the NS3/4A variant sequences containing any number of consecutive amino acids between at least 3-300 amino acids (e.g., 3, 4, 6, 8, 10, 12, 15, 20, 25, 30, 35, 40, 45, 50, 75, 100, 150, 200, 250, or 300 consecutive amino acids) of any one of SEQ. ID. NOs.: 14 and 16-26 are used in the embodiments disclosed herein. Other exemplary NS3/4A variants with altered protease activity may generally be identified by modifying one or more of the above nucleic acid or polypeptide sequences and evaluating the protease activity of the variant, as discussed in further detail in Example 1.

In some embodiments, the helicase activity of a NS3/4A variant is diminished by less than 30%, 25%, 20%, 19%, 18%, 17%, 16%, 15%, 10%, 9%, 8%, 7%, 6%, 5%, 4%, 3%, 2%, 1%, or 0.5%, relative to the native polypeptide. In some embodiments the helicase activity of an NS3/4A variant may be enhanced by at least 30%, 25%, 20%, 19%, 18%, 17%, 16%, 15%, 10%, 9%, 8%, 7%, 6%, 5%, 4%, 3%, 2%, 1%, or 0.5%, relative to the native polypeptide. Such variants may generally be identified by modifying one of the above polypeptide sequences and evaluating the helicase activity as described herein Guidance in determining the identity of amino acids that may affect NS3 helicase activity can be found by comparing the sequence of the NS3 helicase domain with that of homologous known protein molecules and minimizing the number of amino acid sequence changes made in regions of high homology. An exemplary assay for testing variants for helicase activity is discussed in Artsaenko O, et al., (2003) J Gen Virol. 2003 84(Pt 9):2323-32, and Zhang et al., (2005) J Virol. 79(14):8687-97; and Kyono et al., (2004) Biochem (Tokyo) 135(2):245-52.

Optionally, chimeric NS3/4A variants can encode or comprise amino acid substitutions, wherein one amino acid is substituted with another amino acid having similar structural and/or chemical properties (e.g., conservative amino acid replacements). A list of conservative amino acid substitutions can be found in Table 1.

TABLE 1

| Original Residue | Exemplary Substitutions | Preferred Substitutions |
|---|---|---|
| Ala (A) | val; leu; ile | val |
| Arg (R) | lys; gln; asn | lys |
| Asn (N) | gln; his; lys; arg | gln |
| Asp (D) | glu | glu |
| Cys (C) | ser | ser |
| Gln (Q) | asn | asn |
| Glu (E) | asp | asp |
| Gly (G) | pro; ala | ala |
| His (H) | asn; gln; lys; arg | arg |
| Ile (I) | leu; val; met; ala; phe; norleucine | leu |
| Leu (L) | norleucine; ile; val; met; ala; phe | ile |
| Lys (K) | arg; gln; asn | arg |
| Met (M) | leu; phe; ile | leu |
| Phe (F) | leu; val; ile; ala; tyr | leu |
| Pro (P) | ala | ala |
| Ser (S) | thr | thr |
| Thr (T) | ser | ser |
| Trp (W) | tyr; phe | tyr |
| Tyr (Y) | trp; phe; thr; ser | phe |
| Val (V) | ile; leu; met; phe; ala; norleucine | leu |

In some embodiments, variant NS3/4A sequences are engineered or optimized for codons most frequently used in humans. The nucleic acid sequence of an exemplary codon-optimized NS3/4A nucleic acid sequence (coNS3/4A) is provided in SEQ. ID. NO.:35. The peptide encoded by said nucleic acid sequence is provided in SEQ. ID. NO.: 36. The skilled artisan will appreciate, however, that any HCV NS3/4A sequences disclosed herein or discovered in the future can be used to generate codon-optimized variants and that all codon-optimized variants are within the scope of the present invention.

The nucleic acid and corresponding NS3/4A peptide (SEQ ID NOs: 35 and 36) do not correspond to any known HCV sequence or genome. The codon-optimized NS3/4A encoding nucleic acid was found to be only 79% homologous, within the region of nucleotide positions 3417-5475, to HCV-1 and contained a total of 433 different nucleotides. The NS3/4A peptide encoded by the codon-optimized nucleic acid sequence is only 98% homologous to HCV-1 and contained a total of 15 different amino acids. As demonstrated in Example 2, below, the codon optimized nucleic acid was found to generate a higher expression level of NS3 and was found to be more immunogenic, with respect to both humoral and cellular responses, as compared to the native NS3/4A gene from which it was derived. Accordingly, in preferred embodiments, the NS3/4A nucleic acid sequences encoding, or the encoded polypeptide sequences of the NS3/4A chimeric polypeptides comprise codon-optimized nucleic acid and polypeptide sequences of native HCV sequences. For example, in some embodiments, the NS3/4A nucleic acid sequences or encoded polypeptide sequences of an NS3/4A chimeric polypeptides comprises SEQ ID NO: 35 or SEQ ID NO: 36, or fragments thereof, or variants thereof and TCEs and/or linker sequences.

EXAMPLE 2

The sequence of the unique NS3/4A gene described in Example 1 (SEQ. ID. NO.: 1) was analyzed for codon usage with respect to the most commonly used codons in human cells. A total of 435 nucleotides were replaced to optimize codon usage for human cells. The sequence was sent to Retrogen Inc. (6645 Nancy Ridge Drive, San Diego, Calif. 92121) and they were provided with instructions to generate a full-length synthetic codon optimized NS3/4A gene. The codon optimized NS3/4A gene had a sequence homology of 79% within the region between nucleotide positions 3417-5475 of the HCV-1 reference strain. A total of 433 nucleotides differed. On an amino acid level, the homology with the HCV-1 strain was 98% and a total of 15 amino acids differed.

The full length codon optimized 2.1 kb DNA fragment of the HCV corresponding to the amino acids 1007 to 1711 encompassing the NS3 and NS4A NS3/4A gene fragment was amplified by the polymerase chain reaction (PCR) using high fidelity polymerase (Expand High Fidelity PCR, Boehringer-Mannheim, Mannheim, Germany). The amplicon was then inserted into a Bam HI and Xba I digested pVAX vector (Invitrogen, San Diego), which generated the MSLF1-pVAX (coNS3/4A-pVAX) plasmid. All expression constructs were sequenced. Plasmids were grown in competent BL21 *E. Coli*. The plasmid DNA used for in vivo injection was purified using Qiagen DNA purification columns, according to the manufacturers instructions (Qiagen GmbH, Hilden, FRG). The concentration of the resulting plasmid DNA was determined spectrophotometrically (Dynaquant, Pharmacia Biotech, Uppsala, Sweden) and the purified DNA was dissolved in sterile phosphate buffer saline (PBS) at concentrations of 1 mg/ml.

The expression of NS3 and NS3/4A proteins from the wtNS3/4A (wild-type NS3/4A) and coNS3/4A plasmids, were analyzed by an in vitro transcription and translation assay. The assay showed that the proteins could be correctly translated from the plasmids and that the coNS3/4A plasmid gave detectable NS3 and NS3/4A bands at a higher plasmid dilution as compared to the wtNS3/4A plasmid. This result provided strong evidence that the in vitro translation from the coNS3/4A plasmid is more effective than wtNS3/4A. To compare the expression levels more precisely, HepG2 cells were transiently transfected with the wtNS3/4A and the coNS3/4A plasmids. These experiments revealed that the coNS3/4A plasmid generated 11-fold higher expression levels of the NS3 protein when compared to the wtNS3/4A plasmid, as determined by densitometry and a standard curve of recombinant NS3. Since the wtNS3/4A and the coNS3/4A plasmids are identical in size it is unlikely that there would be any major differences in transfections efficiencies between the plasmids. Staining of coNS3/4A plasmid transfected, and SFV infected, BHK cells revealed a similar perinuclear and cytoplasmic distribution of the NS3 as previously observed, confirming an unchanged subcellular localization.

TABLE 2 describes the sequence of the proteolytic cleavage site of NS3/4A, referred to as the breakpoint between NS3 and NS4A. This wild-type breakpoint sequence was mutated in many different ways so as to generate several different NS3/4A breakpoint mutants. TABLE 2 also identifies these mutant breakpoint sequences. The fragments listed in TABLE 2 are preferred immunogens that can be incorporated with or without an adjuvant (e.g., ribavirin) into a composition for administration to an animal so as to induce an immune response in said animal to HCV.

TABLE 2

| Plasmid | Deduced amino acid sequence | SEQ ID |
|---|---|---|
| NS3/4A-pVAX | TKYMTCMSADLEVV<u>TST</u>WVLVGGVL | 14 |
| NS3/4A-TGT-pVAX | TKYMTCMSADLEVV<u>TGT</u>WVLVGGVL | 16 |
| NS3/4A-RGT-pVAX | TKYMTCMSADLEVV<u>RGT</u>WVLVGGVL | 17 |
| NS3/4A-TPT-pVAX | TKYMTCMSADLEVV<u>TPT</u>WVLVGGVL | 18 |
| NS3/4A-RPT-pVAX | TKYMTCMSADLEVV<u>RPT</u>WVLVGGVL | 19 |
| NS3/4A-RPA-pVAX | TKYMTCMSADLEVV<u>RPA</u>WVLVGGVL | 20 |
| NS3/4A-CST-pVAX | TKYMTCMSADLEVV<u>CST</u>WVLVGGVL | 21 |
| NS3/4A-CCST-pVAX | TKYMTCMSADLEVC<u>CST</u>WVLVGGVL | 22 |
| NS3/4A-SSST-pVAX | TKYMTCMSADLEVS<u>SST</u>WVLVGGVL | 23 |
| NS3/4A-SSSSCST-pVAX | TKYMTCMSADSSSS<u>CST</u>WVLVGGVL | 24 |
| NS3A/4A-VVVVTST-pVAX | TKYMTCMSADVVVV<u>TST</u>WVLVGGVL | 25 |
| NS5-pVAX | ASEDVVC<u>CSM</u>SYTWTG | 27 |
| NS5A/B-pVAX | SSEDVVC<u>CSM</u>WVLVGGVL | 26 |

*The wild type sequence for the NS3/4A fragment is NS3/4A-pVAX. The NS3/4A breakpoint is identified by underline, wherein the P1 position corresponds to the first Thr (T) and the P1' position corresponds to the next following amino acid the NS3/4A-pVAX sequence. In the wild type NS3/4A sequence the NS3 protease cleaves between the P1 and P1' positions.

To change the proteolytic cleavage site between NS3 and NS4A, the NS3/4A-pVAX plasmid was mutagenized using the QUICKCHANGE™ mutagenesis kit (Stratagene), following the manufacturer's recommendations. To generate the "TPT" mutation, for example, the plasmid was amplified using the primers 5'-CTGGAGGTCGTCACGCCTAC-CTGGGTGCTCGTT-3' (SEQ. ID. NO.: 31) and 5'-AC-CGAGCACCCAGGTAGGCGTGACGACCTCCAG-3' (SEQ. ID. NO.: 32) resulting in NS3/4A-TPT-pVAX. To generate the "RGT" mutation, for example, the plasmid was amplified using the primers 5'-CTGGAGGTCGTCCGCGG-TACCTGGGTGCTCGTT-3' (SEQ. ID. NO.: 33) and 5'-AC-CGAGCACCCAGGTACC-GCGGACGACCTCCAG-3' (SEQ. ID. NO.: 34) resulting in NS3/4A-RGT-pVAX. All mutagenized constructs were sequenced to verify that the mutations had been correctly made. Plasmids were grown in competent BL21 *E. coli*.

On an amino acid level, the homology with the HCV-1 strain was 98% and a total of 15 amino acids differed. The nucleic acid sequence of the codon-optimized NS3/4a is provided in SEQ ID NO: 35, whereas the peptide encoded by said nucleic acid sequence is provided in SEQ ID NO:36. The full length codon optimized 2.1 kb DNA fragment of the HCV corresponding to the amino acids 1007 to 1711 encompassing the NS3 and NS4A NS3/4A gene fragment was amplified by the polymerase chain reaction (PCR) using high fidelity polymerase (Expand High Fidelity PCR, Boehringer-Mannheim, Mannheim, Germany). The amplicon was then inserted into a Bam HI and Xba I digested pVAX vector (Invitrogen, San Diego), which generated the MSLF1-pVAX (coNS3/4A-pVAX) plasmid. All expression constructs were sequenced. Plasmids were grown in competent BL21 *E. Coli*. The plasmid DNA used for in vivo injection was purified using Qiagen DNA purification columns, according to the manufacturers instructions (Qiagen GmbH, Hilden, FRG). The concentration of the resulting plasmid DNA was determined spectrophotometrically (Dynaquant, Pharmacia Biotech, Uppsala, Sweden) and the purified DNA was dissolved in sterile phosphate buffer saline (PBS) at concentrations of 1 mg/ml.

The expression of NS3 and NS3/4A proteins from the wtNS3/4A (wild-type NS3/4A) and coNS3/4A plasmids, were analyzed by an in vitro transcription and translation assay. The assay showed that the proteins could be correctly translated from the plasmids and that the coNS3/4A plasmid gave detectable NS3 and NS3/4A bands at a higher plasmid dilution as compared to the wtNS3/4A plasmid. This result provided strong evidence that the in vitro translation from the coNS3/4A plasmid is more effective than wtNS3/4A. To compare the expression levels more precisely, HepG2 cells were transiently transfected with the wtNS3/4A and the coNS3/4A plasmids. These experiments revealed that the coNS3/4A plasmid generated 11-fold higher expression levels of the NS3 protein when compared to the wtNS3/4A plasmid, as determined by densitometry and a standard curve of recombinant NS3. Since the wtNS3/4A and the coNS3/4A plasmids are identical in size it is unlikely that there would be any major differences in transfections efficiencies between the plasmids. Staining of coNS3/4A plasmid transfected, and SFV infected, BHK cells revealed a similar perinuclear and cytoplasmic distribution of the NS3 as previously observed, confirming an unchanged subcellular localization.

Several nucleic acid embodiments include nucleotides encoding the HCV peptides described herein (SEQ. ID. NOs.: 2-11 or SEQ. ID. NO.: 36) or a fragment thereof (e.g., SEQ. ID. NOs.: 14 and 15) containing any number of consecutive amino acids between at least 3-50 (e.g., 3, 4, 6, 8, 10, 12, 15, 20, 25, 30, 35, 40, 45, or 50 amino acids in length). Some embodiments for example, include genomic DNA, RNA, and cDNA encoding these HCV peptides. The HCV nucleotide embodiments not only include the DNA sequences shown in the sequence listing (e.g., SEQ. ID. NO.: 1 or SEQ. ID. NO.: 35) but also include nucleotide sequences encoding the amino acid sequences shown in the sequence listing (e.g., SEQ. ID. NOs.: 2-11 or SEQ. ID. NO.: 36) and any nucleotide sequence that hybridizes to the DNA sequences shown in the sequence listing under stringent conditions (e.g., hybridization to filter-bound DNA in 0.5 M $NaHPO_4$, 7.0% sodium dodecyl sulfate (SDS), 1 mM EDTA at 50° C.) and washing in 0.2×SSC/0.2% SDS at 50° C. and any nucleotide sequence that hybridizes to the DNA sequences that encode an amino acid sequence provided in the sequence listing (SEQ. ID. NOs.: 2-11 or SEQ. ID. NO.: 36) under less stringent conditions (e.g., hybridization in 0.5 M $NaHPO_4$, 7.0% sodium dodecyl sulfate (SDS), 1 mM EDTA at 37° C. and washing in 0.2×SSC/0.2% SDS at 37° C.).

The nucleic acid embodiments of the invention also include fragments, modifications, derivatives, and variants of the sequences described above. Desired embodiments, for example, include nucleic acids having at least 25 consecutive bases of one of the novel HCV sequences or a sequence complementary thereto and preferred fragments include at least 25 consecutive bases of a nucleic acid encoding the NS3/4A molecule of SEQ. ID. NO.: 2 or SEQ. ID. NO.: 36 or a mutant NS3/4A molecule of SEQ. ID. NOs.: 3-13 or a sequence complementary thereto.

In this regard, the nucleic acid embodiments described herein can have any number of consecutive nucleotides between about 12 to approximately 2112 consecutive nucleotides of SEQ. ID. NO.: 1 or SEQ. ID. NO.: 35. Some DNA fragments, for example, include nucleic acids having at least 12-15, 15-20, 20-30, 30-50, 50-100, 100-200, 200-500, 500-1000, 1000-1500, 1500-2079, or 1500-2112 consecutive nucleotides of SEQ. ID. NO.: 1 or SEQ. ID. NO.: 35 or a complement thereof. These nucleic acid embodiments can also be altered by substitution, addition, or deletion so long as the alteration does not significantly affect the structure or function (e.g., ability to serve as an immunogen) of the HCV nucleic acid. Due to the degeneracy of nucleotide coding sequences, for example, other DNA sequences that encode substantially the same HCV amino acid sequence as depicted in SEQ. ID. NOs.: 2-13 or SEQ. ID. NO.: 36 can be used in some embodiments. These include, but are not limited to, nucleic acid sequences encoding all or portions of HCV peptides (SEQ. ID. NOs.: 2-13) or nucleic acids that complement all or part of this sequence that have been altered by the substitution of different codons that encode a functionally equivalent amino acid residue within the sequence, thus producing a silent change, or a functionally non-equivalent amino acid residue within the sequence, thus producing a detectable change. Accordingly, the nucleic acid embodiments of the invention are said to be comprising, consisting of, or consisting essentially of nucleic acids encoding any one of SEQ. ID. NOs.: 2-27 or SEQ. ID. NO.: 36 in light of the modifications above.

In some embodiments, the HCV NS3/4A sequences comprise, consist essentially of, or consist of NS3 and or NS4A sequences that encode fragments, or functional fragments of the full-length NS3/4A polypeptide. Such fragments may be truncated at the N-terminus or C-terminus, or may lack internal residues, for example, when compared with a full length native protein. In preferred embodiments, NS3/4A fragments lack amino acid residues that are not essential for the catalytic activity of the NS3 polypeptide. For example, in some embodiments the NS3/4A sequences can comprise, consist, or consist essentially of fragments of any of SEQ ID NOs: 1, 35, and 572-808 encoding any number of consecutive amino acids (e.g., 3, 4, 6, 8, 10, 12, 15, 20, 25, 30, 35, 40, 45, 50, 75, 100, 150, 200, 250, or 300 consecutive amino acids). The section below describes several antigens that can be used in the compositions and methods described herein.

Epitopes

The chimeric NS3/4A nucleic acids and polypeptides disclosed herein include sequences comprising antigens, such as TCEs, positioned at non-naturally occurring locations, either within and/or flanking (e.g., juxtaposed to) NS3/4A sequences. As used herein, the term epitope refers to a set of amino acid residues that are involved in recognition by a particular immunoglobulin (i.e., a B cell epitope or "BCE") or in the context of TCE, those residues necessary for recognition by T cell receptor proteins and/or Major Histocompatability Complex (MHC) receptors. In an immune system setting, in vivo or in vitro, an epitope is the collective features of a molecule, such as primary, secondary, and tertiary peptide structure, and charge, that together form a site recognized by an immunoglobulin, T cell receptor, or HLA molecule. TCEs are recognized by either CD4+ T cells, or helper T lymphocytes ("HTLs") or CD8+ T cells, or cytotoxic T lymphocytes ("CTLs").

TCEs generally comprise a chain of at least four amino acid residues, preferably at least six, more preferably eight to ten, sometimes eleven to fourteen residues, and usually fewer than about thirty residues, more usually fewer than about twenty-five, and preferably fewer than fifteen, e.g., eight to fourteen amino acid residues derived from selected epitopic regions of the target antigen(s). It is to be appreciated, however, that TCE nucleic acids, or TCE amino acid sequences can refer to nucleic acids encoding or protein or peptide molecules, larger than and comprising an epitope of the invention are still within the scope of the invention. For example, nucleic acid and polypeptide sequences of full length proteins that contain at least one TCE, that are capable of producing an immune response are contemplated for use in some embodiments.

In some aspects, the TCE are nucleic acids encoding peptides wherein said nucleic acids are, are at least, are at least about, are less than, or are less than about 3 nucleotides, 4 nucleotides, 5 nucleotides, 6 nucleotides, 7 nucleotides, 8 nucleotides, 9 nucleotides, 10 nucleotides, 11 nucleotides, 12 nucleotides, 13 nucleotides, 14 nucleotides, 15 nucleotides, 16 nucleotides, 17 nucleotides, 18 nucleotides, 19 nucleotides, 20 nucleotides, 21 nucleotides, 22 nucleotides, 23 nucleotides, 24 nucleotides, 25 nucleotides, 26 nucleotides, 27 nucleotides, 28 nucleotides, 29 nucleotides, 30 nucleotides, 31 nucleotides, 32 nucleotides, 33 nucleotides, 34 nucleotides, 35 nucleotides, 36 nucleotides, 37 nucleotides, 38 nucleotides, 39 nucleotides, 40 nucleotides, 41 nucleotides, 42 nucleotides, 43 nucleotides, 44 nucleotides, 45 nucleotides, 46 nucleotides, 47 nucleotides, 48 nucleotides, 49 nucleotides, 50 nucleotides, 55 nucleotides, 60 nucleotides, 65 nucleotides, 70 nucleotides, 75 nucleotides, 80 nucleotides, 85 nucleotides, 90 nucleotides, 95 nucleotides, 100 nucleotides, 110 nucleotides, 120 nucleotides, 130 nucleotides, 140 nucleotides, 150 nucleotides, 160 nucleotides, 170 nucleotides, 180 nucleotides, 190 nucleotides, 200 nucleotides, 250 nucleotides, 300 nucleotides, 350 nucleotides, 400 nucleotides, 450 nucleotides, 500 nucleotides, 550 nucleotides, 600 nucleotides, 650 nucleotides, 700 nucleotides, 750 nucleotides, 800 nucleotides, 850 nucleotides, 900 nucleotides, 950 nucleotides, 1000 nucleotides, 1100 nucleotides, 1200 nucleotides, 1300 nucleotides, 1400 nucleotides, 1500 nucleotides, 1600 nucleotides, 1700 nucleotides, 1800 nucleotides, 1900 nucleotides, 2000 nucleotides, 2500 nucleotides, 3000 nucleotides, 3500 nucleotides, 4000 nucleotides, 4500 nucleotides, 5000 nucleotides, 6000 nucleotides, 7000 nucleotides, 8000 nucleotides, 9000 nucleotides, 10,000 nucleotides in length In some aspects, the TCE are peptides or peptide fragments that are, are at least, are at least about, are less than, or are less than about 3 amino acids, 4 amino acids, 5 amino acids, 6 amino acids, 7 amino acids, 8 amino acids, 9 amino acids, 10 amino acids, 11 amino acids, 12 amino acids, 13 amino acids, 14 amino acids, 15 amino acids, 16 amino acids, 17 amino acids, 18 amino acids, 19 amino acids, 20 amino acids, 21 amino acids, 22 amino acids, 23 amino acids, 24 amino acids, 25 amino acids, 26 amino acids, 27 amino acids, 28 amino acids, 29 amino acids, 30 amino acids, 31 amino acids, 32 amino acids, 33 amino acids, 34 amino acids, 35 amino acids, 36 amino acids, 37 amino acids, 38 amino acids, 39 amino acids, 40 amino acids, 41 amino acids, 42 amino acids, 43 amino acids, 44 amino acids, 45 amino acids, 46 amino acids, 47 amino acids, 48 amino acids, 49 amino acids, 50 amino acids, 55 amino acids, 60 amino acids, 65 amino acids, 70 amino acids, 75 amino acids, 80 amino acids, 85 amino acids, 90 amino acids, 95 amino acids, 100 amino acids, 110 amino acids, 120 amino acids, 130 amino acids, 140 amino acids, 150 amino acids, 160 amino acids, 170 amino acids, 180 amino acids, 190 amino acids, 200 amino acids, 250 amino acids, 300 amino acids, 350 amino acids, 400 amino acids, 450 amino acids, 500 amino acids, 550 amino acids, 600 amino acids, 650 amino acids, 700 amino acids, 750 amino acids, 800 amino acids, 850 amino acids, 900 amino acids, 950 amino acids, 1000 amino acids, 1100 amino acids, 1200 amino acids, 1300 amino acids, 1400 amino acids, 1500 amino acids, 1600 amino acids, 1700 amino acids, 1800 amino acids, 1900 amino acids, 2000 amino acids, 2500 amino acids, 3000 amino acids, 3500 amino acids, 4000 amino acids, 4500 amino acids, 5000 amino acids, 6000 amino acids, 7000 amino acids, 8000 amino acids, 9000 amino acids, 10,000 amino acids in length.

Further, it will be appreciated that the term "TCE" includes sequences that comprise one, two, or multiple TCEs. For example, a TCE may refer to a recombinant string of CTL and/or HTL epitopes. In some embodiments, the NS3/4A chimeric molecules disclosed herein include epitope strings to generate a CTL response against any chosen antigen/target that contains such epitopes. Optionally, HTL epitopes which are active in individuals of different HLA types, for example HTLs from tetanus (against which most individuals will already be primed) are present in the embodiments disclosed herein. Further, in some embodiments, in addition to a TCE, it may also be useful to include B cell epitopes for stimulating B cell responses and antibody production. Optionally, multiple epitope (e.g. multiple TCE and/or multiple TCE and BCE) conjugates can be engineered to be linked by a linker molecule. Linkers can comprise relatively neutral amino acid sequences or amino acid mimetics, such as, e.g., Ala, Gly, or other neutral linkers of nonpolar amino acids or neutral polar amino acids. In certain preferred embodiments herein the neutral linker is Ala. It will be understood that the optionally present linker need not be comprised of the same residues and thus may be a hetero- or homo-oligomer. Preferred exemplary linkers are homo-oligomers of Ala or Gly. When present, the linker will usually be at least one or two residues, more usually three to six residues. Adjuvant sequences such as nucleic acids encoding HIV TAT or fragments thereof (e.g., 3, 6, 9, 12, 15, 21, 24, 27, 30, 33, 36, 39, 42, 45, 48, 51, 54, 57, or 60 nucleotides in length) can be employed in some embodiments. Exemplary sequences can be found in WO05039631A1, which designates the United states and was published in English, hereby expressly incorporated by reference in its entirety. Optionally, linkers and/or adjuvant sequences flank, or are juxtaposed to TCE sequences and/or NS3/4A sequences.

The compositions and methods disclosed herein relate to antigens against which it is desired to generate an immune response. For example, the compositions and methods disclosed herein are useful, for example, in generating or enhancing the immunogenicity of TCEs derived from agents against which CD8$^+$ T cell responses have been shown to play a protective role. As such, the compositions disclosed herein are useful in diseases that include but are not limited to infection and disease caused by the viruses including, but not limited to: influenza A and B viruses (FLU-A, FLU-B), human immunodeficiency type I and II viruses (HIV-I, HIV-II), Epstein-Barr virus (EBV), human T lymphotrophic (or T-cell leukemia) virus type I and type II (HTLV-I, HTLV-II), human papillomaviruses types 1 to 18 (HPV-1 to HPV-18), rubella (RV), varicella-zoster (VZV), hepatitis B (HBV), hepatitis C(HCV), adenoviruses (AV), and herpes simplex virus (HSV), cytomegalovirus (CMV), poliovirus, respiratory syncytial (RSV), rhinovirus, rabies, mumps, rotavirus or measles viruses. Further, the compositions disclosed herein are useful in diseases caused by the bacteria *Mycobacterium tuberculosis* and *Listeria* sp.; and by the protozoan parasites *Plasmodium, Toxoplasma* and *Trypanosoma* and the like.

In a like manner, the compositions and methods described herein are applicable to tumor-associated proteins (e.g. related to melanoma, breast cancer, colon cancer and the like), which could be sources for CTL epitopes. Such tumor proteins and/or peptides, include, but are not limited to, products of the MAGE-1, -2 and -3 genes, products of the c-ErbB2

(HER-2/neu) proto-oncogene, tumor suppressor and regulatory genes which could be either mutated or overexpressed such as p53, ras, myc, and RB1. Tissue specific proteins to target CTL responses to tumors such as prostatic specific antigen (PSA) and prostatic acid phosphatase (PAP) for prostate cancer, and tyrosinase for melanoma. In addition viral related proteins associated with cell transformation into tumor cells such as EBNA-1, UPV E6 and E7 are likewise applicable. A large number of peptides from some of the above proteins have been analyzed for the presence of MHC-binding motifs and for their ability to bind with high efficiency to purified MHC molecules and are the subject of pending patent applications (U.S. patent application Ser. Nos. 08/159,339 and 08/073,205, previously incorporated herein by reference)

The amino acid sequences of exemplary TCEs, including both HTL and CTL TCEs, are listed in Table 3. Nucleic acids encoding these sequences can be readily generated by those of skill in the art.

TABLE 3

| SEQ ID NO | Epitope Source | Sequence | Source |
|---|---|---|---|
| 222 | EBV | YLLEMLWRL | U.S. Pat. No. 6,723,695* |
| 223 | EBV | YFLEILWGL | U.S. Pat. No. 6,723,695 |
| 224 | EBV | YLLEILWRL | U.S. Pat. No. 6,723,695 |
| 225 | EBV | YLQQNWWTL | U.S. Pat. No. 6,723,695 |
| 226 | EBV | LLLALLFWL | U.S. Pat. No. 6,723,695 |
| 227 | EBV | LLVDLLWLL | U.S. Pat. No. 6,723,695 |
| 228 | EBV | LLLIALWNL | U.S. Pat. No. 6,723,695 |
| 229 | EBV | WLLLFLAIL | U.S. Pat. No. 6,723,695 |
| 230 | EBV | TLLVDLLWL | U.S. Pat. No. 6,723,695 |
| 231 | EBV | LLWLLLFLA | U.S. Pat. No. 6,723,695 |
| 232 | EBV | ILLIIALYL | U.S. Pat. No. 6,723,695 |
| 233 | EBV | VLFIFGCLL | U.S. Pat. No. 6,723,695 |
| 234 | EBV | RLGATIWQL | U.S. Pat. No. 6,723,695 |
| 235 | EBV | ILYFIAFAL | U.S. Pat. No. 6,723,695 |
| 236 | EBV | SLVIVTTFV | U.S. Pat. No. 6,723,695 |
| 237 | EBV | LMIIPLINV | U.S. Pat. No. 6,723,695 |
| 238 | EBV | TLFIGSHVV | U.S. Pat. No. 6,723,695 |
| 239 | EBV | LIPETVPYI | U.S. Pat. No. 6,723,695 |
| 240 | EBV | QLTPHTKAV | U.S. Pat. No. 6,723,695 |
| 241 | EBV | QNGALAINTF | U.S. Pat. No. 6,703,024* |
| 242 | EBV | LLDFVRFMGV | U.S. Pat. No. 6,703,024 |

TABLE 3-continued

| SEQ ID NO | Epitope Source | Sequence | Source |
|---|---|---|---|
| 243 | EBV | QAKWRLQTL | WO/95AU0000140* |
| 244 | EBV | RYSIFFDY | WO/95AU0000140 |
| 245 | EBV | HLAAQGMAY | WO/95AU0000140 |
| 246 | EBV | YPLTEQHGM | WO/95AU0000140 |
| 247 | EBV | SVRDRLARL | WO/95AU0000140 |
| 248 | EBV | AVLLHEESM | WO/95AU0000140 |
| 249 | EBV | VSFIEFVGW, | WO/95AU0000140 |
| 250 | EBV | FRKAQIQGL | WO/95AU0000140 |
| 251 | EBV | PYLFWLAAI, | WO/95AU0000140 |
| 252 | EBV | TVFYNIPPMPL | WO/95AU0000140 |
| 253 | EBV | PGDQLPGFSDGRACPV | WO/95AU0000140 |
| 254 | EBV | VEITPYKPTW | WO/95AU0000140 |
| 255 | EBV | TYSAGIVQI | U.S. Pat. No. 6,699,477* |
| 256 | HPV | AQIFNKPYW, | U.S. Pat. No. 6,911,207* |
| 257 | HPV | AGVDNRECI | U.S. Pat. No. 6,911,207 |
| 258 | MAGE-1 (melanoma) | EADPTGHSY | U.S. Pat. No. 6,419,931* |
| 259 | MAGE-2 | KMVELVHFL | U.S. Pat. No. 6,419,931 |
| 260 | MAGE-2 | KMVELVHFLL | U.S. Pat. No. 6,419,931 |
| 261 | MAGE-3 | LVFGIELMEV | U.S. Pat. No. 6,419,931 |
| 262 | MAGE-1 | KVLEYVIKV | U.S. Pat. No. 6,419,931 |
| 263 | MAGE-1 | KVADLVGFLL | U.S. Pat. No. 6,419,931 |
| 264 | MAGE-3 | KVAEFVHFL | U.S. Pat. No. 6,419,931 |
| 265 | MAGE-1 | CILESLFRA | U.S. Pat. No. 6,419,931 |
| 266 | MAGE-1 | FLWGPRALA | U.S. Pat. No. 6,419,931 |
| 267 | MAGE-1 | VMIAMEGGHA | U.S. Pat. No. 6,419,931 |
| 268 | MAGE-1 | LVLGTLEEV | U.S. Pat. No. 6,419,931 |
| 269 | MAGE-1 | ALREEEEGV | U.S. Pat. No. 6,419,931 |
| 270 | MAGE-1 | ALAETSYVKV | U.S. Pat. No. 6,419,931 |
| 271 | MAGE-1 | YVIKVSARV | U.S. Pat. No. 6,419,931 |

TABLE 3-continued

| SEQ ID NO | Epitope Source | Sequence | Source |
|---|---|---|---|
| 272 | MAGE-1 | RALAETSYV | U.S. Pat. No. 6,419,931 |
| 273 | HIV nef84-94 | AVDLSHFLK | U.S. Pat. No. 6,419,931 |
| 274 | EBV NA4 416-424 | IVTDFSVIK | U.S. Pat. No. 6,419,931 |
| 275 | HBc18-27 | FLPSDFFPSV | U.S. Pat. No. 6,419,931 |
| 276 | HIV RT | ILKEPVHGV | U.S. Pat. No. 6,419,931 |
| 277 | HTLV-1, Tox 12-19 | LFGYPVYV | U.S. Pat. No. 6,419,931 |
| 278 | Influenza A, M1 58-66 | GILGFVFTL | U.S. Pat. No. 6,419,931 |
| 279 | HCMV, gB 619-628 | IAGNSAYEYV | U.S. Pat. No. 6,419,931 |
| 280 | *Plasmodium falciparum* | GIEYLNKIQNSLSTEWSPCSVT | U.S. Pat. No. 6,942,866* |
| 281 | *Plasmodium vivax* | YLDKVRATVGTEWTPCSVT | U.S. Pat. No. 6,942,866 |
| 282 | *Plasmodium yoelli* | EFVKQISSQLTEEWSQCSVT | U.S. Pat. No. 6,942,866 |
| 283 | p53 264-272 | LLGRNSFEV | U.S. Pat. No. 6,419,931 |
| 284 | HBVadr-ENV (SAg335-343) | WLSLLVPFV | U.S. Pat. No. 6,419,931 |
| 285 | c-ErbB2 (HER-2/neu)(Breast cancer) | RFRELVSEFSRMARDPQ | U.S. Pat. No. 6,419,931 |
| 286 | HIV nef73-82 | QVPLRPMTYK | U.S. Pat. No. 6,419,931 |
| 287 | HIV-1 NL43 env gp41768-778 | RLRDLLLIVTR | U.S. Pat. No. 6,419,931 |
| 288 | HCV 141-151 | STLPETTTVRR | U.S. Pat. No. 6,419,931 |
| 289 | Influenza virus NP 383-391 | SRYWAIRTR | U.S. Pat. No. 6,419,931 |
| 290 | HIV gag p24 265-274 | KRWIILGLNK | U.S. Pat. No. 6,419,931 |
| 291 | *P. falciparum* circumsp. 368-375 | KPKDELDY | U.S. Pat. No. 6,419,931 |
| 292 | *P. falciparum* circumsp. 368-375 | KSKDLEDY | U.S. Pat. No. 6,419,931 |
| 293 | *P. falciparum* liver Ag 1850-1857 | KPNDKSLY | U.S. Pat. No. 6,419,931 |
| 294 | HIV-2 | TPYDINQIVIL | U.S. Pat. No. 6,419,931 |

TABLE 3-continued

| SEQ ID NO | Epitope Source | Sequence | Source |
|---|---|---|---|
| 295 | P. falciparum liver Ag 1786-1794 | KPIVQYDNF | U.S. Pat. No. 6,419,931 |
| 296 | B53 self peptide | YPAEITLTW | U.S. Pat. No. 6,419,931 |
| 297 | HIV gp41 586-593 | YLKDQQLL | U.S. Pat. No. 6,419,931 |
| 298 | Influenza virus NP 380-388 | ELRSRYWAI | U.S. Pat. No. 6,419,931 |
| 299 | EBV EBNA-3 | FLRGRAYGI | U.S. Pat. No. 6,419,931 |
| 300 | HIV gag 261-269 | GEIYKRWII | U.S. Pat. No. 6,419,931 |
| 301 | HIV gag 331-339 | DCKTILKAL | U.S. Pat. No. 6,419,931 |
| 302 | HIV pol185-193 | DPKVKQWPL | U.S. Pat. No. 6,419,931 |
| 303 | HIV gp41 586-593 | YLKDQQLYL | U.S. Pat. No. 6,419,931 |
| 304 | HIV gap p17.3 | GGKKKYKLK | U.S. Pat. No. 6,419,931 |
| 305 | HBV POL | LLAQFTSAI | U.S. Pat. No. 6,419,931 |
| 306 | HBV ENV | LLVPFVQWFV | U.S. Pat. No. 6,419,931 |
| 307 | HBV ENV | WLSLLVPFV | U.S. Pat. No. 6,419,931 |
| 308 | HBV ENV | FLLAQFTSA | U.S. Pat. No. 6,419,931 |
| 309 | HBV POL | FLLSLGIHL | U.S. Pat. No. 6,419,931 |
| 310 | HBV POL | ALMPLYACI | U.S. Pat. No. 6,419,931 |
| 311 | HBV ENV | ILLLCLIFLL | U.S. Pat. No. 6,419,931 |
| 312 | HBV POL | KLJLYSTHPI | U.S. Pat. No. 6,419,931 |
| 313 | HBV ENV | VLLDYQGML | U.S. Pat. No. 6,419,931 |
| 314 | HBV ENV | LLPIFFCLWV | U.S. Pat. No. 6,419,931 |
| 315 | HBV ENV | VLQAGFFLL | U.S. Pat. No. 6,419,931 |
| 316 | HBV POL | YLHTLWKAGI | U.S. Pat. No. 6,419,931 |
| 317 | HBV POL | YLHTLWKAGV | U.S. Pat. No. 6,419,931 |
| 318 | HBV ENV | PLLPIFFCL | U.S. Pat. No. 6,419,931 |
| 319 | HBV NUC | ILSTLPETTV | U.S. Pat. No. 6,419,931 |

TABLE 3-continued

| SEQ ID NO | Epitope Source | Sequence | Source |
|---|---|---|---|
| 320 | HCV NS4 | LLFNILGGWV | U.S. Pat. No. 6,419,931 |
| 321 | HCV CORE | LLALLSCLTV | U.S. Pat. No. 6,419,931 |
| 322 | HCV NS4 | YLVAYQATV | U.S. Pat. No. 6,419,931 |
| 323 | HCV NS1/ENV | FLLLADARV | U.S. Pat. No. 6,419,931 |
| 324 | HCV NS4 | ILAGYGAGV | U.S. Pat. No. 6,419,931 |
| 325 | HCV CORE | DLMGYIPLV | U.S. Pat. No. 6,419,931 |
| 326 | HCV CORE | YLLPRRGPRL | U.S. Pat. No. 6,419,931 |
| 327 | NS1/ENV2 | ALSTGLIHL | U.S. Pat. No. 6,419,931 |
| 328 | HCV CORE | LLALLSCLTI | U.S. Pat. No. 6,419,931 |
| 329 | HCV NS5 | RLIVFPDLGV | U.S. Pat. No. 6,419,931 |
| 330 | HCV NS5 | RLHGLSAFSL | U.S. Pat. No. 6,419,931 |
| 331 | HCV NS4 | ILGGWVAAQL | U.S. Pat. No. 6,419,931 |
| 332 | HCV ENV1 | SMVGNWAKV | U.S. Pat. No. 6,419,931 |
| 333 | HCV NS3 | YLVTRHADV | U.S. Pat. No. 6,419,931 |
| 334 | HCV NS4 | VLAALAAYCL | U.S. Pat. No. 6,419,931 |
| 335 | UPV16 E7 | LLMGTLGIV | U.S. Pat. No. 6,419,931 |
| 336 | HPV16 E7 | YMLDLQPET | U.S. Pat. No. 6,419,931 |
| 337 | HPV16 E6 | FAFRDLCIV | U.S. Pat. No. 6,419,931 |
| 338 | HPV16 E7 | TLGIVCPIC | U.S. Pat. No. 6,419,931 |
| 339 | HPV16 E7 | TLITEYMILDL | U.S. Pat. No. 6,419,931 |
| 340 | HPV16 E7 | GTLGIVCPI | U.S. Pat. No. 6,419,931 |
| 341 | HPV16 E7 | MLDLQPETT | U.S. Pat. No. 6,419,931 |
| 342 | HPV16 E6 | TIHDIILECV | U.S. Pat. No. 6,419,931 |
| 343 | HIV | VLAEAMSQV | U.S. Pat. No. 6,419,931 |
| 344 | HIV | LLWKGEGAVV | U.S. Pat. No. 6,419,931 |

TABLE 3-continued

| SEQ ID NO | Epitope Source | Sequence | Source |
|---|---|---|---|
| 345 | HIV | LLWKGEGAV | U.S. Pat. No. 6,419,931 |
| 346 | HIV | ILKEPVHGV | U.S. Pat. No. 6,419,931 |
| 347 | HIV | IVGAETFYV | U.S. Pat. No. 6,419,931 |
| 348 | HIV | IIGAETFYV | U.S. Pat. No. 6,419,931 |
| 349 | HIV | LWVTVYYGV | U.S. Pat. No. 6,419,931 |
| 350 | HIV | LMVTVYYGV | U.S. Pat. No. 6,419,931 |
| 351 | HBc 11-27 | ATVELLSFLPSDFFPSV | U.S. Pat. No. 6,419,931 |
| 352 | HBc 91-110 | Thr-Asn-Met-GIy-Leu-Lys-Phe-Arg-Gln-Leu-Leu-Trp-Phe-His-Ile-Ser-Gys-Leu-Thr-Phe | U.S. Pat. No. 6,322,789* |
| 353 | HBenv 329-348 | Ala-Ser-Ala-Arg-Phe-Ser-Trp-Leu-Ser-Leu-Leu-Val-Pro-Phe-Val-Gln-Trp-Phe-Val-Gly | U.S. Pat. No. 6,322,789 |
| 354 | HBenv 349-368 | Leu-Ser-Pro-Thr-Val-Trp-Leu-Ser-Val-Ile-Trp-Met-Met-Trp-Tyr-Trp-GIy-Pro-Ser-Leu | U.S. Pat. No. 6,322,789 |
| 355 | HBenv 309-328 | Asn-Gys-Thr-Gys-Ile-Pro-Ile-Pro-Ser-Ser-Trp-Ala-Phe-Gly-Lys-Phe-Leu-Trp-Glu-Trp | U.S. Pat. No. 6,322,789 |
| 356 | HBenv 329-358 | Ala-Ser-Ala-Arg-Phe-Ser-Trp-Leu-Ser-Leu-Leu-Val-Pro-Phe-Val-Gln-Trp-Phe-Val-Gly | U.S. Pat. No. 6,322,789 |
| 357 | HBc 91-102 | Thr-Asn-Met-Gly-Leu-Lys-Phe-Arg-Gln-Leu-Leu-Trp-Leu-Ser-Pro-Thr-Val-Trp-Leu-Ser-Val-Ile- | U.S. Pat. No. 6,322,789 |
| 358 | HBc 128-140 | TPPAYRPPNAPIL | U.S. Pat. No. 6,419,931 |
| 359 | HBenv 360-368 | WMMWYWGPSL | U.S. Pat. No. 6,322,789 |
| 360 | Myobacterium leprae | LEDPYEKIGAELVKEV | |
| 361 | Myobacterium leprae | EQIAATAAISAGDQS | USSN 11/041,893* |
| 362 | Myobacterium leprae | AGDQSIGDLIAEAMD | USSN 11/041,893 |
| 363 | Myobacterium leprae | VEGAGDTDAIAGRVA | USSN 11/041,893 |
| 364 | Myobacterium leprae | AGGVAVIKAGAATEV | USSN 11/041,893 |
| 365 | Myobacterium leprae | GDEATGANIVKVALE | USSN 11/041,893 |
| 366 | Myobacterium leprae | LQNAASIAGLFLTTE | USSN 11/041,893 |
| 367 | Myobacterium leprae | AGGGVTLLQAAPALD | USSN 11/041,893 |

TABLE 3-continued

| SEQ ID NO | Epitope Source | Sequence | Source |
|---|---|---|---|
| 368 | Myobacterium leprae | RVAQIRTEIENSD | USSN 11/041,893 |
| 369 | Myobacterium leprae | LLQAAPALDKLKL | USSN 11/041,893 |
| 370 | Myobacterium leprae | PEKTAAPASDPTG | USSN 11/041,893 |
| 371 | Myobacterium tuberculosis | LEDPYEKIGAELVKEV | USSN 11/041,893 |
| 372 | Myobacterium tuberculosis | EQIAATAAISAGDQS | USSN 11/041,893 |
| 373 | Myobacterium tuberculosis | AGDQSIGDLIAEAMD | USSN 11/041,893 |
| 374 | Myobacterium tuberculosis | VEGAGDTDAIAGRVA | USSN 11/041,893 |
| 375 | Myobacterium tuberculosis | AGGVAVIKAGAATEV | USSN 11/041,893 |
| 376 | Myobacterium tuberculosis | GDEATGANTVKVALE | USSN 11/041,893 |
| 377 | Myobacterium tuberculosis | LQNAASIAGLFLTTE | USSN 11/041,893 |
| 378 | Myobacterium tuberculosis | AGGGVTLLQAAPALD | USSN 11/041,893 |
| 379 | Myobacterium tuberculosis | RVQAQIRTEIENSD | USSN 11/041,893 |
| 380 | Myobacterium tuberculosis | LLQAAPALDKLKL | USSN 11/041,893 |
| 381 | Myobacterium tuberculosis | LPAKFLEGF | USSN 11/041,893 |
| 382 | Myobacterium tuberculosis | YLQVPSPSMGRDIKVQFQ | USSN 11/041,893 |
| 383 | Myobacterium tuberculosis | GRDIKVQFQSGGNNSPAV | USSN 11/041,893 |
| 384 | Myobacterium tuberculosis | GCQTYKEWTLLTSELPQW | USSN 11/041,893 |
| 385 | Myobacterium tuberculosis | IPAEFLENF | USSN 11/041,893 |
| 386 | Myobacterium tuberculosis | WPTLIGLAM | USSN 11/041,893 |
| 387 | Myobacterium tuberculosis | IPAIKFLEGL | USSN 11/041,893 |
| 388 | Myobacterium tuberculosis | MIPVGGQSSF | USSN 11/041,893 |
| 389 | Myobacterium tuberculosis | MIPVGGQSSFY | USSN 11/041,893 |
| 390 | Myobacterium tuberculosis | MSQIMYNYPAMMAHAGDM | USSN 11/041,893 |
| 391 | Myobacterium tuberculosis | ITYQGWQTQWNQALED | USSN 11/041,893 |
| 392 | Myobacterium tuberculosis | ATFAAPVALAA | USSN 11/041,893 |

TABLE 3-continued

| SEQ ID NO | Epitope Source | Sequence | Source |
|---|---|---|---|
| 393 | *Myobacterium tuberculosis* | SGATIPQGEQS | USSN 11/041,893 |
| 394 | *Myobacterium tuberculosis Mycobacterium bovis* | AVAASNNPELTTLTAALSGQLNPQV | USSN 11/041,893 |
| 395 | *Myobacterium tuberculosis Mycobacterium bovis* | ALSGQLNPQVNLVDTLNSGQY | USSN 11/041,893 |
| 396 | *Myobacterium tuberculosis* Mycobacterium bovis | FSKLPASTIDELKTNSSLLTSILTYH | USSN 11/041,893 |
| 397 | *Myobacterium tuberculosis Mycobacterium bovis* | GNADVVCGGVSTANATVYMIDSVL | USSN 11/041,893 |
| 398 | *Myobacterium tuberculosis Mycobacterium bovis* | AVAASNNPELTTLTAALSGQLNPQV | USSN 11/041,893 |
| 399 | *Myobacterium tuberculosis Mycobacterium bovis* | ALSGQLNPQVNLVDTLNSGQY | USSN 11/041,893 |
| 400 | *Myobacterium tuberculosis Mycobacterium bovis* | FSKLPASTIDELKTNSSLLTSILTYH | USSN 11/041,893 |
| 401 | *Myobacterium tuberculosis Mycobacterium bovis* | GNADVVCGGVSTANATVYMIDSVL | USSN 11/041,893 |
| 402 | *Myobacterium tuberculosis Mycobacterium bovis* | ATTVYMIDSVLMIPPA | USSN 11/041,893 |
| 403 | *Myobacterium tuberculosis Mycobacterium bovis* | MTEQQWNFAGIEAAASAIQG | USSN 11/041,893 |
| 404 | *Myobacterium tuberculosis Mycobacterium bovis* | EQQWNFAGIEAAA | USSN 11/041,893 |
| 405 | *Myobacterium tuberculosis Mycobacterium bovis* | WNFAGIEAA | USSN 11/041,893 |
| 406 | *Myobacterium tuberculosis Mycobacterium bovis* | VQGVQQKWDATATELNNALQ | USSN 11/041,893 |
| 407 | *Myobacterium tuberculosis Mycobacterium bovis* | AWGGSGSEAUQGVQQKWDATATEL | USSN 11/041,893 |
| 408 | *Myobacterium tuberculosis Mycobacterium bovis* | QGVQQKWDATATELNNALQNLART | USSN 11/041,893 |

TABLE 3-continued

| SEQ ID NO | Epitope Source | Sequence | Source |
|---|---|---|---|
| 409 | Myobacterium tuberculosis Mycobacterium bovis | LARTISEAGQAMASTEGNVTGMFA | USSN 11/041,893 |
| 410 | Myobacterium tuberculosis Mycobacterium bovis | EQQWNFAGIEAAA | USSN 11/041,893 |
| 411 | Streptococcus mutans | NNNDVNIDRTLVAKQSVVKF | USSN 11/041,893 |
| 412 | Streptococcus mutans | QLKTADLPAGRDETTSFVLV | USSN 11/041,893 |
| 413 | Streptococcus mutans | LATFNADLTKSVATIYPTVV | USSN 11/041,893 |
| 414 | Chlamydia pneumoniae | GDYVFDRI | USSN 11/041,893 |
| 415 | Chlamydia pneumoniae | SLLGNATAL | USSN 11/041,893 |
| 416 | Chlamydia pneumoniae | QAVANGGAI | USSN 11/041,893 |
| 417 | Chlamydia pneumoniae | RGAFCDKEF | USSN 11/041,893 |
| 418 | Chlamydia pneumoniae | CYGRLYSVKV | USSN 11/041,893 |
| 419 | Chlamydia pneumoniae | KYNEEARKKI | USSN 11/041,893 |
| 420 | Chlamydia pneumoniae | GPKGRHVVI | USSN 11/041,893 |
| 421 | Eseherichia coli | TPTIIPARIGL | USSN 11/041,893 |
| 422 | Salmonella typhimurium | LIQCMLKKTMLS1NQ | USSN 11/041,893 |
| 423 | Listeria monocytogenes | GYKDGNEYI | USSN 11/041,893 |
| 424 | Borrelia burgdorferi | VVKEGTVTLSKNISKSGEVS | USSN 11/041,893 |
| 425 | Lymphocytic choriomeningitis virus | FQPQNGQFI | USSN 11/041,893 |
| 426 | Lymphocytic choriomeningitis virus | RPQASGVYM | USSN 11/041,893 |
| 427 | Lymphocytic choriomeningitis virus | PYIACRTSI | USSN 11/041,893 |
| 428 | Lymphocytic choriomeningitis virus | MYPIACRTSI | USSN 11/041,893 |
| 429 | Lymphocytic choriomeningitis virus | WPYIACRTSI | USSN 11/041,893 |
| 430 | Lassa Fever virus | FGTMIPSLTLACLT | USSN 11/041,893 |
| 431 | Lassa Fever virus | FGIVIIPSLTIACMC | USSN 11/041,893 |
| 432 | Lassa Fever virus | QGQVDLNDAVQAL | USSN 11/041,893 |

TABLE 3-continued

| SEQ ID NO | Epitope Source | Sequence | Source |
|---|---|---|---|
| 433 | Lassa Fever virus | QGQADLNDVIQSL | USSN 11/041,893 |
| 434 | Lassa Fever virus | ALGMFISDTPGER | USSN 11/041,893 |
| 435 | Lassa Fever virus | SLGMFVSDTPGER | USSN 11/041,893 |
| 436 | Lassa Fever virus | QLDPNAKTWMIDIE | USSN 11/041,893 |
| 437 | Lassa Fever virus | NLIPNAKTWIVIIDIE | USSN 11/041,893 |
| 438 | Lassa Fever virus | VWDQFKDLCHMHT | USSN 11/041,893 |
| 439 | Lassa Fever virus | VWDQFKDLCHMHT | USSN 11/041,893 |
| 440 | Lassa Fever virus | IWDEYKHLCRMHT | USSN 11/041,893 |
| 441 | HIV-1 | FPVTPQVP | USSN 11/041,893 |
| 442 | HIV-1 | FPVTPRVPL | USSN 11/041,893 |
| 443 | HIV-1 | TPQVPLRPM | USSN 11/041,893 |
| 444 | HIV-1 | YPLTFGWCY | USSN 11/041,893 |
| 445 | HIV-1 | PLTFGWCYK | USSN 11/041,893 |
| 446 | HIV-1 | LTFGWCYKL | USSN 11/041,893 |
| 447 | HIV-1 | EIYKRWIIL | USSN 11/041,893 |
| 448 | HIV-1 | ILGLNKIV | USSN 11/041,893 |
| 449 | HIV-1 | ILGLNKWRMY | USSN 11/041,893 |
| 450 | HBV sAg | QAGFFLLTRILTIPQSLD | USSN 11/041,893 |
| 451 | HBV sAg | SCCCTKPTDGNCTCIPIPSS | USSN 11/041,893 |
| 452 | HBV sAg | WEWASVRESWLS | USSN 11/041,893 |
| 453 | HBV sAg | LPLLPIFFCLWVYI | USSN 11/041,893 |
| 454 | HPV | RATIYNIVTF | USSN 11/041,893 |
| 455 | HPV | GQAEPDRAHYNIVTFCCKCDSTLRLC VQSTHVDIR | USSN 11/041,893 |
| 456 | EBV | RRIYDLIEL | USSN 11/041,893 |
| 457 | EBV | RKIYDLIEL | USSN 11/041,893 |
| 458 | EBV | FRKAQIQGL | USSN 11/041,893 |
| 459 | EBV | HRCQAIRK | USSN 11/041,893 |
| 460 | EBV | RRARSLSAERY | USSN 11/041,893 |
| 461 | EBV | DWTGGALLVLYSFALML | USSN 11/041,893 |
| 462 | EBV | ALLVLYSFAL | USSN 11/041,893 |
| 463 | EBV | LLVLYSFAL | USSN 11/041,893 |
| 464 | EBV | VLYSFALML | USSN 11/041,893 |
| 465 | EBV | LVLGIWIYLLEMLWRRLG | USSN 11/041,893 |
| 466 | EBV | LIIALYLQQNWWTLLVD | USSN 11/041,893 |
| 467 | EBV | IALYLQQNW | USSN 11/041,893 |
| 468 | EBV | ALYLQQNWW | USSN 11/041,893 |
| 469 | EBV | QNWWTLLVD | USSN 11/041,893 |

TABLE 3-continued

| SEQ ID NO | Epitope Source | Sequence | Source |
|---|---|---|---|
| 470 | EBV | LYLQQNWWT | USSN 11/041,893 |
| 471 | EBV | LIWMYYHGQRHSDEHHH | USSN 11/041,893 |
| 472 | EBV | QRHSDEHHH | USSN 11/041,893 |
| 473 | EBV | GQRHSDEHH | USSN 11/041,893 |
| 474 | EBV | YYHGQRHSD | USSN 11/041,893 |
| 475 | EBV | WMYYHGQRH | USSN 11/041,893 |
| 476 | EBV | TDDSGHESDSNSNEGRH | USSN 11/041,893 |
| 477 | EBV | ESDSNSNEG | USSN 11/041,893 |
| 478 | EBV | DSNSNEGRH | USSN 11/041,893 |
| 479 | EBV | PHSPSDSAGNDGGPPQL | USSN 11/041,893 |
| 480 | EBV | AGNDGGPPQ | USSN 11/041,893 |
| 481 | EBV | PSDSAGNDG | USSN 11/041,893 |
| 482 | EBV | RHSDEHHHDDSLPHPQQ | USSN 11/041,893 |
| 483 | EBV | EENLLDVFRM | USSN 11/041,893 |
| 484 | EBV | LVSDYCNVLNKEFTA | USSN 11/041,893 |
| 485 | EBV | FFIQQAPSNRVMIPAT | USSN 11/041,893 |
| 486 | EBV | RVMIPATIGTAMYKL | USSN 11/041,893 |
| 487 | EBV | KHSRVRAYTYSKVLG | USSN 11/041,893 |
| 488 | EBV | RALIKTLPRASYSSH | USSN 11/041,893 |
| 489 | EBV | ERPIFPHPSKPTFLP | USSN 11/041,893 |
| 490 | EBV | EVCQPRKIRPFHPPG | USSN 11/041,893 |
| 491 | EBV | QKEEAAICGQMDDLSH | USSN 11/041,893 |
| 492 | EBV | DYCNVLNKEF | USSN 11/041,893 |
| 493 | EBV | ATIGTAMYK | USSN 11/041,893 |
| 494 | EBV | FLRGRAYGL | USSN 11/041,893 |
| 495 | EBV | AVFDRKSDAK | USSN 11/041,893 |
| 496 | EBV | RRIYLDLIEL | USSN 11/041,893 |
| 497 | EBV | LLWTLVVLL | USSN 11/041,893 |
| 498 | EBV | CLGGLLTMV | USSN 11/041,893 |
| 499 | EBV | IEDPPFNSL | USSN 11/041,893 |
| 500 | EBV | SSCSSCPLSKI | USSN 11/041,893 |
| 501 | EBV | TYGPVFMCL | USSN 11/041,893 |
| 502 | EBV | APENAYQAY | USSN 11/041,893 |
| 503 | EBV | RAKFKQLL | USSN 11/041,893 |
| 504 | EBV | GLCTLVAML | USSN 11/041,893 |
| 505 | EBV | TLDYKPLSV | USSN 11/041,893 |
| 506 | EBV | QNGALAINTE | USSN 11/041,893 |
| 507 | EBV | EENLLDFVRF | USSN 11/041,893 |

TABLE 3-continued

| SEQ ID NO | Epitope Source | Sequence | Source |
|---|---|---|---|
| 508 | EBV | HPLTNNLPL | USSN 11/041,893 |
| 509 | HCV | GYKVLVLNPSVAAT | USSN 11/041,893 |
| 510 | Hantaan virus | NAHEGQLVI | USSN 11/041,893 |
| 511 | Hantaan virus | ISNQEPLKL | USSN 11/041,893 |
| 512 | Dengue virus | LIGFRKEIGRMLNIL | USSN 11/041,893 |
| 513 | Dengue virus | KGPLRMVLAFITFLR | USSN 11/041,893 |
| 514 | Rotavirus | RNFDTIRLSFQLVER | USSN 11/041,893 |
| 515 | Rotavirus | RLSFQLVRPPNMTP | USSN 11/041,893 |
| 516 | Rotavirus | VRPPNMTPAVANLF | USSN 11/041,893 |
| 517 | Measles virus | LSEIKGVIVITRLEAV | USSN 11/041,893 |
| 518 | Trypanosoma cruzi | IYNVGQVSI | USSN 11/041,893 |
| 519 | Trypanosoma cruzi | STINFTLVASVIIEEA | USSN 11/041,893 |
| 520 | Trypanosoma cruzi | LVASVIIEEAPSGNT | USSN 11/041,893 |
| 521 | Toxoplasma gondii | TDPGDVVIEELFNRIPETSV | USSN 11/041,893 |
| 522 | Toxoplasma gondii | LQLIRLAASLQHYGLVHA | USSN 11/041,893 |
| 523 | Toxoplasma gondii | IEWIYRRCKNIPQPVRALLEGFLR | USSN 11/041,893 |
| 524 | Babesia bovis | EYLVNKVLYMATMNYKT | USSN 11/041,893 |
| 525 | Babesia bovis | EAPWYKRWIKKFR | USSN 11/041,893 |
| 526 | Babesia bovis | FREAPQATKHFL | USSN 11/041,893 |
| 527 | Babesia bovis | FREAPQATKHFLDEN | USSN 11/041,893 |
| 528 | Babesia bovis | FREAPQATKHFLGEN | USSN 11/041,893 |
| 529 | Babesia bovis | FVVSLLKKNVVRDPESNDVENFASQYFYM | USSN 11/041,893 |
| 530 | Babesia bovis | VNSEKVDADDAGNAETQQLPDDAENEVRADD | USSN 11/041,893 |
| 531 | Plasmodium vivax | NFVGKFLELQIPGHTDLLHL | USSN 11/041,893 |
| 532 | Plasmodium vivax | FNQLMHVINFHYDLLRANVH | USSN 11/041,893 |
| 533 | Plasmodium vivax | LDMLKKVVLGLWKPLDNIKD | USSN 11/041,893 |
| 534 | Plasmodium vivax | LEYYLREKAKMAGTLIPES | USSN 11/041,893 |
| 535 | Plasmodium vivax | KKIKAFLETSNNKAAAPAQS | USSN 11/041,893 |
| 536 | Plasmodium vivax | SKDQIKKLTSLKNKLERRQN | USSN 11/041,893 |
| 537 | Plasmodium falciparum | DPNANPNVDPNANPNV | USSN 11/041,893 |

TABLE 3-continued

| SEQ ID NO | Epitope Source | Sequence | Source |
|---|---|---|---|
| 538 | Plasmodium falciparum | FGYRKPLDNIKDNVGKMEDYIKK | USSN 11/041,893 |
| 539 | Plasmodium falciparum | SKLNSLNNPHNVLQNFSVFFNKK | USSN 11/041,893 |
| 540 | Plasmodium falciparum | GYRKPLDNIKDNVGKMEDYIKK | USSN 11/041,893 |
| 541 | Plasmodium falciparum | KLNSLNNPHNVLQNFSVFFNK | USSN 11/041,893 |
| 542 | Plasmodium falciparum | TKILLKHYKGLVKYYNGESSP | USSN 11/041,893 |
| 543 | Plasmodium falciparum | HGTKYLIDGYEE1NELLYKLN | USSN 11/041,893 |
| 544 | Plasmodium falciparum | VTHESYQELVKKLEALEDAV | USSN 11/041,893 |
| 545 | Plasmodium falciparum | GLFHKEKMILNEEEITTKGA | USSN 11/041,893 |
| 546 | Plasmodium falciparum | DSNIMNSINNVMIDEIDFFEK | USSN 11/041,893 |
| 547 | Plasmodium falciparum | DDYTEYDLTEIDNILVKMFKTN | USSN 11/041,893 |
| 548 | Plasmodium falciparum | LTMSNVKNVSQTNFKSLLRNL | USSN 11/041,893 |
| 549 | Plasmodium falciparum | HTLETVNISDVNDFQISKY | USSN 11/041,893 |
| 550 | Plasmodium falciparum | DDEEDLDEFKPIVQYDNFQD | USSN 11/041,893 |
| 551 | Plasmodium falciparum | EENIGIKELEDLIEKNENL | USSN 11/041,893 |
| 552 | Plasmodium falciparum | DDLDEGIEKSSEELSEEK | USSN 11/041,893 |
| 553 | Plasmodium falciparum | IKKGKKYEKTKDNNF | USSN 11/041,893 |
| 554 | Plasmodium falciparum | DNEILQWDELSEDITKYFMKL | USSN 11/041,893 |
| 555 | Plasmodium falciparum | EQQQSDLEQERLAKEKLQEQQSDLEQ ERRAKEKLQ | USSN 11/041,893 |

* The listed patents and patent applications are hereby expressly incorporated by reference in their entirety.

Yet other exemplary TCEs are listed in TABLES 4 as well as described herein (e.g., SEQ ID NOs: 809-1011 and SEQ ID NO:1014).

TABLE 4

HCV T-CELL EPITOPES

| Protein | HLA Restriction | Sequence | SEQ ID NO: |
|---|---|---|---|
| Core | A2 | FLPSDFFPSV | 809 |
| Core | A2 | CLTFGRETV | 810 |
| Core | A2 | VLEYLVSFGV | 811 |
| Core | A2/A24 | EYLVSFGVW | 812 |
| Core | A2 | ILSTLPETTV | 813 |
| Core | A33/A68 | STLPETTVVRR | 814 |
| Core | A2 | AILSKTGDPV | 815 |
| Env | A2 | LLDPRVRGL | 816 |
| Env | A2 | VLQAGFFLL | 817 |

TABLE 4-continued

HCV T-CELL EPITOPES

| Protein | HLA Restriction | Sequence | SEQ ID NO: |
|---|---|---|---|
| Env | A2 | FLLTRILTI | 818 |
| Env | A2 | SLNFLGGTTV | 819 |
| Env | A2 | FLGGTPVCL | 820 |
| Env | A2 | LLLCLIFLL | 821 |
| Env | A2 | LLCLIFLLV | 822 |
| Env | A2 | LLDYQGMLPV | 823 |
| Env | A2 | LVLLDYQGML | 824 |
| Env | A2 | VLLDYQGML | 825 |
| Env | A2 | LLDYQGMLPV | 826 |
| Env | A2 | WLSLLVPFV | 827 |
| Env | A2 | LLVPFVQWFV | 828 |
| Env | A2 | GLSPTVWLSV | 829 |
| Env | A2 | SIVSPFIPLL | 830 |
| Env | A2 | LLPIFFCLWV | 831 |
| Env | A2 | ILSPFFFLPLL | 832 |
| x-Protein | A2 | VLCLRPVGA | 833 |
| x-Protein | A2 | TLPSPSSSA | 834 |
| x-Protein | A2 | HLSLRGLFV | 835 |
| x-Protein | A2 | VLHKRTLGL | 836 |
| x-Protein | A2 | AMSTTDLEA | 837 |
| x-Protein | A2 | CLFKDWEEL | 838 |
| Pol | A24 | LYSSTVPVF | 839 |
| Pol | A2 | GLSRYVARL | 840 |
| Pol | A2 | YMDDVVLGA | 841 |
| Pol | A2 | FLLSLGIHL | 842 |
| Pol | A24 | KYTSFPWLL | 843 |
| Pol | A2 | ILRGTSFVYV | 844 |
| Pol | A2 | SLYADSPSV | 845 |

Other exemplary sequences that can be used in part or in whole as epitopes in the embodiments are also described herein, e.g. TCE's and BCE's.

Other exemplary HTL epitopes within a HTL peptide from tetanus toxoid 830-843 having the sequence: Gln-Tyr-Ile-Lys-Ala-Asn-Ser-Lys-Phe-Ile-Gly-Ile-Thr-Glu (QYIKAN-SKFIGITE) [SEQ ID NO: 556], malaria circumsporozoite 382-398 (KIAKMEKASSVFNVVNS) [SEQ ID NO: 557]; malaria circumsporozoite 378-398 (DIEKKIAKMEKASS-VFNVVNS) [SEQ ID NO: 558], malaria circumsporozoite 326-345 (EYLNKIQNSLSTEWSPCSVT) and ovalbumin 323-336 Ile-Ser-Gln-Ala-Val-His-Ala-Ala-His-Ala-Glu-Ile-Asn-Glu [SEQ ID NO:559] and the influenza epitope 307-319 Pro-Lys-Tyr-Val-Lys-Gln-Asn-Thr-Leu-Lys-Leu-Ala-Thr [SEQ ID NO: 560]; *Corneybacterium diptheriae* dephteria toxin NLFQVVHWSYNRPAYSPGYV [SEQ ID NO: 561]; *Escherichia coli* OmpF FDFGLRPSTAYTK-SKAKDVVE [SEQ ID NO: 567]; *Escherichia coli* OmpF DEVFATYYFNKNMSTYVDYII [SEQ ID NO: 1379]; *Escherichia coli* OmpF NKNMSTYVDYIINQIDSKNK [SEQ ID NO: 568]. In addition, suitable T helper peptides have been identified as described in pending U.S. patent application Ser. No. 08/121,101, hereby expressly incorporated by reference in its entirety.

Other examples of HTL-inducing peptides are those which are specific for the antigen (virus or other organism, tumor, etc.) being targeted by the CTL. For example, several HTL-inducing peptides specific for HBV have been described, such as $HBc_{1-20}$, having the sequence: Met-Asp-Ile-Asp-Pro-Tyr-Lys-Glu-Phe-Gly-Ala-Thr-Val-Glu-Leu-Leu-Ser-Phe-Leu-Pro [SEQ ID NO: 562]; peptides from the region $HBc_{50-69}$, which has the sequence Pro-His-His-Tyr-Ala-Leu-Arg-Gln-Ala-Ile-Leu-Cys-Trp-Gly-Glu-Leu-Met-Tyr-Leu-Ala [SEQ ID NO: 563], and from the region of $HBc_{100-139}$, including $HBc_{100-119}$ having the sequence Leu-Leu-Trp-Phe-His-Ile-Ser-Cys-Leu-Thr-Phe-Gly-Arg-Glu-Thr-Val-Ile-Glu-Tyr-Leu [SEQ ID NO: 564] (where $Ile_{116}$ is Leu in the HBV adw subtype), $HBc_{117-131}$ having the sequence Glu-Tyr-Leu-Val-Ser-Phe-Gly-Val-Trp-Ile-Arg-Thr-Pro-Pro-Ala [SEQ ID NO: 565], and peptide $HBc_{120-139}$ having the sequence Val-Ser-Phe-Gly-Val-Trp-Ile-Arg-Thr-Pro-Pro-Ala-Tyr-Arg-Pro-Pro-Asn-Ala-Pro-Ile [SEQ ID NO: 566]. See, Ferrari et al., J. Clin. Invest. 88:214-222 (1991), and U.S. Pat. Nos. 4,882,145, and 5,143,726, hereby expressly incorporated by reference in their entireties.

The skilled artisan will also appreciate that proteins containing at least one epitope, such as a TCE, useful in the embodiments disclose herein can be identified using a variety of techniques known in the art. Illustrative methods are described in, for example, Current Protocols in Immunology, Edited by: John E. Coligan, Ada M. Kruisbeek, David H. Margulies, Ethan M. Shevach, Warren Strober (2001 John Wiley & Sons, NY, N.Y.) Ausubel et al. (2001 Current Protocols in Molecular Biology, Greene Publ. Assoc. Inc. & John Wiley & Sons, Inc., NY, N.Y.); Sambrook et al. (1989 Molecular Cloning, Second Ed., Cold Spring Harbor Laboratory, Plainview, N.Y.); Maniatis et al. (1982 Molecular Cloning, Cold Spring Harbor Laboratory, Plainview, N.Y.). Illustrative methods useful in this context include intracellular cytokine staining (ICS), ELISPOT, proliferation assays, cytotoxic T cell assays including chromium release or equivalent assays, and gene expression analysis using any number of polymerase chain reaction (PCR) or RT-PCR based assays.

Epitopes of the embodiments disclosed herein may be identified using any number of techniques known in the art, such as those described by: Lamb J R, et al., (1989) Rev. Infect. Dis. March-April: Suppl 2:s443-447; Lamb J R, et al. (1987) EMBO J. 6(5):1245-1249; Lamb J R, et al., (1986) Lepr. Rev. December; Suppl 2:131-137; Mehra V, et al., (1986) Proc. Natl. Acad. Sci. USA 83(18): 7013-7; Horsfall A C, et al., (1991) Immunol. Today 12(7):211-3; Rothbard J B et al., (1990) Curr Top Microbiol Immunol 155:143-52; Singh H et al., (2001) Bioinformatics 17:1236-1237; DeGroot A S, et al. Vaccine 19:4385-4395; DeLalla C, et al., (1999) J. Immunol. 163:1725-1729; Cochlovius B, et al., (2000) J. Immunol. 165:4731-4741; Consogno G, et al. (2003) Blood 101:1039-1044; Roberts C G, et al. (1996) AIDS Res. Hum. Retrovir. 12:593-610; Kwok W, et al. (2001) Trends Immunol. 22:583-588; Novak E J, et al., (2001) J. Immunol. 166: 6665-6670.

An epitope that is used in some embodiments described herein may comprise a naturally occurring or naturally processed epitope as defined using any number of assays known to the skilled artisan and as described herein. Assays for identifying epitopes are known to the skilled artisan and are described, for example, in Current Protocols in Immunology, John E. Coligan, Ada M. Kruisbeek, David H. Margulies, Ethan M. Shevach, and Warren Strober (Eds), John Wiley & Sons, New York. N.Y. Epitopes may be identified using intracellular cytokine staining and flow cytometric analysis such as described in Hoffmeister B., et al., (2003) Methods.; 29(3): 270-281; Maecker H T, et al., (2001) J Immunol Methods 255(1-2):27-40. Similarly, proteins, peptides, overlapping peptides, or pools of peptides can be used in standard chromium release and/or proliferation assays to identify epitopes.

In those cases where antigen-specific T cell lines or clones are available, for example tumor-infiltrating lymphocytes (TIL) or virus-specific CTL, these cells can be used to screen for the presence of the relevant epitopes using target cells prepared with specific antigens. Such targets can be prepared using random, or selected synthetic peptide libraries, which would be utilized to sensitize the target cells for lysis by the CTL. Another approach to identify the relevant epitope when T cell lines or clones are available is to use recombinant DNA methodologies. Gene, or preferably cDNA, libraries from CTL-susceptible targets are first prepared and transfected into non-susceptible target cells. This allows the identification and cloning of the gene coding the protein precursor to the peptide containing the CTL epitope. The second step in this process is to prepare truncated genes from the relevant cloned gene, in order to narrow down the region that encodes for the CTL epitope. This step is optional if the gene is not too large. The third step is to prepare synthetic peptides of approximately 10-20 amino acids of length, overlapping by 5-10 residues, which are used to sensitize targets for the CTL. When a peptide, or peptides, is shown to contain the relevant epitope, smaller peptides can be prepared to establish the peptide of minimal size that contains the epitope.

Alternatively, epitopes may be defined by direct elution of peptides bound by particular MHC molecule and direct sequencing of the peptides (see, for example, Engelhard V H, et al., Cancer J. 2000 May; 6 Suppl. 3: S272-80). Briefly, the eluted peptides are separated using a purification method such as HPLC, and individual fractions are tested for their capacity to sensitize targets for CTL lysis or to induce proliferation of cytokine secretion in HTL. When a fraction has been identified as containing the peptide, it is further purified and submitted to sequence analysis. The peptide sequence can also be determined using tandem mass spectrometry. A synthetic peptide is then prepared and tested with the CTL or HTL to corroborate that the correct sequence and peptide have been identified Epitopes may also be identified using computer analysis, such as the Tsites program, which searches for peptide motifs that have the potential to elicit Th responses. (See, e.g., Rothbard and Taylor, (1988) EMBO J. 7:93-100; Deavin et al., (1996) Mol. Immunol. 33:145-155, 1996). CTL peptides with motifs appropriate for binding to murine and human class I or class II MHC may be identified according to BIMAS (Parker et al., (19944) J. Immunol. 152:163) and other HLA peptide binding prediction analyses. Briefly, the protein sequences for example from viral or tumor cell components are examined for the presence of MHC-binding motifs. These binding motifs which exist for each MHC allele are conserved amino acid residues, usually at positions 2 (or 3) and 9 (or 10) for MHC class I binding peptides of 9-10 residues long. Synthetic peptides are then prepared of those sequences bearing the MHC binding motifs, and subsequently are tested for their ability to bind to MHC molecules. The MHC binding assay can be carried out either using cells which express high number of empty MHC molecules (cellular binding assay), or using purified MHC molecules. Lastly, the MHC binding peptides are then tested for their capacity to induce a CTL response in naive individuals, either in vitro using human lymphocytes, or in vivo using HLA-transgenic animals. These CTL are tested using peptide-sensitized target cells, and targets that naturally process the antigen, such as viral infected cells or tumor cells. To further confirm immunogenicity, a peptide may be tested using an HLA A2 transgenic mouse model and/or any of a variety of in vitro stimulation assays.

Epitopes that are used with embodiments described herein may also be identified using a peptide motif searching program based on algorithms developed by Rammensee, et al. (Hans-Georg Rammensee, Jutta Bachmann, Niels Nikolaus Emmerich, Oskar Alexander Bachor, Stefan Stevanovic: SYFPEITHI: database for MHC ligands and peptide motifs. Immunogenetics (1999) 50: 213-219); by Parker, et. al. (supra), or using methods such as those described by Doytchinova and Flower (2002) Immunol Cell Biol. 80(3):270-9 and Blythe M J, Doytchinova I A, Flower D R. (2002), Bioinformatics 18, 434-439.

In certain embodiments, an epitope may comprise a variant of a native epitope. A "variant," as used herein, is a polypeptide (or a nucleic acid encoding such a polypeptide) that differs from a native polypeptide in one or more substitutions, deletions, additions and/or insertions, such that the immunogenicity of the polypeptide is retained (i.e., the ability of the variant to react with antigen-specific antisera and/or T-cell lines or clones is not substantially diminished relative to the native polypeptide). In other words, the ability of a variant to react with antigen-specific antisera and/or T-cell lines or clones may be enhanced or unchanged, relative to the native polypeptide, or may be diminished by less than 50%, and preferably less than 20% relative to the native polypeptide. In some embodiments, the ability of a variant to react with antigen-specific antisera and/or T-cell lines or clones may be diminished by less than 30%, 25%, 20%, 19%, 18%, 17%, 16%, 15%, 10%, 9%, 8%, 7%, 6%, 5%, 4%, 3%, 2%, 1%, or 0.5%, relative to the native polypeptide. In one embodiment the ability of a variant to react with antigen-specific antisera and/or T-cell lines or clones may be enhanced by at least 30%, 25%, 20%, 19%, 18%, 17%, 16%, 15%, 10%, 9%, 8%, 7%, 6%, 5%, 4%, 3%, 2%, 1%, or 0.5%, relative to the native polypeptide. Such variants may generally be identified by modifying one of the above polypeptide sequences and evaluating the reactivity of the modified polypeptide with antisera and/or T-cells as described herein. In some embodiments, a variant may be identified by evaluating its ability to bind to a human, murine, or nonhuman primate MHC molecule. In preferred embodiments, a variant polypeptide has a modification such that the ability of the variant polypeptide to bind to a class I or class II MHC molecule is increased relative to that of a wild type (unmodified) polypeptide. The skilled artisan recognizes that any number of class I or class II MHC molecules can be used in the context of the embodiments described herein, for example any HLA molecule as identified and available from the IMGT/HLA database.

In more embodiments, the ability of the variant TCE to bind to an HLA molecule is increased by at least 2 fold, preferably at least 3 fold, 4 fold, or 5 fold relative to that of a native polypeptide. It has been found in some embodiments that a relatively small number of substitutions (e.g., 1 to 3) within an epitope can enhance the ability of the epitope to elicit an immune response. Suitable substitutions may generally be identified by using computer programs, as described above, and the effect can be confirmed based on the reactivity of the modified polypeptide with antisera and/or T-cells as described herein. Accordingly, within certain preferred embodiments, a variant in which 1 to 3 amino acid resides within an epitope are substituted such that the ability to react with antigen-specific antisera and/or T-cell lines or clones is statistically greater than that for the unmodified polypeptide. Such substitutions are preferably located within an MHC binding site of the polypeptide, which may be identified as described above. Preferred substitutions allow increased binding to MHC class I or class II molecules.

The CTL or HTL sequences employed in the compositions and methods described herein need not be identical to specific amino acids disclosed in aforementioned disclosures, and can be selected by a variety of techniques, for example, according to certain motifs as described above. Therefore, the epitopes may be subject to various changes, such as insertions, deletions, and substitutions, either conservative or non-conservative, where such changes might provide for certain advantages in their use. Conservative substitutions are discussed above in reference to TABLE 1. Usually, the portion of the sequence which is intended to substantially mimic a CTL or HTL stimulating epitope will not differ by more than about 20% from the corresponding sequence of a native, or naturally occurring antigen, when known, except where additional amino acids may be added at either terminus for the purpose of modifying the physical or chemical properties of the peptide for, e.g., ease of linking or coupling, and the like. In those situations where regions of the peptide sequences are found to be polymorphic among antigen subtypes, it may be desirable to vary one or more particular amino acids to more effectively mimic differing CTL or HTL epitopes of different antigen strains.

In some instances, it may be desirable to combine two or more epitopes that contribute to stimulating specific CTL or HTL responses in one or more patients or histocompatibility types. The epitopes in the composition can be identical or different, and together they can provide equivalent or greater biological activity than the parent peptide(s). For example, using the methods described herein, two or more peptides may define different or overlapping CTL epitopes from a particular region, e.g., the peptide region, e.g., HBenv$_{309-328}$; peptide region HBenv$_{329-349}$, HBenv$_{349-368}$, or peptide region HBc$_{91-110}$, which peptides can be combined in a "cocktail" to provide enhanced immunogenicity of CTL responses, and peptides can be combined with peptides having different MHC restriction elements.

Compositions

As will be understood by those skilled in the art, the nucleic acids of the embodiments disclosed herein can be single-stranded (coding or antisense), or double-stranded, and may be a DNA (genomic, cDNA, or synthetic) or RNA molecule. Additional coding or non-coding sequences may, but need not, be present within a nucleic acid of the embodiments disclosed herein, and a nucleic acid may, but need not, be linked to other molecules and/or support materials.

Embodiments of the invention also include (a) DNA vectors that contain any of the foregoing nucleic acid sequence and/or their complements (i.e., antisense); (b) DNA expression vectors that contain any of the foregoing nucleic acid sequences operatively associated with a regulatory element that directs the expression of the nucleic acid; and (c) genetically engineered host cells that contain any of the foregoing nucleic acid sequences operatively associated with a regulatory element that directs the expression of the coding sequences in the host cell. These recombinant constructs are capable of replicating autonomously in a host cell. Alternatively, the recombinant constructs can become integrated into the chromosomal DNA of a host cell. Such recombinant polynucleotides typically comprise an HCV genomic or cDNA polynucleotide of semi-synthetic or synthetic origin by virtue of human manipulation. Therefore, recombinant nucleic acids comprising these sequences and complements thereof that are not naturally occurring are provided.

Although nucleic acids encoding NS3/4A chimeric peptides or TCE sequences or nucleic acids having sequences that complement the NS3/4A chimeric sequences or TCE sequences as they appear in nature can be employed, they will often be altered, e.g., by deletion, substitution, or insertion, and can be accompanied by sequence not present in nature. As used herein, regulatory elements include, but are not limited to, inducible and non-inducible promoters, enhancers, operators and other elements known to those skilled in the art that drive and regulate expression. Such regulatory elements include, but are not limited to, the cytomegalovirus hCMV immediate early gene, the early or late promoters of SV40 adenovirus, the lac system, the trp system, the TAC system, the TRC system, the major operator and promoter regions of phage A, the control regions of fd coat protein, the promoter for 3-phosphoglycerate kinase, the promoters of acid phosphatase, and the promoters of the yeast-mating factors.

In addition, recombinant NS3/4A chimeric peptide-encoding nucleic acid sequences and their complementary sequences can be engineered so as to modify their processing or expression. For example, and not by way of limitation, the HCV nucleic acids described herein can be combined with a promoter sequence and/or ribosome binding site, or a signal sequence can be inserted upstream of chimeric polypeptide-encoding sequences so as to permit secretion of the peptide and thereby facilitate harvesting or bioavailability. Additionally, a given NS3/4A or TCE nucleic acid can be mutated in vitro or in vivo, to create and/or destroy translation, initiation, and/or termination sequences, or to create variations in coding regions and/or form new restriction sites or destroy pre-existing ones, or to facilitate further in vitro modification. (See, Examples 1 and 2). Any technique for mutagenesis known in the art can be used, including but not limited to, in vitro site-directed mutagenesis. (Hutchinson et al., *J. Biol. Chem.*, 253:6551 (1978)). The nucleic acids encoding the chimeric NS3/4A polypeptides described above, can be manipulated using conventional techniques in molecular biology so as to create recombinant constructs that express the NS3/4A recombinant peptides.

Further, nucleic acids encoding other proteins or domains of other proteins can be joined to nucleic acids encoding an HCV peptide so as to create a fusion protein. Nucleotides encoding fusion proteins can include, but are not limited to, a full length NS3/4A sequence (SEQ. ID. NO.: 2 or SEQ. ID. NO.: 36), mutant NS3/4A sequences (e.g., SEQ. ID. NOs.: 3-11 or 40-220) or a peptide fragment of an NS3/4A sequence fused to an unrelated protein or peptide, such as for example, polyhistidine, hemagglutinin, an enzyme, fluorescent protein, or luminescent protein, as discussed below.

It was discovered that the construct "NS3/4A-pVAX" was significantly more immunogenic in vivo than the construct "NS3-pVAX". Surprisingly, it was also discovered that the codon-optimized NS3/4A containing construct ("MSLF1-pVAX") was more immunogenic in vivo than NS3/4A pVAX. The example below describes these experiments.

EXAMPLE 3

To determine whether a humoral immune response was elicited by the NS3-pVAX and NS3/4A-pVAX vectors, the expression constructs described in Example 1 were purified using the Qiagen DNA purification system, according to the manufacturer's instructions and the purified DNA vectors were used to immunize groups of four to ten Balb/c mice. The plasmids were injected directly into regenerating tibialis anterior (TA) muscles as previously described (Davis et al., *Human Gene Therapy* 4(6):733 (1993)). In brief, mice were injected intramuscularly with 50 µl/TA of 0.01 mM cardiotoxin (Latoxan, Rosans, France) in 0.9% sterile NaCl. Five days later, each TA muscle was injected with 50 µl PBS containing either rNS3 or DNA.

Inbred mouse strains C57/BL6 (H-2b), Balb/C(H-2d), and CBA (H-2k) were obtained from the breeding facility at Möllegard Denmark, Charles River Uppsala, Sweden, or B&K Sollentuna Sweden. All mice were female and were used at 4-8 weeks of age. For monitoring of humoral responses, all mice received a booster injection of 50 µl/TA of plasmid DNA every fourth week. In addition, some mice were given recombinant NS3 (rNS3) protein, which was purified, as described herein. The mice receiving rNS3 were immunized no more than twice. All mice were bled twice a month.

Enzyme immunosorbent assays (EIAs) were used to detect the presence of murine NS3-specific antibodies. These assays were performed essentially as described (Chen et al., *Hepatology* 28(1): 219 (1998)). Briefly, rNS3 was passively adsorbed overnight at 4° C. to 96-well microtiter plates (Nunc, Copenhagen, Denmark) at 1 µg/ml in 50 mM sodium carbonate buffer (pH 9.6). The plates were then blocked by incubation with dilution buffer containing PBS, 2% goat serum, and 1% bovine serum albumin for one hour at 37° C. Serial dilutions of mouse sera starting at 1:60 were then incubated on the plates for one hour. Bound murine serum antibodies were detected by an alkaline phosphatase conjugated goat anti-mouse IgG (Sigma Cell Products, Saint Louis, Mo.) followed by addition of the substrate pNPP (1 tablet/5 ml of 1M Diethanol amine buffer with 0.5 mM $MgCl_2$). The reaction was stopped by addition of 1M NaOH and absorbency was read at 405 nm.

Figure 1A:
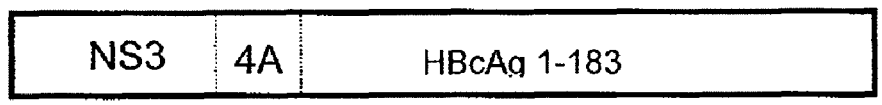
Figure 1B:
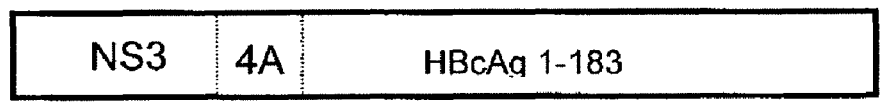
Figure 1C:
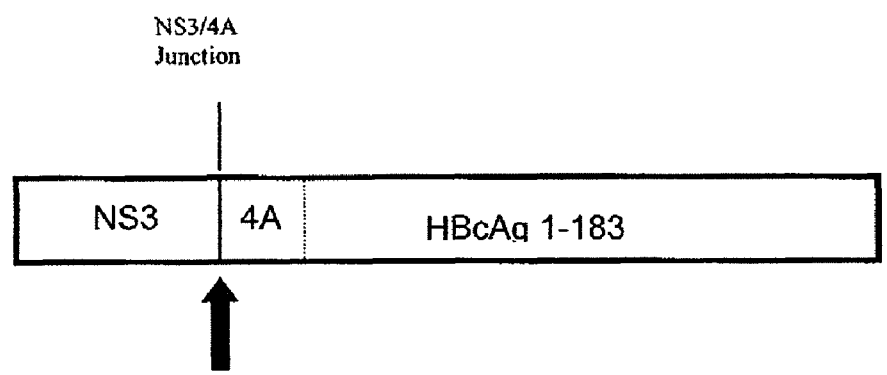
Figure 1D:
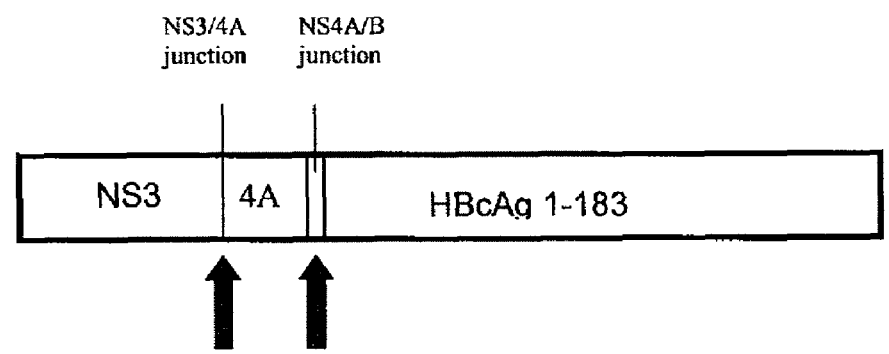
Figure 1E:
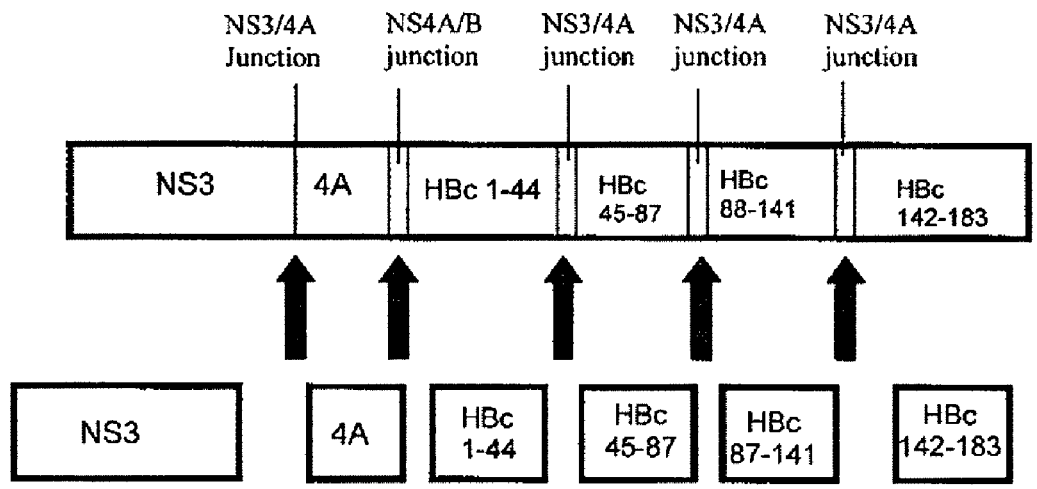
Figure 1F:
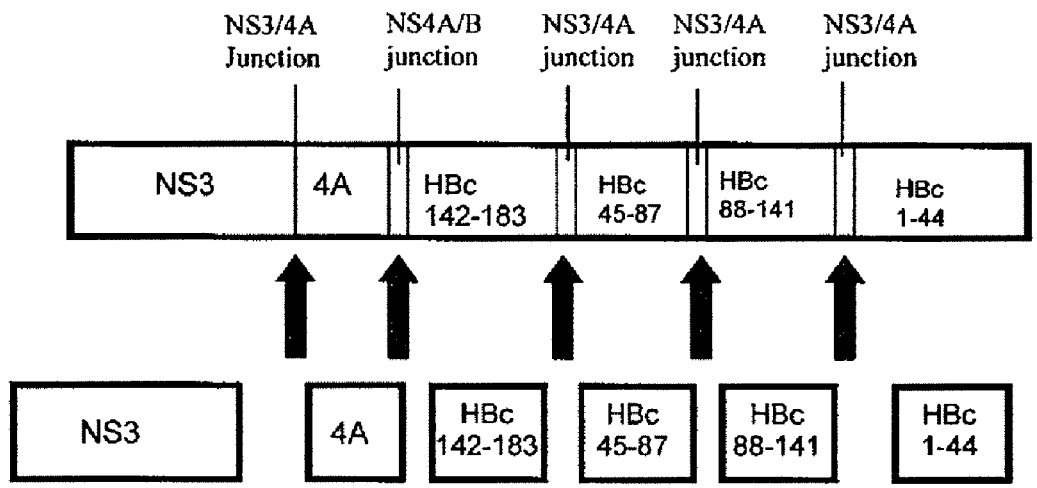
Figure 1G:
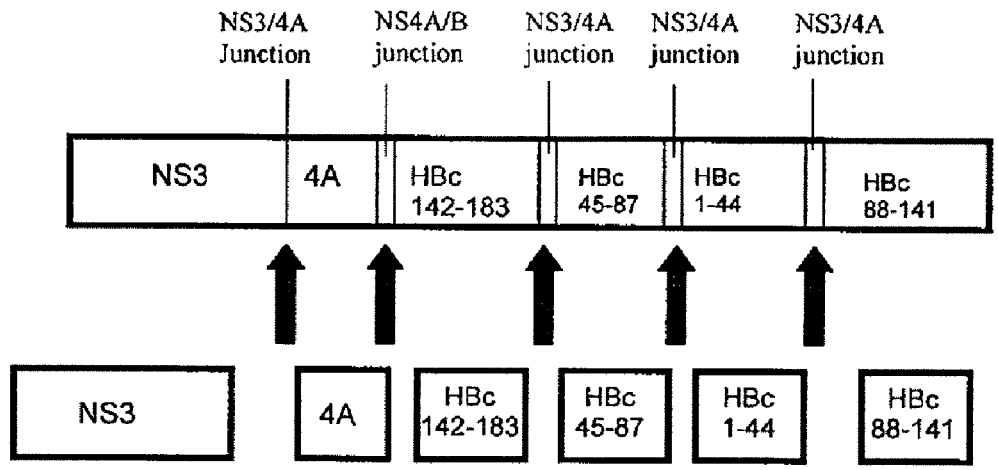
Figure 1H:
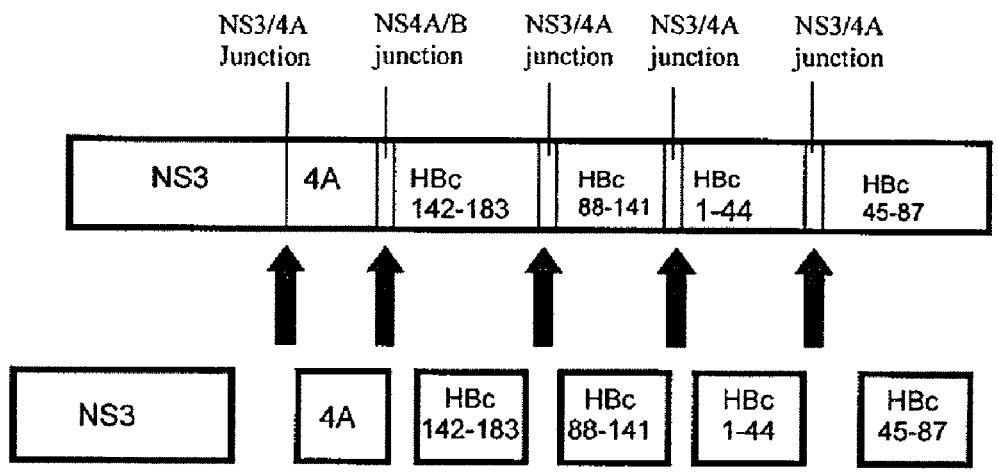
Figure 1I:
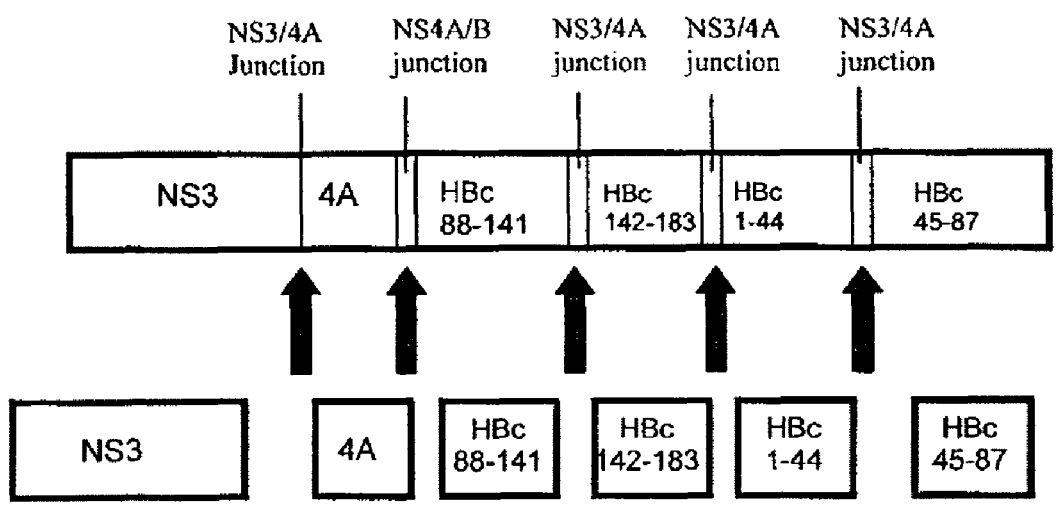
Figure 2:
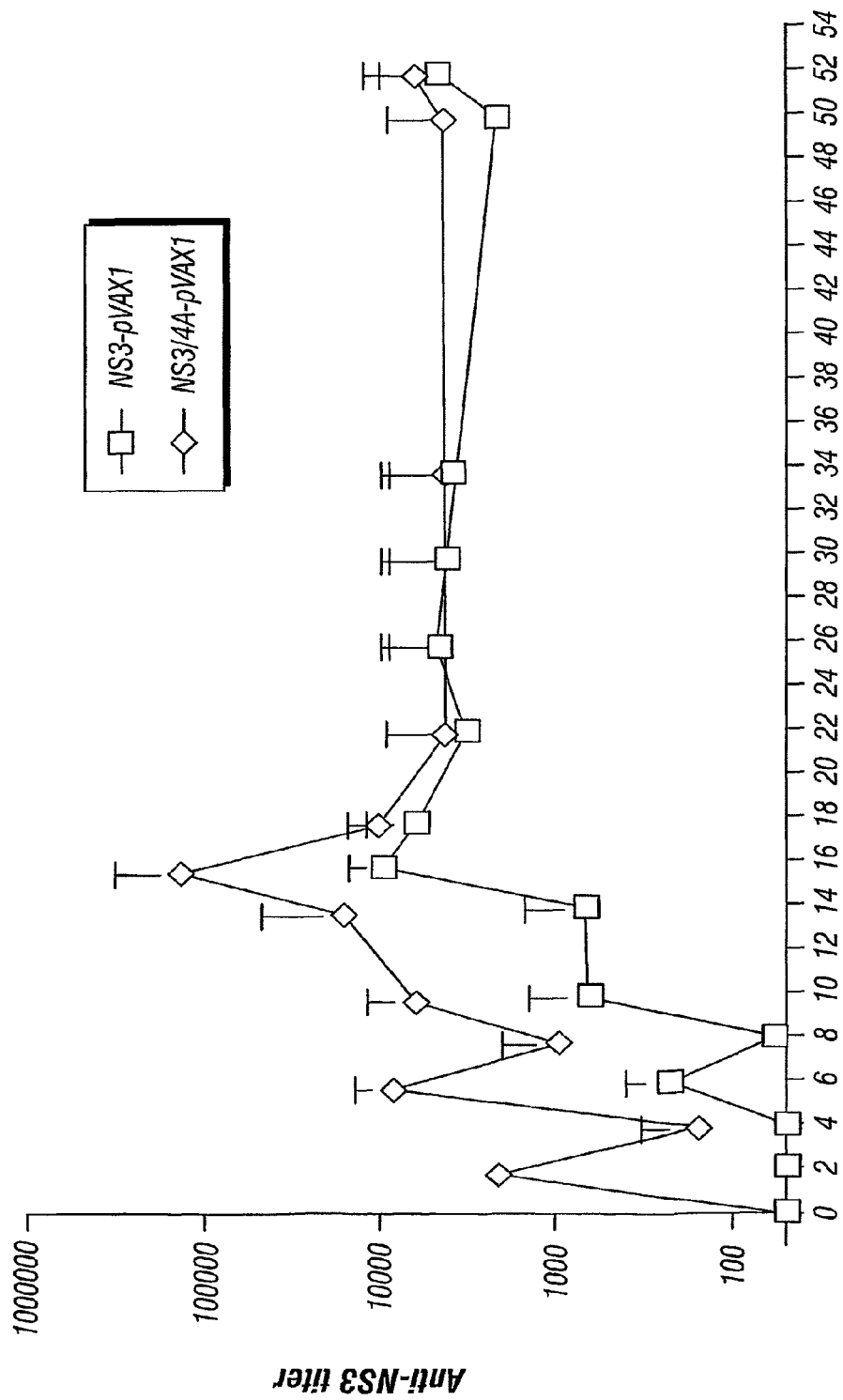

After four weeks, four out of five mice immunized with NS3/4A-pVAX had developed NS3 antibodies, whereas one out of five immunized with NS3-pVAX had developed antibodies (FIG. 2). After six weeks, four out of five mice immunized with NS3/4A-pVAX had developed high levels ($>10^4$) of NS3 antibodies (mean levels 10800±4830) and one had a titer of 2160. Although all mice immunized with NS3-pVAX developed NS3 antibodies, none of them developed levels as high as that produced by the NS3/4A-pVAX construct (mean levels 1800±805). The antibody levels elicited by the NS3/4A fusion construct were significantly higher than those induced by NS3-pVAX at six weeks (mean ranks 7.6 v.s 3.4, p<0.05, Mann-Whitney rank sum test, and p<0.01, Students t-test). Thus, immunization with either NS3-pVAX or NS3/4A-pVAX resulted in the production of NS3-specific antibodies, but the NS3/4A containing construct was a more potent immunogen.

A similar experiment was conducted to compare the immunogenicity of the NS3/4A-pVAX and MSLF1-pVAX constructs. To better resemble a future vaccination schedule in humans, however, the plasmids were delivered to groups of ten mice using a gene gun. In brief, plasmid DNA was linked to gold particles according to protocols supplied by the manufacturer (Bio-Rad Laboratories, Hercules, Calif.). Prior to immunization, the injection area was shaved and the immunization was performed according to the manufacturer's protocol. Each injection dose contained 4 µg of plasmid DNA. Immunizations were performed on weeks 0, 4, and 8.

The MSLF1 gene was found to be more immunogenic than the native NS3/4A gene since NS3-specific antibodies were significantly higher in mice immunized with the MSLF1-pVAX construct at two weeks after the second and third immunization (TABLE 5). These results confirmed that the codon-optimized MSLF1-pVAX was a more potent B cell immunogen than NS3/4A-pVAX.

TABLE 5

| Immunogen | Week | No. of injections | Mean NS3 titre | SD | Mann-Whitney |
|---|---|---|---|---|---|
| NS3/4A | 2 | 1 | 0 | 0 | NS |
| MSLF1 | 2 | 1 | 0 | 0 | |
| NS3/4A | 6 | 2 | 0 | 0 | p < 0.0002 |
| MSLF1 | 6 | 2 | 2484 | 3800 | |
| NS3/4A | 10 | 3 | 60 | 0 | p < 0.0001 |
| MSLF1 | 10 | 3 | 4140 | 4682 | |

The example below provides more evidence that MSLF-1 (coNS3/4a) produces a strong humoral response.

EXAMPLE 3A

To test the intrinsic immunogenicity of the different NS3 genes groups of BALB/c (H-$2^d$) mice were immunized with the following vectors: wtNS3/4A (wild type NS3/4a), coNS3/4A (codon-optimized NS3/4a or MSLF-1), or wtNS3/4A-SFV (wild-type NS3/4A obtained from SFV expression). Doses of 4 μg DNA was administered using the gene gun and doses of $10^7$ SFV particles were injected subcutaneously (s.c.). The mice were boosted after four weeks. The mice immunized with the wtNS3/4A-SFV developed antibodies already after the first injection suggesting a potent immunogenicity (FIGS. 3A and 3B). At two weeks after the second immunization most mice immunized with the coNS3/4A or wtNS3/4A-SFV vectors had developed mean antibody levels over $10^3$ (FIGS. 3A and 3B). In contrast, none of the mice immunized with the wtNS3/4A plasmid had developed detectable NS3-specific antibodies at six weeks (FIGS. 3A and 3B). Thus, both codon optimization and mRNA amplification by SFV results in an increased B cell immunogenicity of the NS3/4A gene.

To indirectly compare the T helper 1 (Th1) and Th2-skewing of the T cell response primed by wtNS3/4A, coNS3/4A, and wtNS3/4A-SFV immunizations the levels of NS3-specific IgG1 (Th2) and IgG2a (Th1) antibodies were analyzed (FIGS. 3A and 3B). The IgG2a/IgG1-ratio in mice immunized with rNS3 with or without adjuvant was always <1 regardless of the murine haplotype, signaling a Th2-dominated response. In contrast, mice immunized i.m. with the wtNS3 (wild-type NS3), wtNS3/4A, or coNS3/4A containing plasmids had Th1-skewed Th-cell responses evidenced by IgG2a/IgG1 ratios of >1 (FIG. 3B). Thus, codon optimization did not change the IgG subclass distribution. When genetically immunizing BALB/c mice with NS3/4A using the gene gun the subclass ratio suggested a mixed Th1/Th2 response (FIG. 3B). It should be noted that the codon optimized plasmid did not display an increased in vitro stimulatory capacity of B cells, as compared to the native plasmid, suggesting that no major immune stimulatory motifs had been lost or introduced.

Immunizations using SFV primed a Th1-, or mixed Th1/Th2-like isotype distribution. The anti-NS3 IgG2a/IgG1-ratio following wtNS3/4A-SFV immunization ranged from 2.4 to 20 between different experiments providing evidence of a Th1-like response. This is similar to the previous experience with SFV vectors where a Th1-skewed IgG subclass distribution was observed.

The example below describes experiments that were performed to determine if mutant NS3/4A peptides, which lack a proteolytic cleavage site, could elicit an immune response to NS3.

EXAMPLE 4

To test if the enhanced immunogenicity of NS3/4A could be solely attributed to the presence of NS4A, or if the NS3/4A fusion protein in addition had to be cleaved at the NS3/4A junction, another set of experiments were performed. In a first experiment, the immunogenicity of the NS3-pVAX, NS3/4A-pVAX, and mutant NS3/4A constructs were compared in Balb/c mice. Mice were immunized on week 0 as described above, and, after two weeks, all mice were bled and the presence of antibodies to NS3 at a serum dilution of 1:60 was determined (TABLE 6). Mice were bled again on week 4. As shown in TABLE 6, all the constructs induced an immune response; the mutant constructs, for example, the NS3/4A-TGT-pVAX vector was comparable to the NS3-pVAX vector (4/10 vs. 0/10; NS, Fisher's exact test). The NS3/4A-pVAX vector, however, was more potent than the mutant constructs.

TABLE 6

| Weeks from 1st immunization | No. of antibody responders to the respective immunogen after one 100 µg i.m immunization | | |
|---|---|---|---|
| | NS3-pVAX | wild-type NS3/4A-pVAX | mutant example NS3/4A-TGT-pVAX |
| 2 | 0/10 | 17/20 | 4/10 |
| 4 | 0/10 (<60) | 20/20 (2415 ± 3715) 55% > $10^3$ 10% > $10^4$ | 10/10 (390 ± 639) 50% > $10^2$ 10% > $10^3$ |

During the chronic phase of infection, HCV replicates in hepatocytes, and spreads within the liver. A major factor in combating chronic and persistent viral infections is the cell-mediated immune defense system. CD4+ and CD8+ lymphocytes infiltrate the liver during the chronic phase of HCV infection, but they are incapable of clearing the virus or preventing liver damage. In addition, persistent HCV infection is associated with the onset of hepatocellular carcinoma (HCC). The examples below describe experiments that were performed to determine whether the NS3, NS3/4A, and MSLF1 constructs were capable of eliciting a T-cell mediated immune response against NS3.

EXAMPLE 5

To study whether the constructs described above were capable of eliciting a cell-mediated response against NS3, an in vivo tumor growth assay was performed. To this end, an SP2/0 tumor cell line (SP2/0-Ag14 myeloma cell line (H-$2^d$)) stably transfected with the NS3/4A gene was made. The SP2/0 cells were maintained in DMEM medium supplemented with 10% fetal calf serum (FCS; Sigma Chemicals, St. Louis, Mo.), 2 mM L-Glutamine, 10 mM HEPES, 100 U/ml Penicillin and 100 µg/ml Streptomycin, 1 mM non-essential amino acids, 50 µM β-mercaptoethanol, 1 mM sodium pyruvate (GIBCO-BRL, Gaithesburgh, Md.). The pcDNA3.1 plasmid containing the NS3/4A gene was linearized by BglII digestion. A total of 5 µg linearized plasmid DNA was mixed with 60 µg transfection reagent (Superfect, Qiagen, Germany) and the mixture was added to a 50% confluent layer of SP2/0 cells in a 35 mm dish. The transfection procedure was performed according to manufacturer's protocol.

Transfected cells were cloned by limiting dilution and selected by addition of 800 µg geneticin (G418)/ml complete DMEM medium after 14 days. A stable NS3/4A-expressing SP2/0 clone was identified using PCR and RTPCR and/or a capture EIA using a monoclonal antibody to NS3. All EIAs for the detection of murine NS3 antibodies were essentially performed as follows. In brief, rNS3 (recombinant NS3 protein produced in E. Coli, dialyzed overnight against PBS, and sterile filtered) was passively adsorbed overnight at 4° C. to 96-well microtiter plates (Nunc, Copenhagen, Denmark) at 1 µg/ml in 50 mM sodium carbonate buffer (pH 9.6). The plates were then blocked by incubation with dilution buffer containing PBS, 2% goat serum, and 1% bovine serum albumin for one hour at +37° C. Serial dilutions of mouse sera starting at 1:60 were then incubated on the plates for one hour. Bound murine serum antibodies were detected by an alkaline phosphatase conjugated goat anti-mouse IgG (Sigma cell products, Saint Louis, Mo. USA) followed by addition of the substrate pNPP (1 tablet/5 ml of 1M Diethanolamine buffer with 0.5 mM MgCl2). The reaction was stopped by addition of 1M NaOH. Absorbance was then read at 405 nm.

The in vivo growth kinetics of the SP2/0 and the NS3/4A-SP2/0 cell lines were then evaluated in Balb/c mice. Mice were injected subcutaneously with $2 \times 10^6$ tumor cells in the right flank. Each day the size of the tumor was determined through the skin. The growth kinetics of the two cell lines was comparable. The mean tumor sizes did not differ between the two cell lines at any time point, for example. (See TABLE 7).

TABLE 7

| Mouse ID | Tumor cell line | Maximum in vivo tumor size at indicated time point | | | | | | | | |
|---|---|---|---|---|---|---|---|---|---|---|
| | | 5 | 6 | 7 | 8 | 11 | 12 | 13 | 14 | 15 |
| 1 | SP2/0 | 1.6 | 2.5 | 4.5 | 6.0 | 10.0 | 10.5 | 11.0 | 12.0 | 12.0 |
| 2 | SP2/0 | 1.0 | 1.0 | 2.0 | 3.0 | 7.5 | 7.5 | 8.0 | 11.5 | 11.5 |
| 3 | SP2/0 | 2.0 | 5.0 | 7.5 | 8.0 | 11.0 | 11.5 | 12.0 | 12.0 | 13.0 |
| 4 | SP2/0 | 4.0 | 7.0 | 8.0 | 10.0 | 13.0 | 15.0 | 16.5 | 16.5 | 17.0 |
| 5 | SP2/0 | 1.0 | 1.0 | 3.0 | 4.0 | 5.0 | 6.0 | 6.0 | 6.0 | 7.0 |
| | Group mean | 1.92 | 3.3 | 5.0 | 6.2 | 9.3 | 10.1 | 10.7 | 11.6 | 12.1 |
| 6 | NS3/4A-SP2/0 | 1.0 | 2.0 | 3.0 | 3.5 | 4.0 | 5.5 | 6.0 | 7.0 | 8.0 |
| 7 | NS3/4A-SP2/0 | 2.0 | 2.5 | 3.0 | 5.0 | 7.0 | 9.0 | 9.5 | 9.5 | 11.0 |
| 8 | NS3/4A-SP2/0 | 1.0 | 2.0 | 3.5 | 3.5 | 9.5 | 11.0 | 12.0 | 14.0 | 14.0 |

TABLE 7-continued

| Mouse ID | Tumor cell line | Maximum in vivo tumor size at indicated time point | | | | | | | |
|---|---|---|---|---|---|---|---|---|---|
| | | 5 | 6 | 7 | 8 | 11 | 12 | 13 | 14 | 15 |
| 9 | NS3/4A-SP2/0 | 1.0 | 1.0 | 2.0 | 6.0 | 11.5 | 13.0 | 14.5 | 16.0 | 18.0 |
| 10 | NS3/4A-SP2/0 | 3.5 | 6.0 | 7.0 | 10.5 | 15.0 | 15.0 | 15.0 | 15.5 | 20.0 |
| Group mean | | 1.7 | 2.7 | 3.7 | 5.7 | 9.4 | 10.7 | 11.4 | 12.4 | 14.2 |
| p-value of student's t-test comparison between group means | | 0.7736 | 0.6918 | 0.4027 | 0.7903 | 0.9670 | 0.7986 | 0.7927 | 0.7508 | 0.4623 |

The example below describes experiments that were performed to determine whether mice immunized with the NS3/4A constructs had developed a T-cell response against NS3.

EXAMPLE 6

To examine whether a T-cell response was elicited by the NS3/4A immunization, the capacity of an immunized mouse's immune defense system to attack the NS3-expressing tumor cell line was assayed. The protocol for testing for in vivo inhibition of tumor growth of the SP2/0 myeloma cell line in Balb/c mice has been described in detail previously (Encke et al., *J. Immunol.* 161:4917 (1998)). Inhibition of tumor growth in this model is dependent on the priming of cytotoxic T lymphocytes (CTLs). In a first set of experiments, groups of ten mice were immunized i.m. five times with one month intervals with either 100 µg NS3-pVAX or 100 µg NS3/4A-pVAX. Two weeks after the last immunization $2 \times 10^6$ SP2/0 or NS3/4A-SP2/0 cells were injected into the right flank of each mouse. Two weeks later the mice were sacrificed and the maximum tumor sizes were measured. There was no difference between the mean SP2/0 and NS3/4A-SP2/0 tumor sizes in the NS3-pVAX immunized mice. (See TABLE 8).

TABLE 8

| Mouse ID | Immunogen | Dose (µg) | Tumor cell line | Tumor growth | Maximum tumor size (mm) |
|---|---|---|---|---|---|
| 1 | NS3-pVAX | 100 | SP2/0 | Yes | 5 |
| 2 | NS3-pVAX | 100 | SP2/0 | Yes | 15 |
| 3 | NS3-pVAX | 100 | SP2/0 | No | — |
| 4 | NS3-pVAX | 100 | SP2/0 | Yes | 6 |

TABLE 8-continued

| 5 | NS3-pVAX | 100 | SP2/0 | Yes | 13 |
|---|---|---|---|---|---|
| | Group total | | | 4/5 | 9.75 ± 4.992 |
| 6 | NS3-pVAX | 100 | NS3/4A-SP2/0 | Yes | 9 |
| 7 | NS3-pVAX | 100 | NS3/4A-SP2/0 | Yes | 8 |
| 8 | NS3-pVAX | 100 | NS3/4A-SP2/0 | Yes | 7 |
| 9 | NS3-pVAX | 100 | NS3/4A-SP2/0 | No | — |
| 10 | NS3-pVAX | 100 | NS3/4A-SP2/0 | No | — |
| | | | | 3/5 | 8.00 ± 1.00 |

Note:
Statistical analysis (StatView): Student's t-test on maximum tumor size. P-values <0.05 are considered significant.
Unpaired t-test for Max diam
Grouping Variable: Column 1
Hypothesized Difference = 0
Row exclusion: NS3DNA-Tumor-001213

| | Mean Diff. | DF | t-Value | P-Value |
|---|---|---|---|---|
| NS3-sp2, NS3-spNS3 | 1.750 | 5 | 0.58 | 0.584 |

Group Info for Max diam
Grouping Variable: Column 1
Row exclusion: NS3DNA-Tumor-001213

| | Count | Mean | Variance | Std. Dev. | Std. Err |
|---|---|---|---|---|---|
| NS3-sp2 | 4 | 9.750 | 24.917 | 4.992 | 2.496 |
| NS3-spNS3 | 3 | 8.000 | 1.000 | 1.000 | 0.57 |

To analyze whether administration of different NS3 containing compositions affected the elicitation of a cell-mediated immune response, mice were immunized with PBS, rNS3, a control DNA, or the NS3/4A construct, and tumor sizes were determined, as described above. The NS3/4A construct was able to elicit a T-cell response sufficient to cause a statistically significant reduction in tumor size (See TABLE 9).

TABLE 9

| Mouse ID | Immunogen | Dose (µg) | Tumor cell line | Anti-NS3 | Tumor growth | Maximum tumor size (mm) |
|---|---|---|---|---|---|---|
| 1 | NS3-pVAX | 10 | NS3/4A-SP2/0 | <60 | + | 12.0 |
| 2 | NS3-pVAX | 10 | NS3/4A-SP2/0 | <60 | + | 20.0 |
| 3 | NS3-pVAX | 10 | NS3/4A-SP2/0 | 60 | + | 18.0 |
| 4 | NS3-pVAX | 10 | NS3/4A-SP2/0 | <60 | + | 13.0 |
| 5 | NS3-pVAX | 10 | NS3/4A-SP2/0 | <60 | + | 17.0 |
| | Group mean | | | 60 | 5/5 | 16.0 ± 3.391 |
| 6 | NS3-pVAX | 100 | NS3/4A-SP2/0 | 2160 | + | 10.0 |
| 7 | NS3-pVAX | 100 | NS3/4A-SP2/0 | <60 | − | — |
| 8 | NS3-pVAX | 100 | NS3/4A-SP2/0 | <60 | − | — |
| 9 | NS3-pVAX | 100 | NS3/4A-SP2/0 | 360 | − | — |
| 10 | NS3-pVAX | 100 | NS3/4A-SP2/0 | <60 | + | 12.5 |

TABLE 9-continued

| | | | | | | |
|---|---|---|---|---|---|---|
| | Group mean | | | 1260 | 2/5 | 11.25 ± 1.768 |
| 11 | NS3/4A-pVAX | 10 | NS3/4A-SP2/0 | <60 | + | 10.0 |
| 12 | NS3/4A-pVAX | 10 | NS3/4A-SP2/0 | <60 | − | — |
| 13 | NS3/4A-pVAX | 10 | NS3/4A-SP2/0 | <60 | − | — |
| 14 | NS3/4A-pVAX | 10 | NS3/4A-SP2/0 | <60 | + | 13.0 |
| 15 | NS3/4A-pVAX | 10 | NS3/4A-SP2/0 | <60 | + | 13.5 |
| | Group mean | | | <60 | 3/5 | 12.167 ± 1.893 |
| 16 | NS3/4A-pVAX | 100 | NS3/4A-SP2/0 | 60 | + | 10.0 |
| 17 | NS3/4A-pVAX | 100 | NS3/4A-SP2/0 | 360 | − | — |
| 18 | NS3/4A-pVAX | 100 | NS3/4A-SP2/0 | 2160 | + | 8.0 |
| 19 | NS3/4A-pVAX | 100 | NS3/4A-SP2/0 | 2160 | + | 12.0 |
| 20 | NS3/4A-pVAX | 100 | NS3/4A-SP2/0 | 2160 | + | 7.0 |
| | Group mean | | | 1380 | 4/5 | 9.25 ± 2.217 |
| 36 | p17-pcDNA3 | 100 | NS3/4A-SP2/0 | <60 | + | 20.0 |
| 37 | p17-pcDNA3 | 100 | NS3/4A-SP2/0 | <60 | + | 7.0 |
| 38 | p17-pcDNA3 | 100 | NS3/4A-SP2/0 | <60 | + | 11.0 |
| 39 | p17-pcDNA3 | 100 | NS3/4A-SP2/0 | <60 | + | 15.0 |
| 40 | p17-pcDNA3 | 100 | NS3/4A-SP2/0 | <60 | + | 18.0 |
| | Group mean | | | <60 | 5/5 | 14.20 ± 5.263 |
| 41 | rNS3/CFA | 20 | NS3/4A-SP2/0 | >466560 | + | 13.0 |
| 42 | rNS3/CFA | 20 | NS3/4A-SP2/0 | >466560 | − | — |
| 43 | rNS3/CFA | 20 | NS3/4A-SP2/0 | >466560 | + | 3.5 |
| 44 | rNS3/CFA | 20 | NS3/4A-SP2/0 | >466560 | + | 22.0 |
| 45 | rNS3/CFA | 20 | NS3/4A-SP2/0 | >466560 | + | 17.0 |
| | Group mean | | | 466560 | 4/5 | 17.333 ± 4.509 |
| 46 | PBS | — | NS3/4A-SP2/0 | <60 | + | 10.0 |
| 47 | PBS | — | NS3/4A-SP2/0 | <60 | + | 16.5 |
| 48 | PBS | — | NS3/4A-SP2/0 | 60 | + | 15.0 |
| 49 | PBS | — | NS3/4A-SP2/0 | <60 | + | 21.0 |
| 50 | PBS | — | NS3/4A-SP2/0 | <60 | + | 15.0 |
| 51 | PBS | — | NS3/4A-SP2/0 | <60 | − | — |
| | Group mean | | | 60 | 5/6 | 15.50 ± 3.937 |

Note:
Statistical analysis (StatView): Student's t-test on maximum tumor size. P-values <0.05 are considered as significant.

Unpaired t-test for Largest Tumor size
Grouping Variable: group
Hypothesized Difference = 0

| | Mean Diff. | DF | t-Value | P-Value |
|---|---|---|---|---|
| p17-sp3-4, NS3-100-sp3-4 | 2.950 | 5 | .739 | .4933 |
| p17-sp3-4, NS3/4-10-sp3-4 | 2.033 | 6 | .628 | .5532 |
| p17-sp3-4, NS3-10-sp3-4 | −1.800 | 8 | −.643 | .5383 |
| p17-sp3-4, NS3/4-100-sp3-4 | 4.950 | 7 | 1.742 | .1250 |
| p17-sp3-4, PBS-sp3-4 | −1.300 | 8 | −.442 | .6700 |
| p17-sp3-4, rNS3-sp3-4 | −3.133 | 6 | −.854 | .4259 |
| NS3-100-sp3-4, NS3/4-10-sp3-4 | −.917 | 3 | −.542 | .6254 |
| NS3-100-sp3-4, NS3-10-sp3-4 | −4.750 | 5 | −1.811 | .1299 |
| NS3-100-sp3-4, NS3/4-100-sp3-4 | 2.000 | 4 | 1.092 | .3360 |
| NS3-100-sp3-4, PBS-sp3-4 | −4.250 | 5 | −1.408 | .2183 |
| NS3-100-sp3-4, rNS3-sp3-4 | −6.083 | 3 | −1.744 | .1795 |
| NS3/4-10-sp3-4, NS3-10-sp3-4 | −3.833 | 6 | −1.763 | .1283 |
| NS3/4-10-sp3-4, NS3/4-100-sp3-4 | 2.917 | 5 | 1.824 | .1277 |
| NS3/4-10-sp3-4, PBS-sp3-4 | −3.333 | 6 | −1.344 | .2274 |
| NS3/4-10-sp3-4, rNS3-sp3-4 | −5.167 | 4 | −1.830 | .1412 |
| NS3-10-sp3-4, NS3/4-100-sp3-4 | 6.750 | 7 | 3.416 | .0112 |
| NS3-10-sp3-4, PBS-sp3-4 | .500 | 8 | .215 | .8350 |
| NS3-10-sp3-4, rNS3-sp3-4 | −1.333 | 6 | −.480 | .6480 |
| NS3/4-100-sp3-4, PBS-sp3-4 | −6.250 | 7 | −2.814 | .0260 |
| NS3/4-100-sp3-4, rNS3-sp3-4 | −8.083 | 5 | −3.179 | .0246 |
| PBS-sp3-4, rNS3-sp3-4 | −1.833 | 6 | −.607 | .5662 |

The example below describes more experiments that were performed to determine whether the reduction in tumor size can be attributed to the generation of NS3-specific T-lymphocytes.

EXAMPLE 7

In the next set of experiments, the inhibition of SP2/0 or NS3/4A-SP2/0 tumor growth was again evaluated in NS3/4A-pVAX immunized Balb/c mice. In mice immunized with the NS3/4A-pVAX plasmid, the growth of NS3/4A-SP2/0 tumor cells was significantly inhibited as compared to growth of the non-transfected SP2/0 cells. (See TABLE 10). Thus, NS3/4A-pVAX immunization elicits CTLs that inhibit growth of cells expressing NS3/4A in vivo.

Figure 3A:
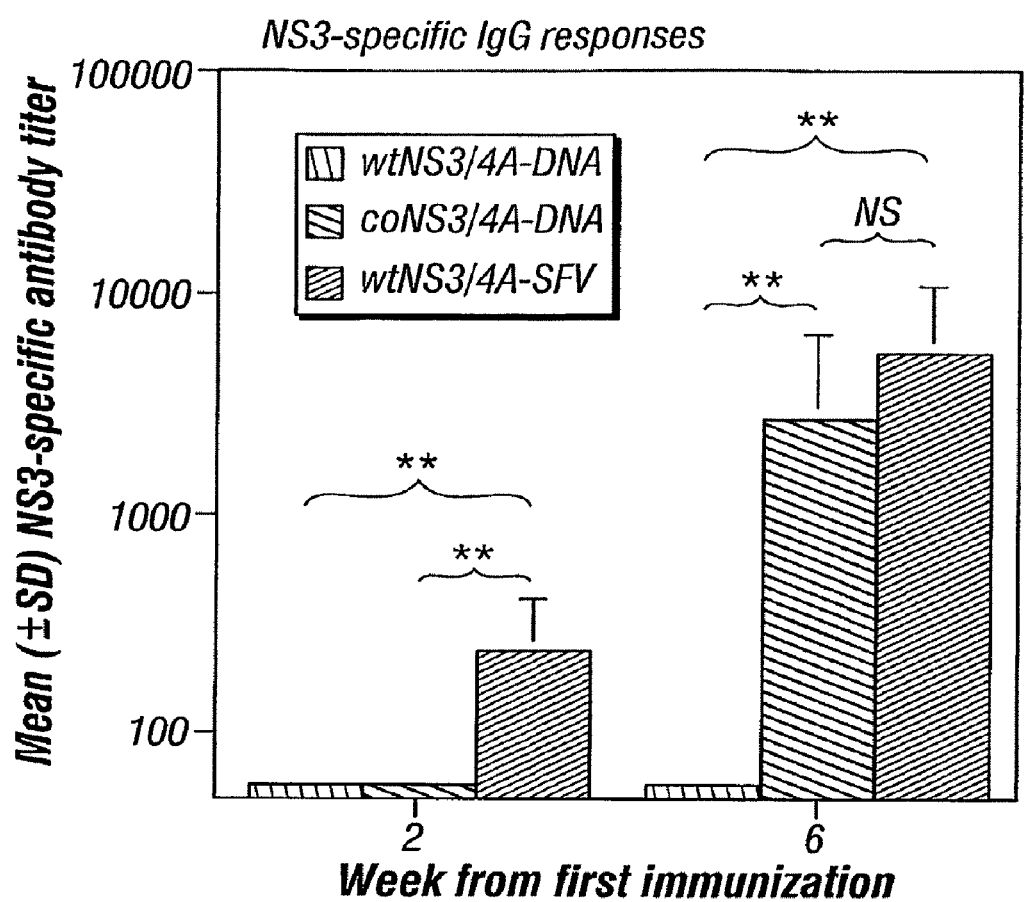
Figure 3B:
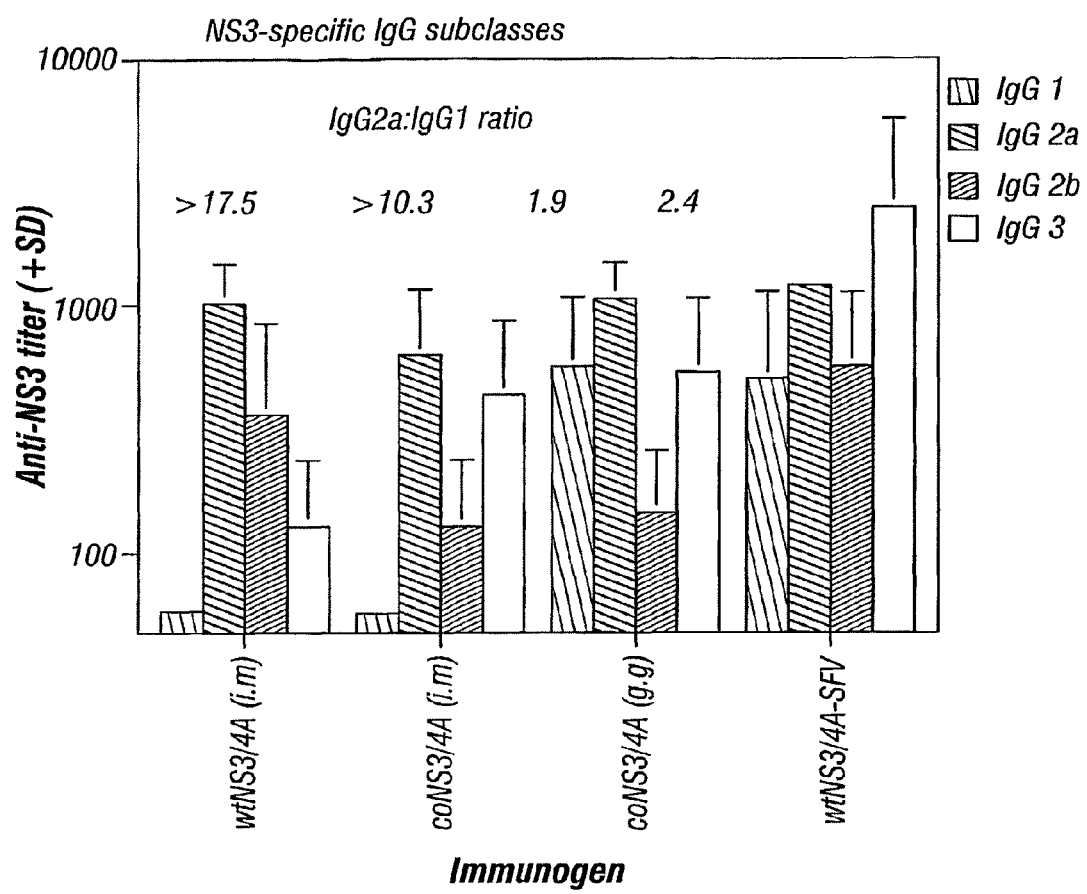
Figure 4A:
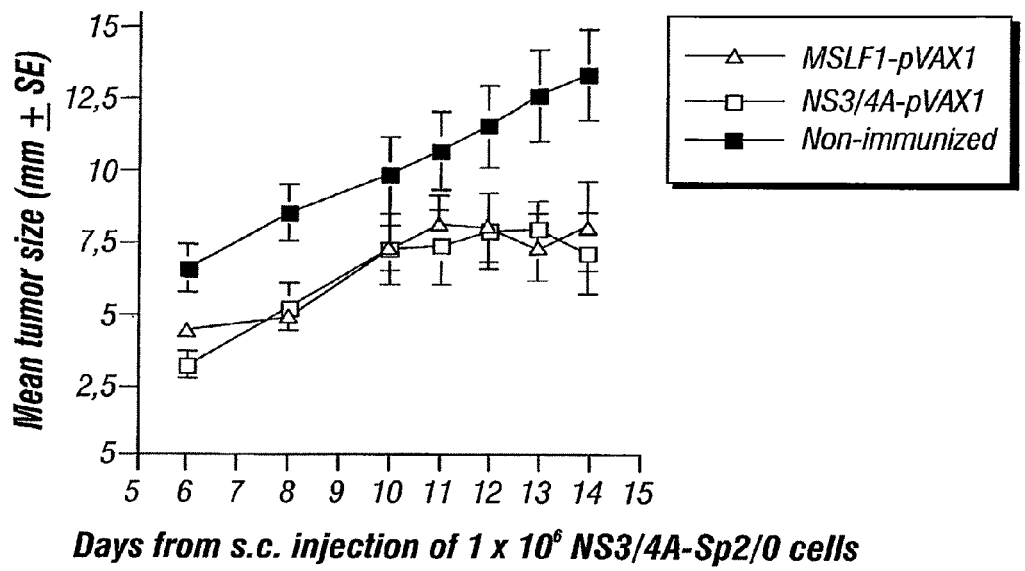
Figure 4B:
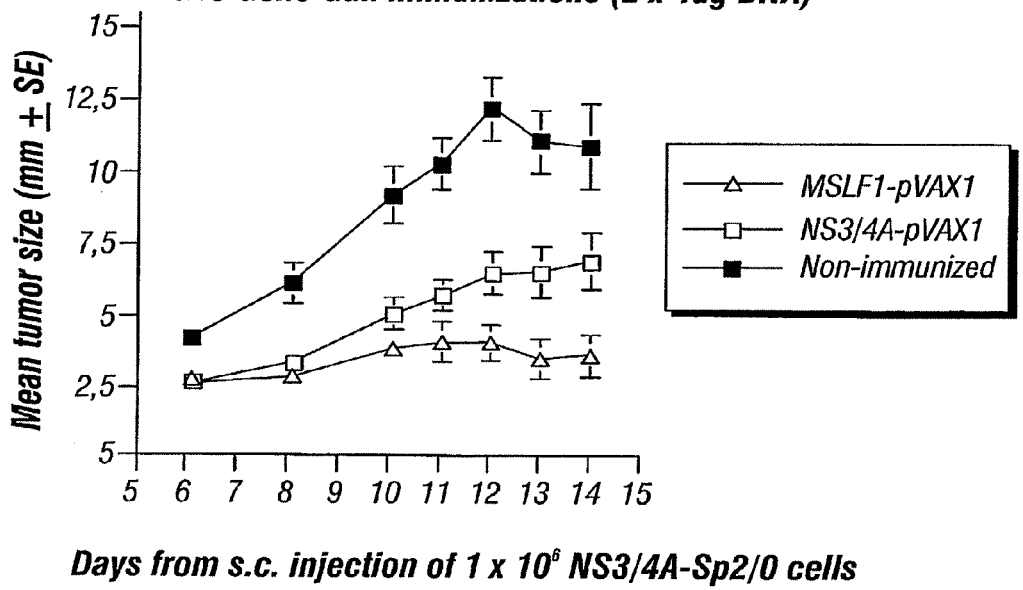
Figure 5:
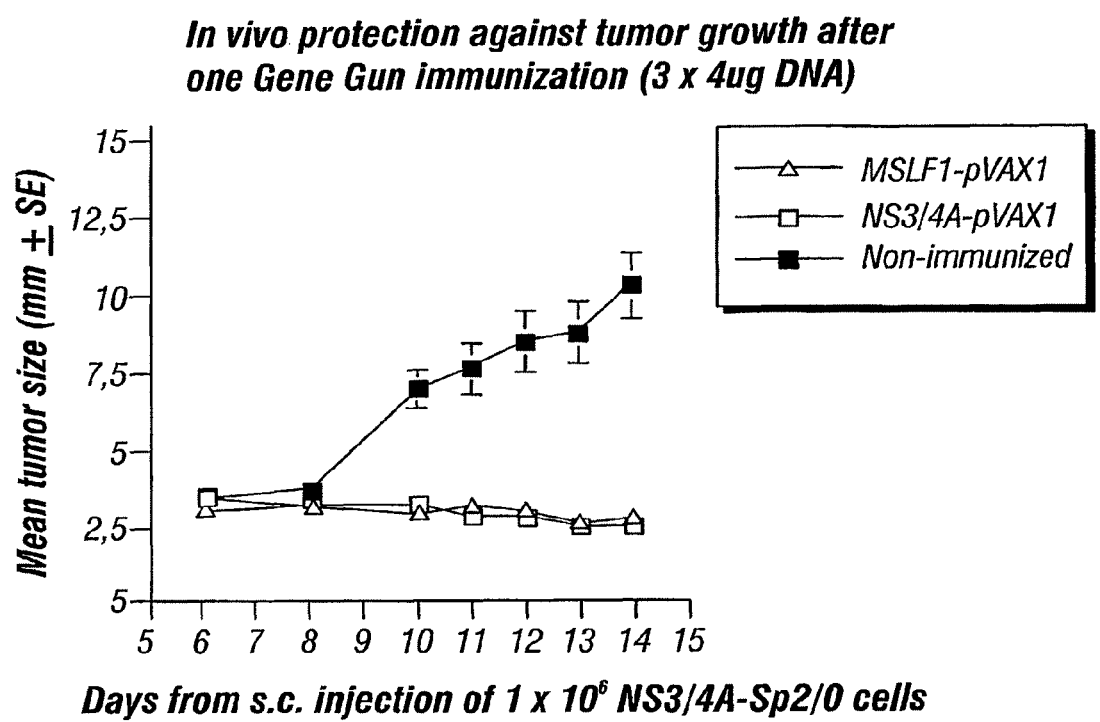

After only a single immunization, tumor inhibiting responses were observed. (See FIG. 3 and TABLE 11). After two immunizations, both the NS3/4A-pVAX and MSLF1-pVAX plasmids primed tumor-inhibiting responses. (See FIG. 4A and TABLE 12). The tumors were significantly smaller in mice immunized with the MSLF1 gene, however, as compared to the native NS3/4A gene. After three injections, both plasmids effectively primed comparable tumor inhibiting responses. (See FIG. 4B and TABLE 13). These experiments provided evidence that the MSLF-1 gene was more efficient in activating tumor inhibiting immune responses in vivo than NS3/4A-pVAX.

TABLE 10

| Mouse ID | Immunogen | Dose (μg) | Tumor cell line | Tumor growth | Maximum tumor size (mm) |
|---|---|---|---|---|---|
| 11 | NS3/4A-pVAX | 100 | SP2/0 | No | — |
| 12 | NS3/4A-pVAX | 100 | SP2/0 | Yes | 24 |
| 13 | NS3/4A-pVAX | 100 | SP2/0 | Yes | 9 |
| 14 | NS3/4A-pVAX | 100 | SP2/0 | Yes | 11 |
| 15 | NS3/4A-pVAX | 100 | SP2/0 | Yes | 25 |
|  |  |  |  | 4/5 | 17.25 ± 8.421 |
| 16 | NS3/4A-pVAX | 100 | NS3/4A-SP2/0 | No | — |
| 17 | NS3/4A-pVAX | 100 | NS3/4A-SP2/0 | Yes | 9 |
| 18 | NS3/4A-pVAX | 100 | NS3/4A-SP2/0 | Yes | 7 |
| 19 | NS3/4A-pVAX | 100 | NS3/4A-SP2/0 | Yes | 5 |
| 20 | NS3/4A-pVAX | 100 | NS3/4A-SP2/0 | Yes | 4 |
|  |  |  |  | 4/5 | 6.25 ± 2.217 |

Note:
Statistical analysis (StatView): Student's t-test on maximum tumor size. P-values <0.05 are considered significant.

Unpaired t-test for Max diam
Grouping Variable: Column 1
Hypothesized Difference = 0
Row exclusion: NS3DNA-Tumor-001213

|  | Mean Diff. | DF | t-Value | P-Value |
|---|---|---|---|---|
| NS3/4-sp2, NS3/4-spNS3 | 11.000 | 6 | 2.526 | 0.044 |

Group Info for Max diam
Grouping Variable: Column 1
Row exclusion: NS3DNA-Tumor-001213

|  | Count | Mean | Variance | Std. Dev. | Std. Err |
|---|---|---|---|---|---|
| NS3/4-sp2 | 4 | 17.250 | 70.917 | 8.421 | 4.211 |
| NS3/4-spNS3 | 4 | 6.250 | 4.917 | 2.217 | 1.109 |

In another set of experiments, the inhibition of NS3/4A-expressing SP2/0 tumor growth was evaluated in MSLF1-pVAX immunized Balb/c mice. In brief, groups of mice were immunized with different immunogens (4 μg of plasmid) using a gene gun at weeks zero, four, eight, twelve, and sixteen. Two weeks after the last immunization approximately $2\times10^6$ NS3/4A-expressing SP2/0 cells were injected s.c into the right flank of the mouse. The kinetics of the tumor growth was then monitored by measuring the tumor size through the skin at days seven, 11, and 13. The mean tumor sizes were calculated and groups were compared using the Mann-Whitney non-parametric test. At day 14 all mice were sacrificed.

TABLE 11

| Group | MSLF1-pVAX1 | NS3/4A-pVAX1 | Non-immunized |
|---|---|---|---|
| MSLF1-pVAX1 | — | N.S. | p < 0.05 |
| NS3/4A-pVAX1 | N.S. | — | p < 0.05 |
| Non-immunized | p < 0.05 | p < 0.05 | — |

TABLE 12

| Group | MSLF1-pVAX1 | NS3/4A-pVAX1 | Non-immunized |
|---|---|---|---|
| MSLF1-pVAX1 | — | p < 0.05 | p < 0.01 |
| NS3/4A-pVAX1 | p < 0.05 | — | p < 0.01 |
| Non-immunized | p < 0.01 | p < 0.01 | — |

TABLE 13

| Group | MSLF1-pVAX1 | NS3/4A-pVAX1 | Non-immunized |
|---|---|---|---|
| MSLF1-pVAX1 | — | N.S. | p < 0.01 |
| NS3/4A-pVAX1 | N.S. | — | p < 0.01 |
| Non-immunized | p < 0.01 | p < 0.01 | — |

The example below describes experiments that were performed to analyze the efficiency of various NS3 containing compositions in eliciting a cell-mediated response to NS3.

EXAMPLE 8

Figure 6A:
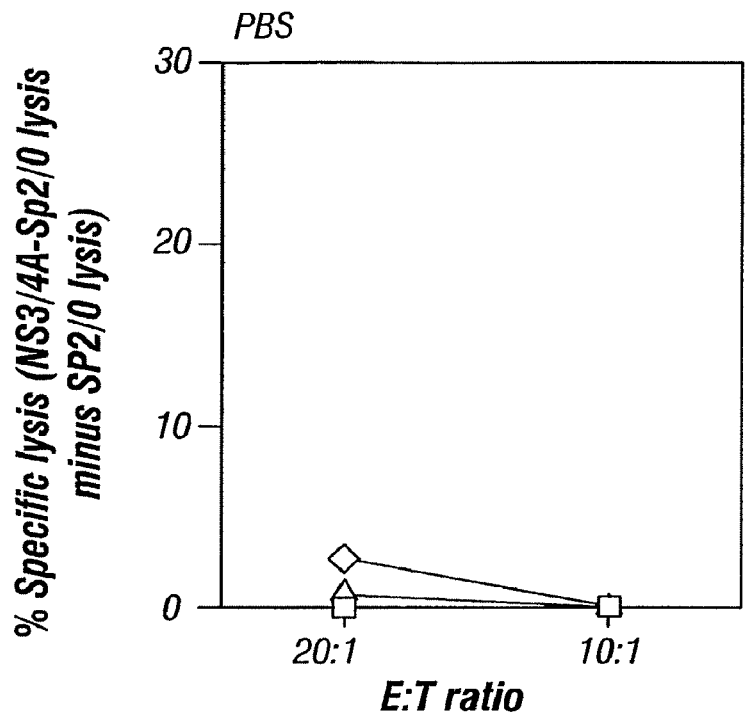
Figure 6B:
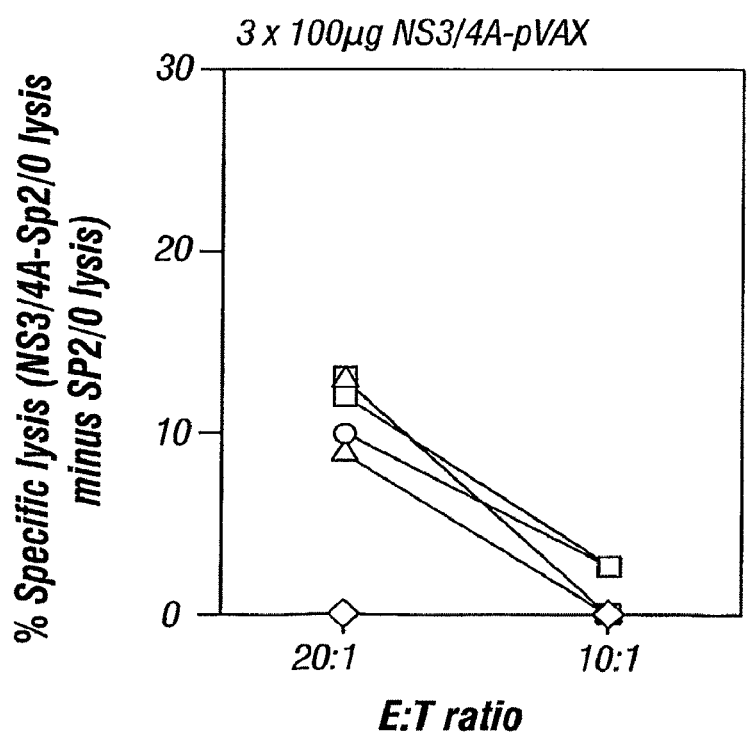
Figure 7A:
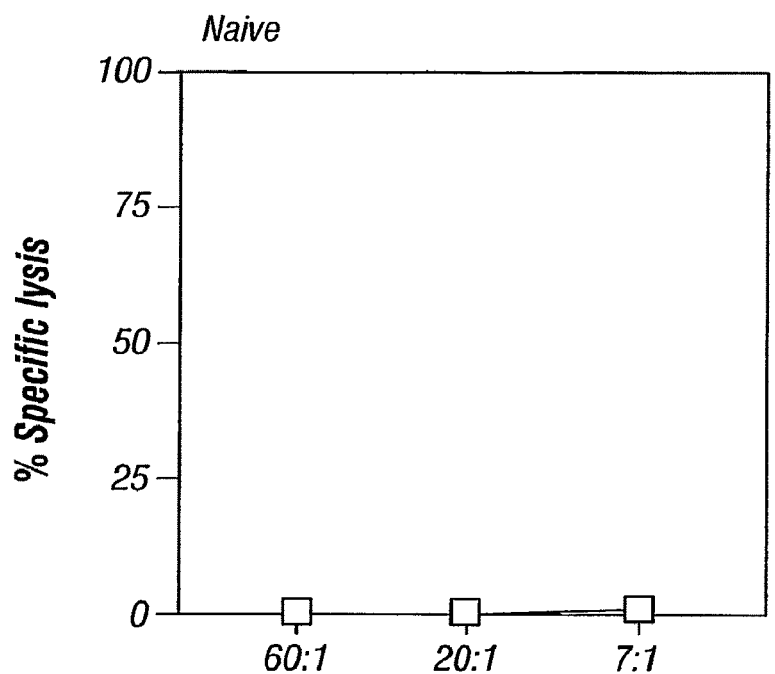
Figure 7B:
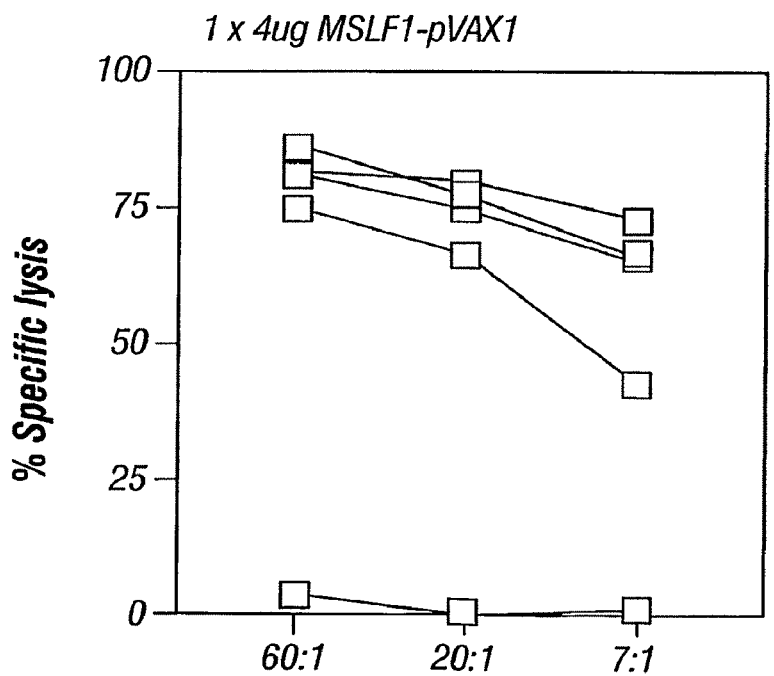
Figure 7C:
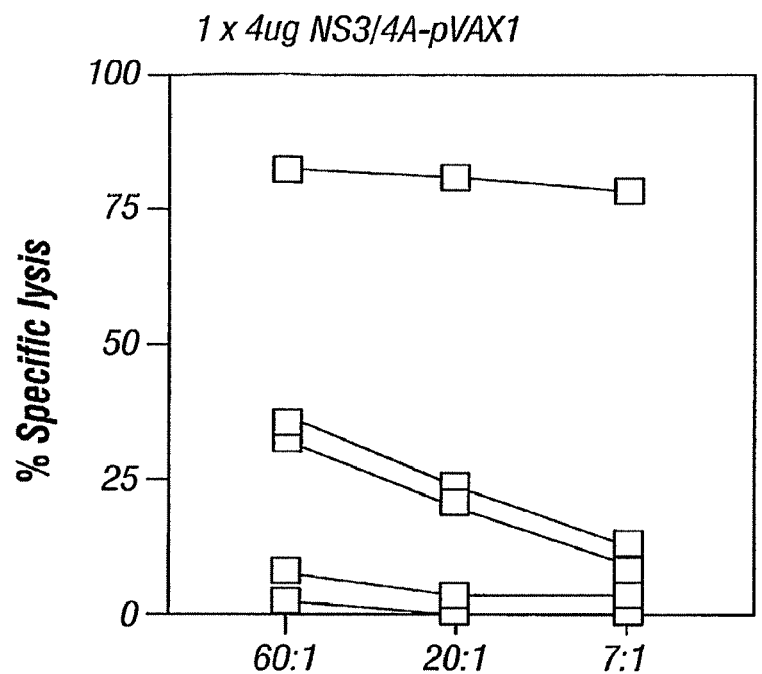
Figure 7D:
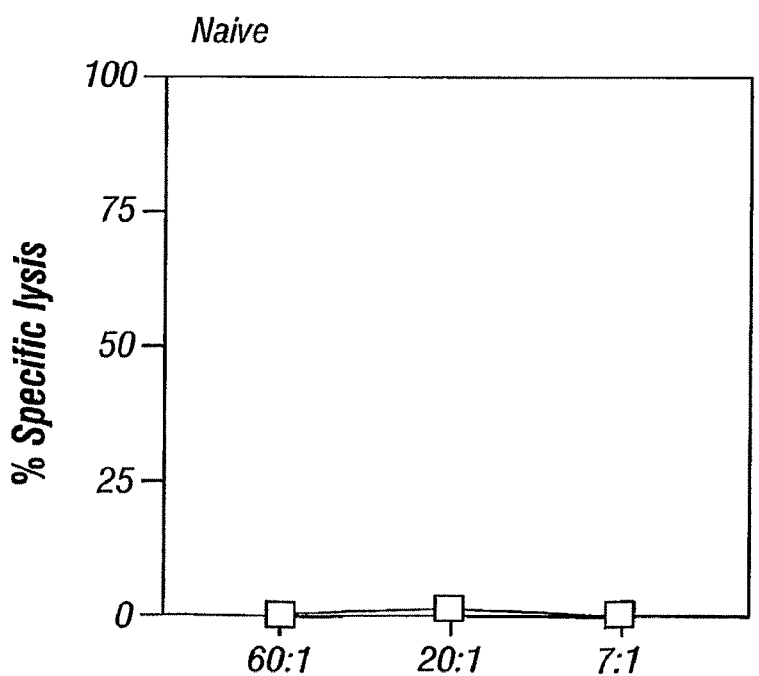
Figure 7E:
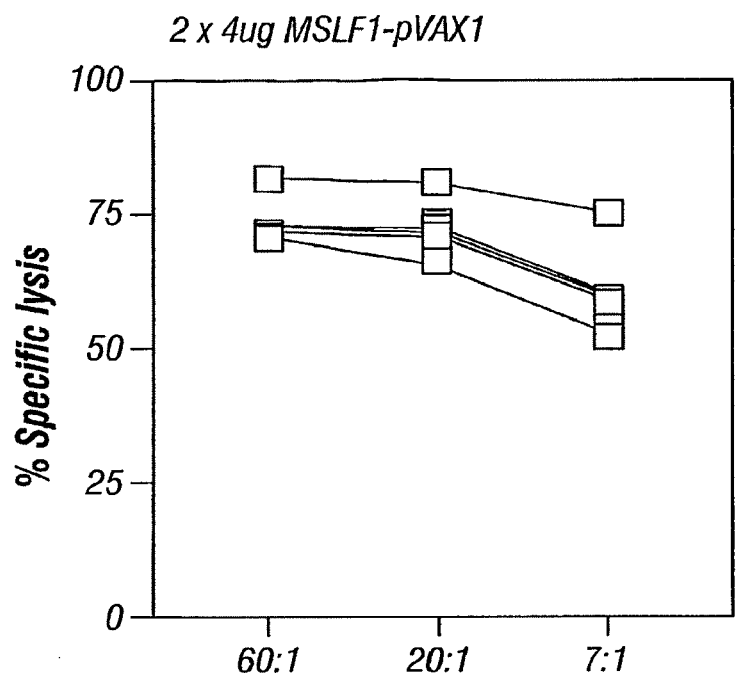
Figure 7F:
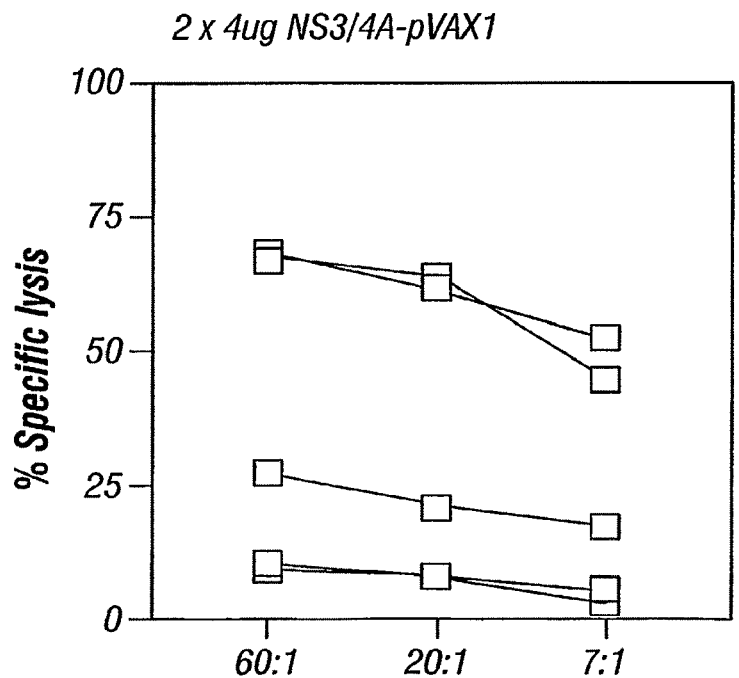
Figure 7G:
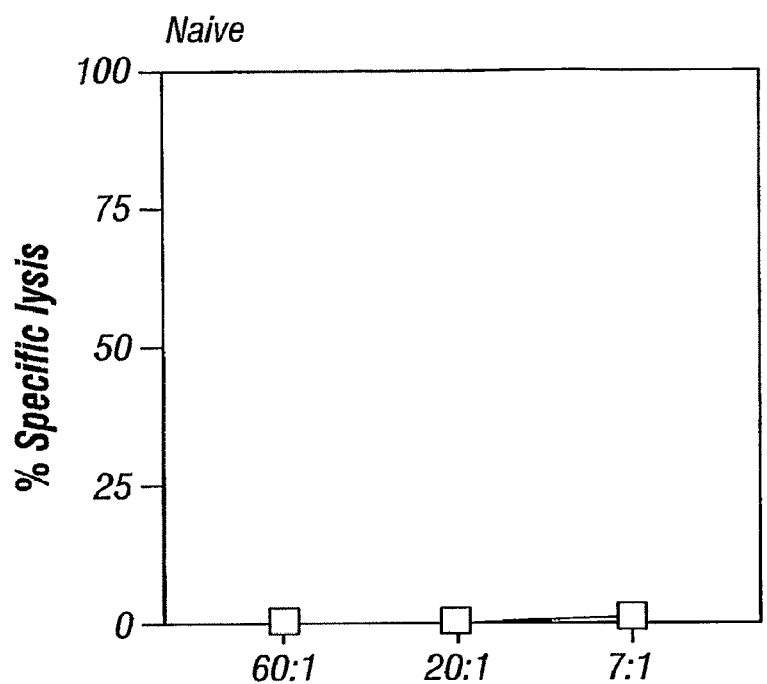
Figure 7H:
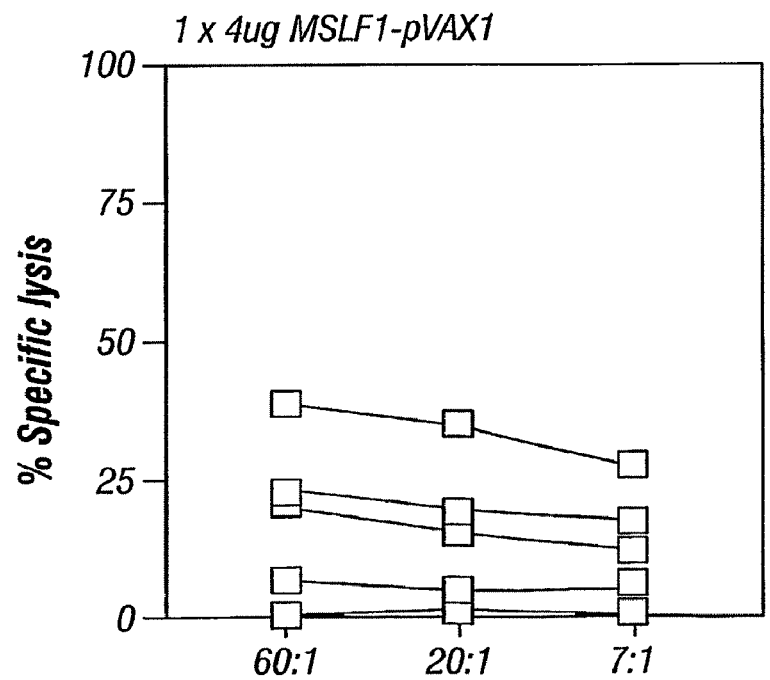
Figure 7I:
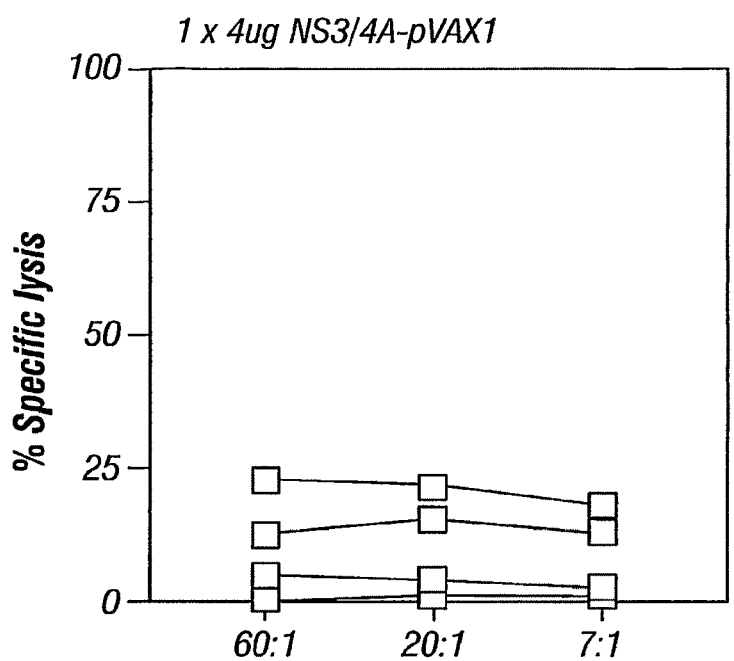
Figure 7J:
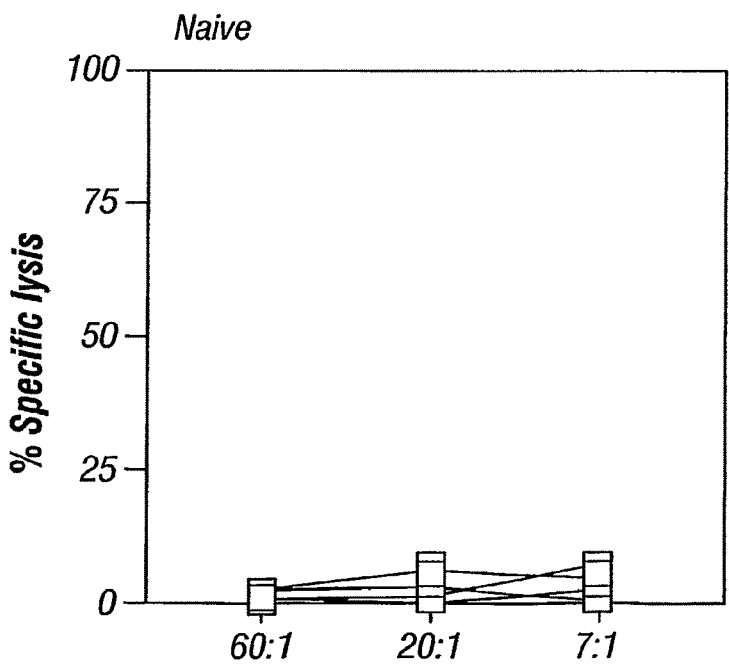
Figure 7K:
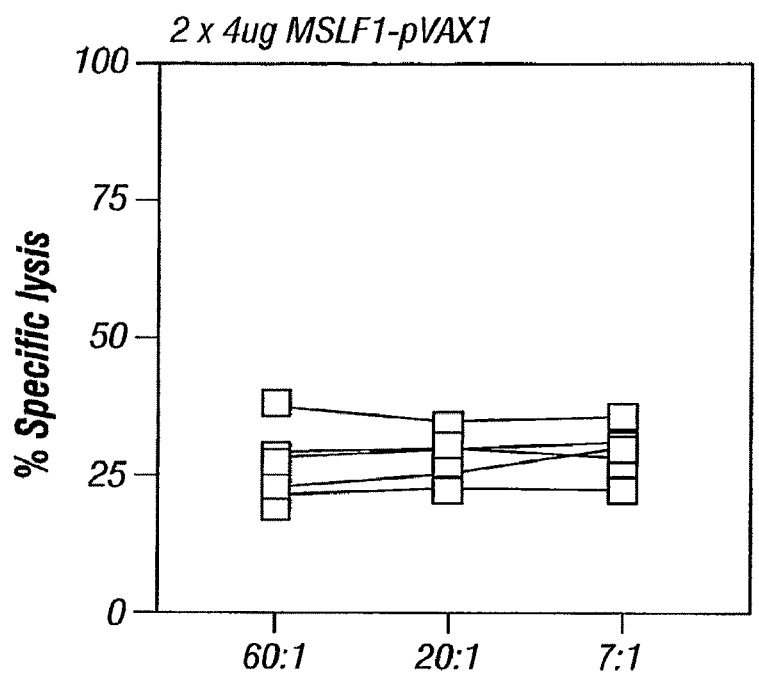
Figure 7L:
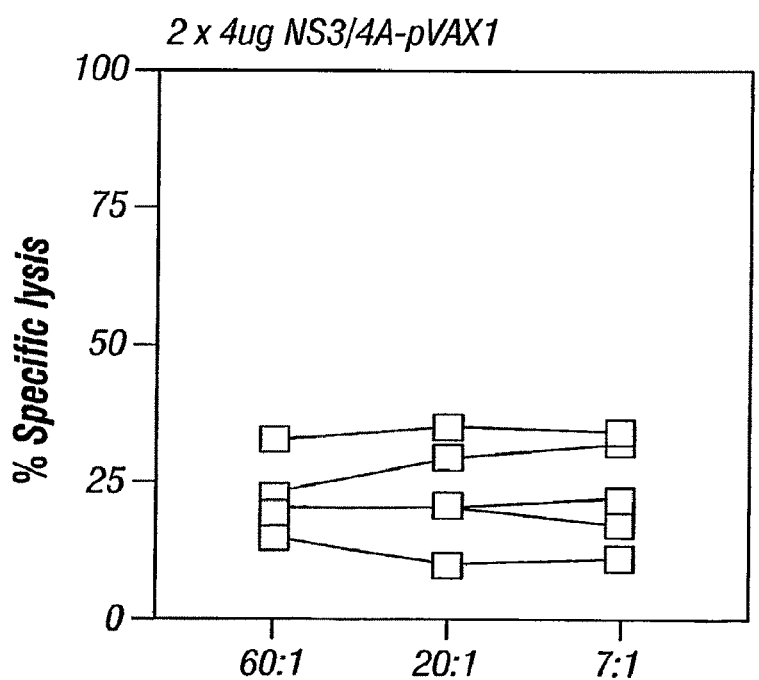

To determine whether NS3-specific T-cells were elicited by the NS3/4A immunizations, an in vitro T-cell mediated tumor cell lysis assay was employed. The assay has been described in detail previously (Sallberg et al., J. Virol. 71:5295 (1997)). In a first set of experiments, groups of five Balb/c mice were immunized three times with 100 μg NS3/4A-pVAX i.m. Two weeks after the last injection the mice were sacrificed and splenocytes were harvested. Re-stimulation cultures with $3\times10^6$ splenocytes and $3\times10^6$ NS3/4A-SP2/0 cells were set. After five days, a standard $Cr^{51}$-release assay was performed using NS3/4A-SP2/0 cells or SP2/0 cells as targets. Percent specific lysis was calculated as the ratio between lysis of NS3/4A-SP2/0 cells and lysis of SP2/0 cells. Mice immunized with NS3/4A-pVAX displayed specific lysis over 10% in four out of five tested mice, using an effector to target ratio of 20:1 (See FIGS. 6A and 6B).

In a next set of experiments, the T cell responses to MSLF1-pVAX and NS3/4A-pVAX were compared. The ability of the two plasmids to prime in vitro detectable CTLs were evaluated in C57/BL6 mice since an H-2b-restricted NS3 epitope had been previously mapped. Groups of mice were immunized with the two plasmids and CTLs were detected in vitro using either peptide coated H-2b expressing RMA-S cells or NS3/4A-expressing EL-4 cells. Briefly, in vitro stimulation was carried out for five days in 25-ml flasks at a final volume of 12 ml, containing 5 U/ml recombinant murine IL-2 (mIL-2; R&D Systems, Minneapolis, Minn.). The restimulation culture contained a total of $40\times10^6$ immune spleen cells and $2\times10^6$ irradiated (10,000 rad) syngenic SP2/0 cells expressing the NS3/4A protein. After five days in vitro stimulation a standard $^{51}Cr$-release assay was performed. Effector cells were harvested and a four-hour $^{51}Cr$ assay was performed in 96-well U-bottom plates in a total volume of 200 μl. A total of $1\times10^6$ target cells was labeled for one hour with 20 μl of $^{51}Cr$ (5 mCi/ml) and then washed three times in PBS. Cytotoxic activity was determined at effector:target (E:T) ratios of 40:1, 20:1, and 10:1, using $5\times10^3$ $^{51}Cr$-labeled target cells/well.

Alternatively, splenocytes were harvested from C57BL/6 mice 12 days after peptide immunization and were resuspended in RPMI 1640 medium supplemented with 10% FCS, 2 mM L-Glutamine, 10 mM HEPES, 100 U/ml Penicillin and 100 μg/ml Streptomycin, 1 mM non-essential amino acids, 50 μM β-mercaptoethanol, 1 mM sodium pyruvate. In vitro stimulation was carried out for five days in 25 ml flasks in a total volume of 12 ml, containing $25\times10^6$ spleen cells and $25\times10^6$ irradiated (2,000 rad) syngeneic splenocytes. The restimulation was performed in the presence of 0.05 μM NS3/4A H-2 $D^b$ binding peptide (sequence GAVQNEVTL SEQ. ID. NO.: 37) or a control peptide H-2 $D^b$ peptide (sequence KAVYNFATM SEQ. ID. NO.: 38). After five days a $^{51}Cr$-release assay was performed. RMA-S target cells were pulsed with 50 μM peptide for 1.5 hrs at +37° C. prior to $^{51}Cr$-labelling, and then washed three times in PBS. Effector cells were harvested and the four hour $^{51}Cr$ assay was performed as described. Cytotoxic activity was determined at the E:T ratios 60:1, 20:1, and 7:1 with $5\times10^3$ $^{51}Cr$-labeled target cells/well. By these assays, it was determined that the MSLF1 gene primed higher levels of in vitro lytic activity compared to the NS3/4A-pVAX vector. (See FIG. 7A-7L). Similar results were obtained with both the peptide coated H-2b expressing RMA-S cells and NS3/4A-expressing EL-4 cells.

Additional evidence that the codon-optimized MSLF1 gene primed NS3-specific CTLs more effectively than the native NS3/4A gene was obtained using flow cytometry. The frequency of NS3/4A-peptide specific CD8+ T cells were analyzed by ex-vivo staining of spleen cells from NS3/4A DNA immunized mice with recombinant soluble dimeric mouse H-2 $D^b$:Ig fusion protein. Many of the monoclonal antibodies and MHC:Ig fusion proteins described herein were purchased from BDB Pharmingen (San Diego, Calif.); Anti-CD16/CD32 (Fc-Block™, clone 2.4G2), FITC conjugated anti-CD8 (clone 53-6.7), FITC conjugated anti-H-2 $K^b$ (clone AF6-88.5), FITC conjugated anti-H-2 $D^b$ (clone KH95), recombinant soluble dimeric mouse H-2$D^b$:Ig, PE conjugated Rat-α Mouse IgG1 (clone X56).

Approximately, $2\times10^6$ spleen cells resuspended in 100 μl PBS/1% FCS (FACS buffer) were incubated with 1 μg/$10^6$ cells of Fc-blocking antibodies on ice for 15 minutes. The cells were then incubated on ice for 1.5 hrs with either 2 μg/$10^6$ cells of H-2$D^b$:Ig preloaded for 48 hours at +4° C. with 640 nM excess of NS3/4A derived peptide (sequence GAVQNEVTL SEQ. ID. NO.: 37) or 2 μg/$10^6$ cells of unloaded H-2 $D^b$:Ig fusion protein. The cells were then washed twice in FACS buffer and resuspended in 100 μl FACS buffer containing 10 μl/100 μl PE conjugated Rat-α Mouse IgG1 secondary antibody and incubated on ice for 30 minutes. The cells were then washed twice in FACS buffer and incubated with 1 μg/$10^6$ cells of FITC conjugated α-mouse CD8 antibody for 30 minutes. The cells were then washed twice in FACS buffer and resuspended in 0.5 ml FACS buffer containing 0.5 μg/ml of PI. Approximately 200,000 events from each sample were acquired on a FACS Calibur (BDB) and dead cells (PI positive cells) were excluded from the analysis.

The advantage of quantifying specific CTLs by FACS analysis is that it bypasses the possible disadvantages of in vitro expansion of CTLs in vitro prior to analysis. Direct ex-vivo quantification of NS3-specific CTLs using NS3-peptide loaded divalent H-2$D^b$:Ig fusion protein molecules revealed that the codon optimized MSLF-1 gene primed a effectively primed NS3-specific CTLs already after two immunizations, whereas the original NS3/4A gene did not. Thus, the optimized MSLF-1 gene effectively primes NS3-specific CTLs that are of higher frequency and of better functionality by all parameters tested, as compared to the original NS3/4A gene. The example below provides more evidence that codon optimized NS3/4A efficiently primes NS3 specific cytotoxic T cells.

EXAMPLE 8A

Figure 8A:
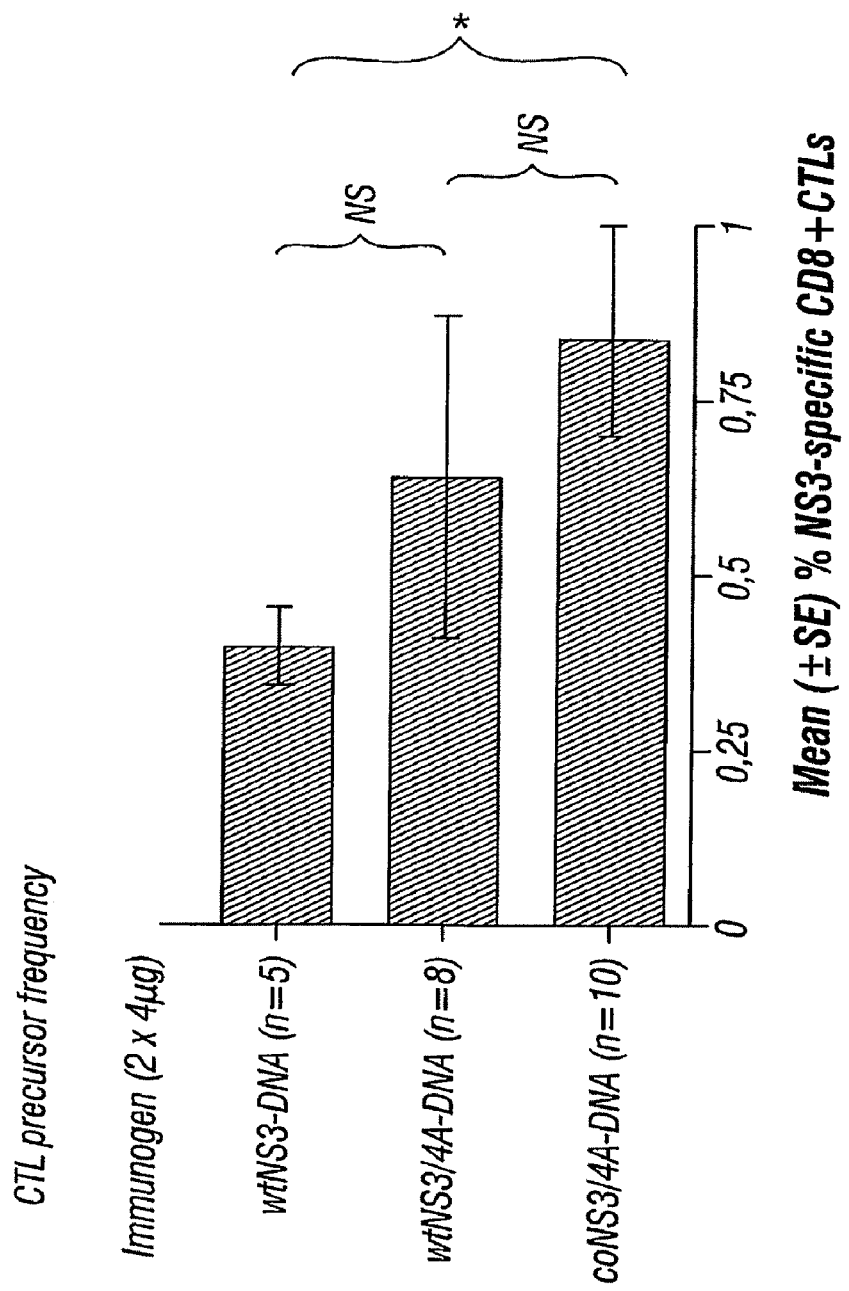
Figure 8B:
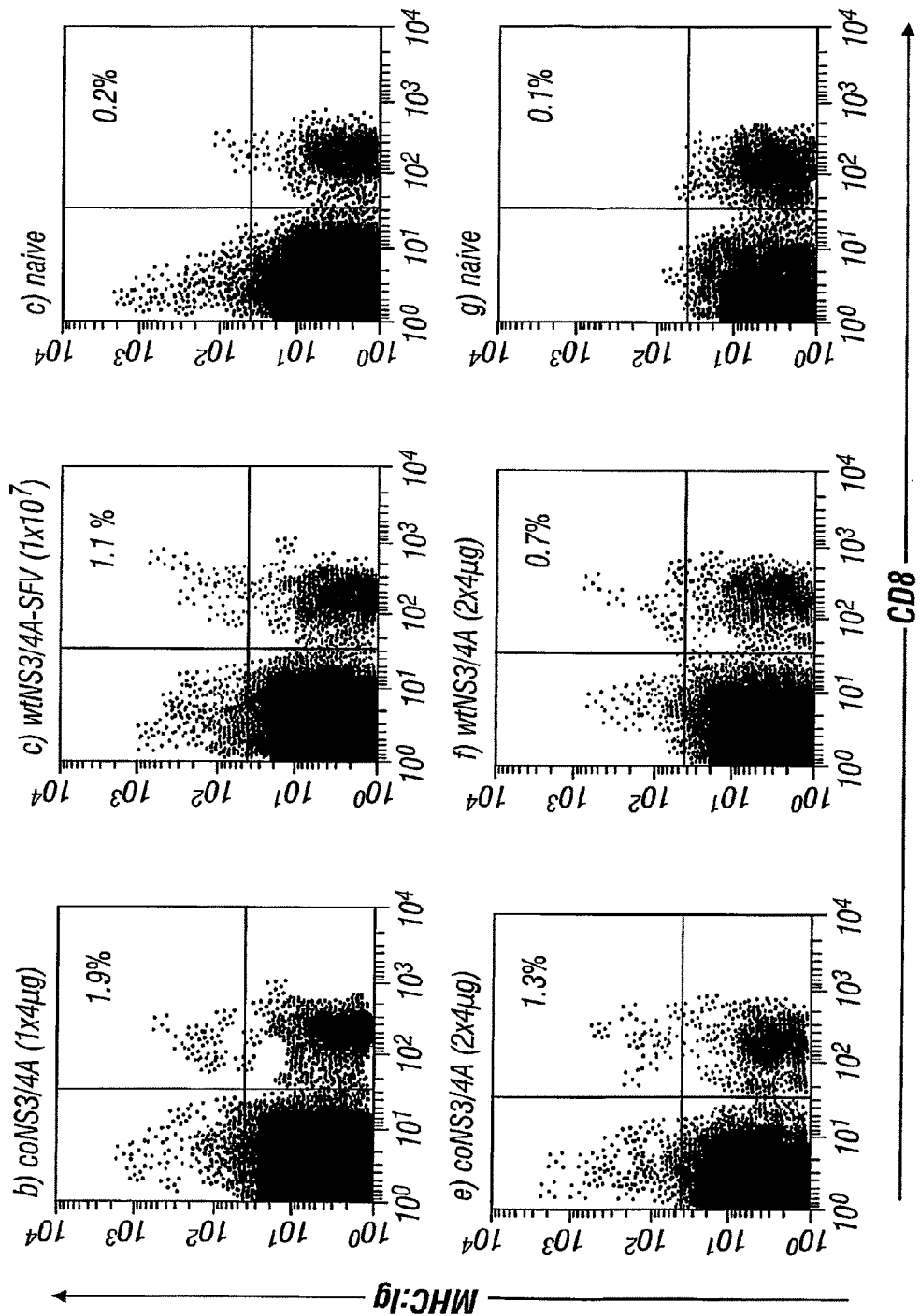
Figure 8B:
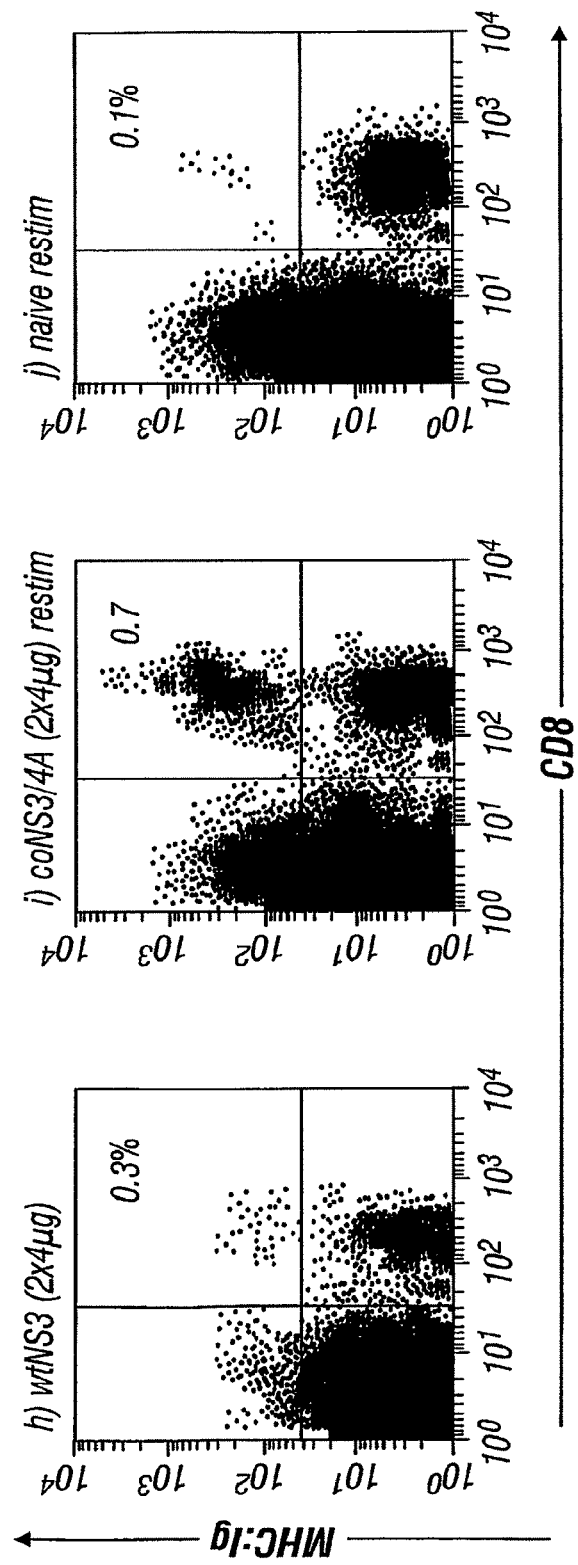

Initially, the frequency of NS3-specific CTLs that could be primed by gene gun immunization using the wtNS3, wtNS3/4A and coNS3/4A expressing plasmids was determined. The coNS3/4A plasmid primed higher precursor frequencies of NS3-specific CTL as compared to the wtNS3 gene enforcing the importance of NS4A (FIG. 8A). No statistical difference in CTL precursor frequencies was noted between the wtNS3/4A and coNS3/4A expressing plasmids when analyzed directly ex vivo (FIG. 8A). A single immunization with the coNS3/4A plasmid or wtNS3/4A-SFV primed around 1% of peptide-specific CTLs within two weeks from immunization (FIG. 8A). The specificity of the detection of NS3-specific CTLs was confirmed by a five-day restimulation in vitro with the NS3-peptide, by which high precursor frequencies were observed after immunization with the coNS3/4A gene (FIG. 8A).

Figure 9A:
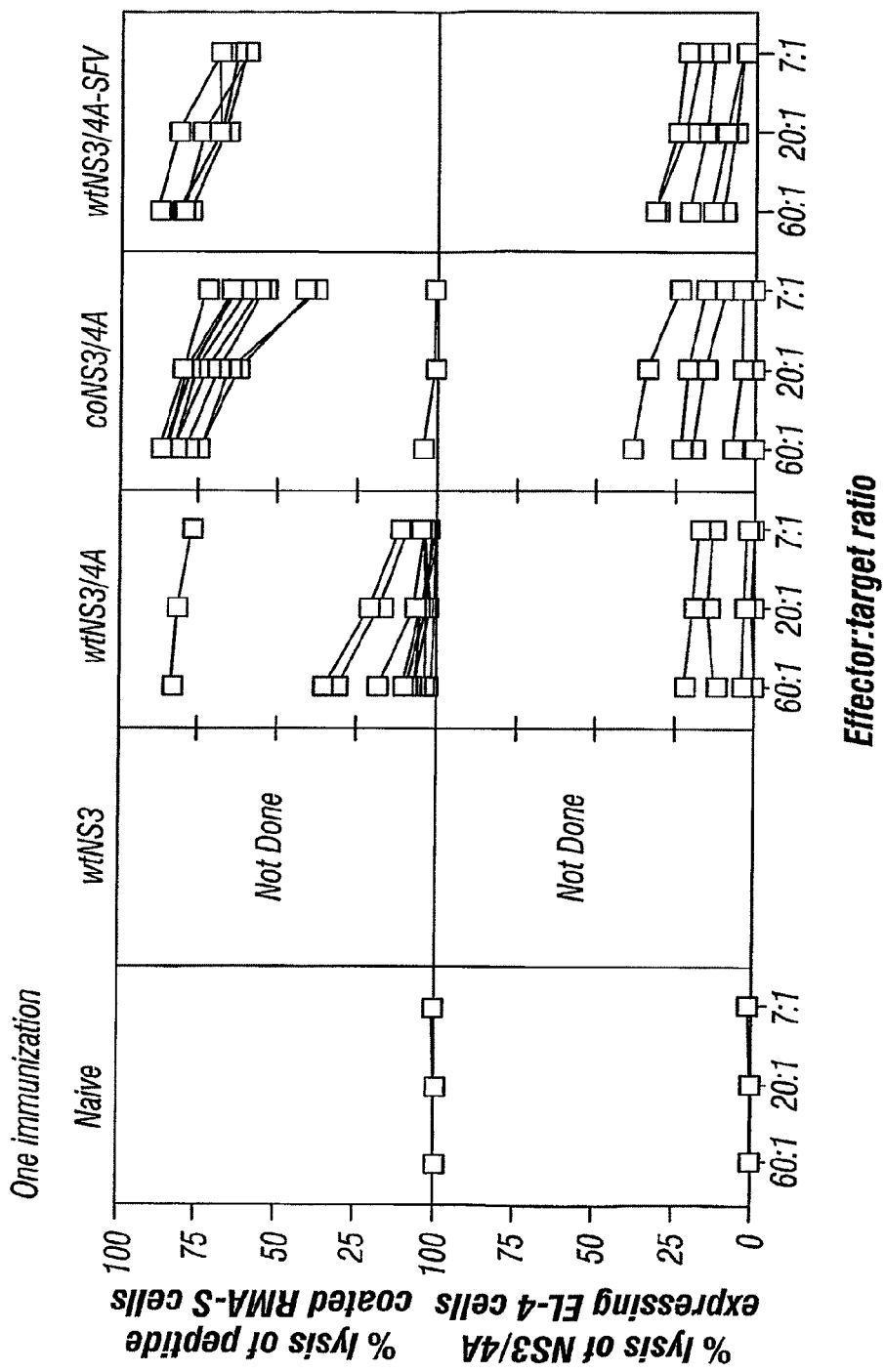
Figure 9B:
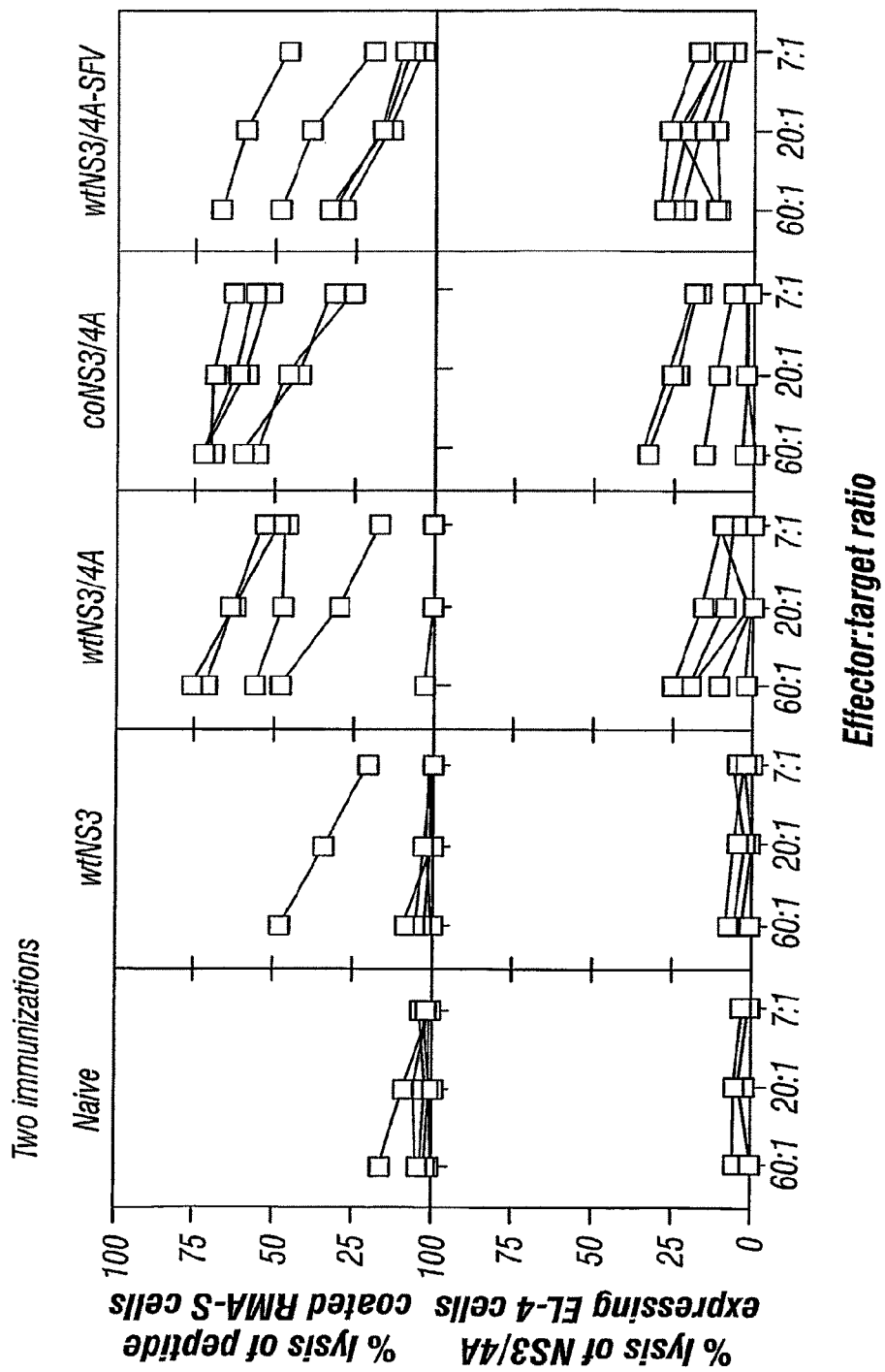

To directly compare the in vitro lytic activity of the NS3-specific CTLs primed by different vectors, a standard $^{51}$Cr-release assay was performed after one or two immunizations. The lytic activity of the in vivo primed CTLs were assayed on both NS3-peptide loaded H-2 $D^b$ expressing RMA-S cells and EL-4 cells stably expressing NS3/4A. After one dose, the coNS3/4A plasmid and the wtNS3/4A-SFV vector was clearly more efficient than the wtNS3/4A plasmid in priming CTLs that lysed NS3-peptide coated target cells (FIGS. 9A and 9B). Thus, the CTL priming event was enhanced by codon optimization or mRNA amplification of the NS3/4A gene. The difference was less clear when using the NS3/4A-expressing EL-4 cells presumably since this assay is less sensitive (FIGS. 9A and 9B). After two immunizations all NS3/4A vectors seemed to prime NS3-specific CTLs with a similar efficiency (FIG. 9B). However, two immunizations with any of the NS3/4A-containing vectors were clearly more efficient in priming NS3-specific CTLs as compared to the plasmid containing only the wtNS3 gene (FIG. 9B), which is fully consistent with the CTL precursor analysis and previous observations. Thus, codon optimization or mRNA amplification of the NS3/4A gene more rapidly primes NS3-specific CTLs.

Analysis of the inhibition of tumor growth in vivo in BALB/c mice using SP2/0 myeloma cells, or in C57BL/6 mice using EL-4 lymphoma cells, expressing an HCV viral antigen is recognized by those in the field to represent the in vivo functional HCV-specific immune response. (See Encke J et al., J Immunol 161: 4917-4923 (1998)). An SP2/0 cell line stably expressing NS3/4A has previously been described (see Frelin L et al., Gene Ther 10: 686-699 (2003)) and an NS3/4A expressing EL-4 cell line was characterized as described below.

Figure 10A:
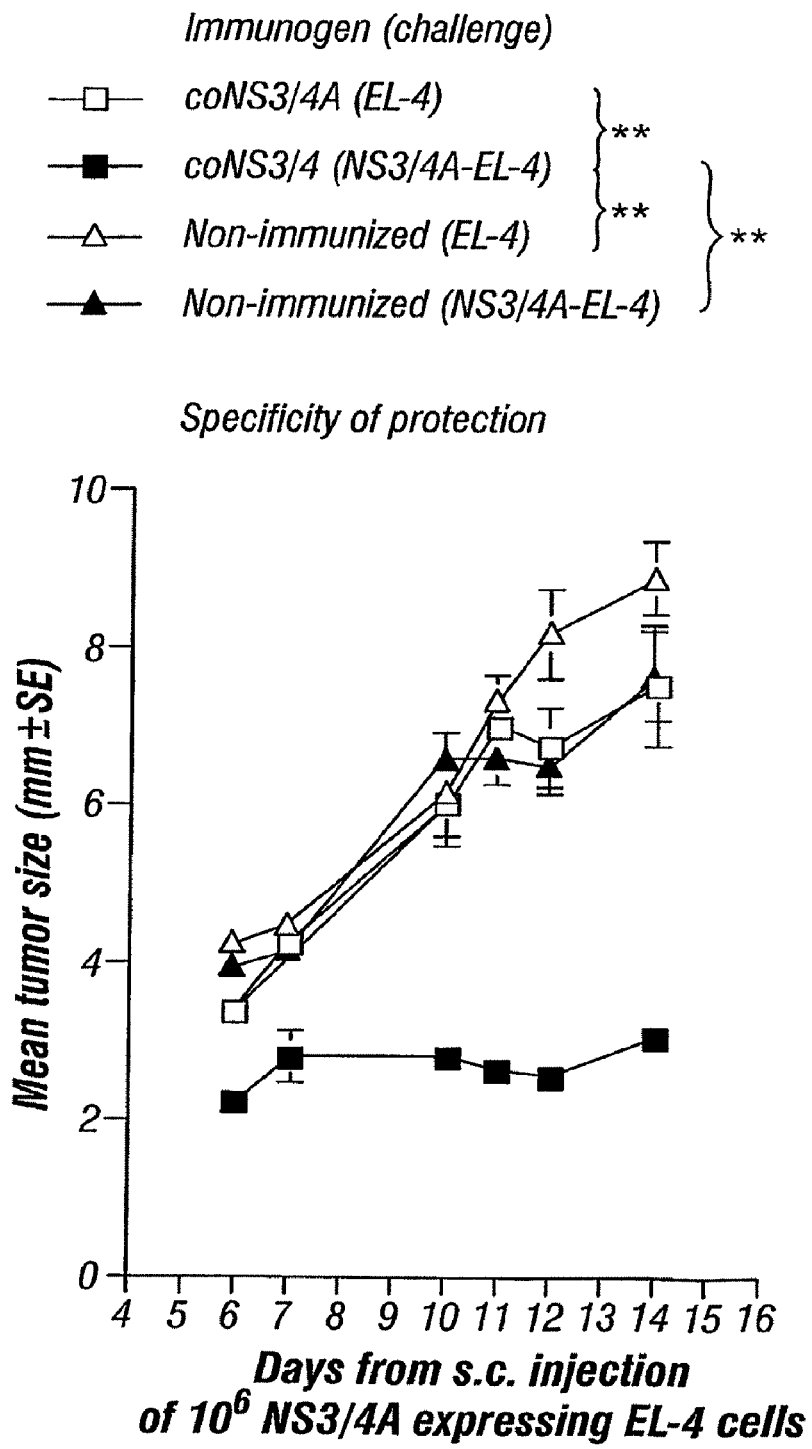

To confirm that inhibition of tumor growth using the NS3/4A-expressing EL-4 cell line is fully dependent on an NS3/4A-specific immune response a control experiment was performed. Groups of ten C57BL/6 mice were either left nonimmunized, or immunized twice with the coNS3/4A plasmid. Two weeks after the last immunization the mice were challenged with an s.c. injection of $10^6$ native EL-4 or NS3/4A-expressing EL-4 cells (NS3/4A-EL-4). An NS3/4A-specific immune response was required for protection, since only the immunized mice were protected against growth of the NS3/4A-EL-4 cell line (FIG. 10A). Thus, this H-2 b-restricted model behaves similarly to the SP2/0H-$2^d$ restricted model.

Figure 10B:
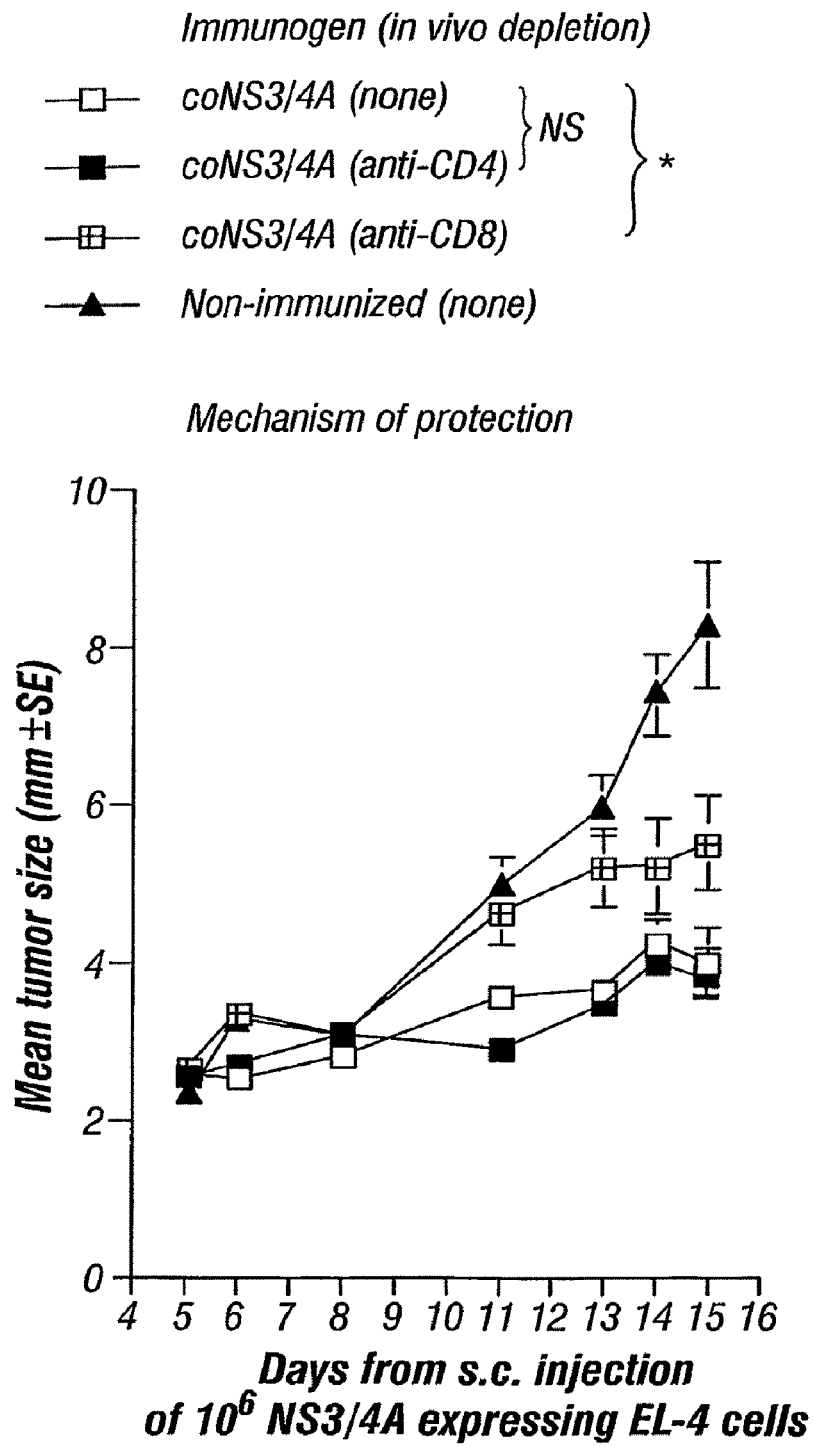

Immunizations with recombinant NS3 protein provided evidence that both NS3/4A-specific B cells and CD4+ T cells were not of a pivotal importance in protection against tumor growth. In vitro depletion of CD4+ or CD8+ T cells of splenocytes from coNS3/4A plasmid immunized H-$2^b$ mice provided evidence that CD8+ T cells were the major effector cells in the $^{51}$Cr-release assay. To define the in vivo functional anti-tumor effector cell population, CD4+ or CD8+ T cells in mice immunized with the coNS3/4A plasmid one week prior to, and during, challenge with the NS3/4A-EL-4 tumor cell line were selectively depleted. Analysis by flow cytometry revealed that 85% of CD4+ and CD8+ T cells had been depleted, respectively. This experiment revealed that in vivo depletion of CD4+ T cells had no significant effect on the tumor immunity (FIG. 10B). In contrast, depletion of CD8+ T cells in vivo significantly reduced the tumor immunity (p<0.05, ANOVA; FIG. 10B). Thus, as expected, NS3/4A-specific CD8+ CTLs seems to be the major protective cell at the effector stage in the in vivo model for inhibition of tumor growth.

Figure 11:
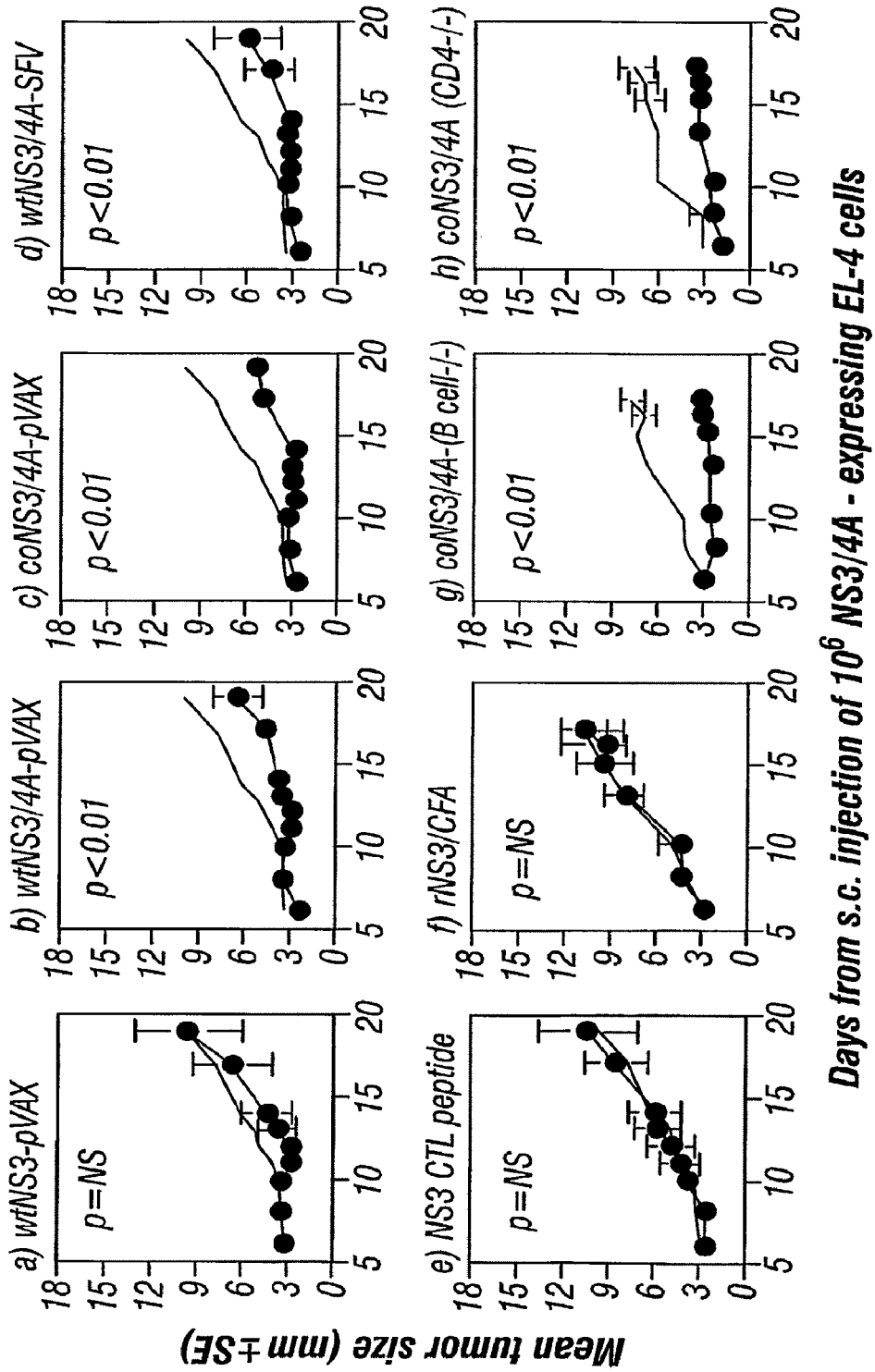

The tumor challenge model was then used to evaluate how effective the different immunogens were in priming a protective immunity against growth of NS3/4A-EL-4 tumor cells in vivo. To ensure that the effectiveness of the priming event was studied, all mice were immunized only once. Fully consistent with the in vitro CTL data did we find that only vectors containing NS3/4A were able to rapidly prime protective immune responses as compared to the immunized with the empty pVAX plasmid (p<0.05, ANOVA; FIG. 11). However, this was dependent on NS4A but independent of either codon optimization or mRNA amplification, suggesting that C57BL/6 mice are quite easily protected against tumor growth using genetic immunization.

To further clarify the prerequisites for priming of the in vivo protective CD8+ CTL responses additional experiments were performed. First, C57BL/6 mice immunized with the NS3-derived CTL peptide were not protected against growth of NS3/4A-EL-4 tumors (FIG. 11). Second, immunization with recombinant NS3 in adjuvant did not protect against tumor growth (FIG. 11). NS3-derived CTL peptide effectively primes CTLs in C57BL/6 mice and rNS3 in adjuvant primes high levels of NS3-specific T helper cells. Thus, an endogenous production of NS3/4A seems to be needed to prime in vivo protective CTLs. To further characterize the priming event, groups of B cell (µMT) or CD4 deficient C57BL/6 mice were immunized once with the coNS3/4A gene using gene gun, and were challenged two weeks later (FIG. 11). Since both lineages were protected against tumor growth we conclude that neither B cells nor CD4+ T cells were required for the priming of in vivo functional NS3/4A-specific CTLs (FIG. 11). In conclusion, the priming of in vivo tumor protective NS3/4A-specific CTLs in C57BL/6 mice requires NS4A and an endogenous expression of the immunogen. In C57BL/6 mice the priming is less dependent on the gene delivery route or accessory cells, such as B cells or CD4+ T cells. The fact that the priming of in vivo functional CTL by the coNS3/4A DNA plasmid was independent of CD4+ T helper cells may help to explain the speed by which the priming occurred.

Repeated experiments in C57BL/6 mice using the NS3/4A-EL-4 cell line have shown that protection against tumor growth is obtained already after the first immunization with the NS3/4A gene, independent of codon optimization or mRNA amplification. Also, after two injections the immunity against NS3/4A-EL-4 tumor growth was even further enhanced, but only when NS4A was present. Thus, this model may therefore not be sufficiently sensitive to reveal subtle differences in the intrinsic immunogenicity of different immunogens.

To better compare the immunogenicity of the wtNS3/4A and the coNS3/4A DNA plasmids, additional experiments were performed in H-$2^d$ mice, were at least two immunizations seemed to be required for a tumor protective immunity. It is important to remember that the IgG subclass distribution obtained after gene gun immunization with the NS3/4A gene in BALB/c mice suggested a mixed Th1/Th2-like response. Thus, it was possible that a Th2-like immunization route (gene gun) in the Th2-prone BALB/c mouse strain may impair the ability to prime in vivo effective CTL responses.

Figure 12A:
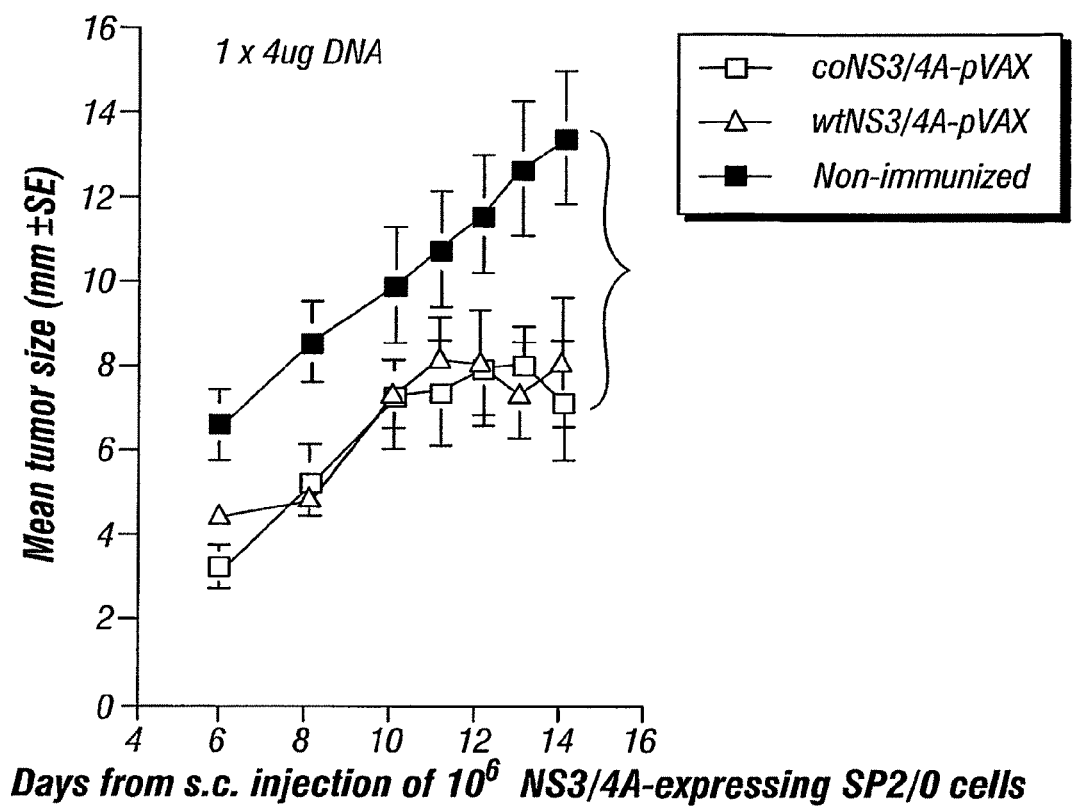
Figure 12B:
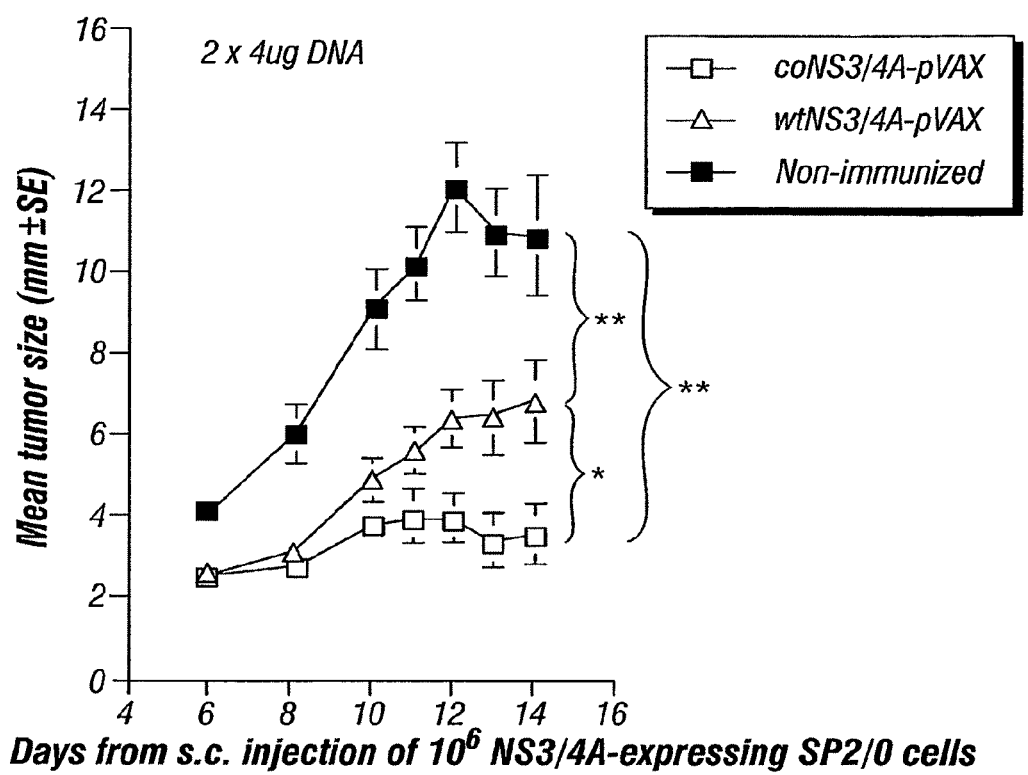
Figure 12C:
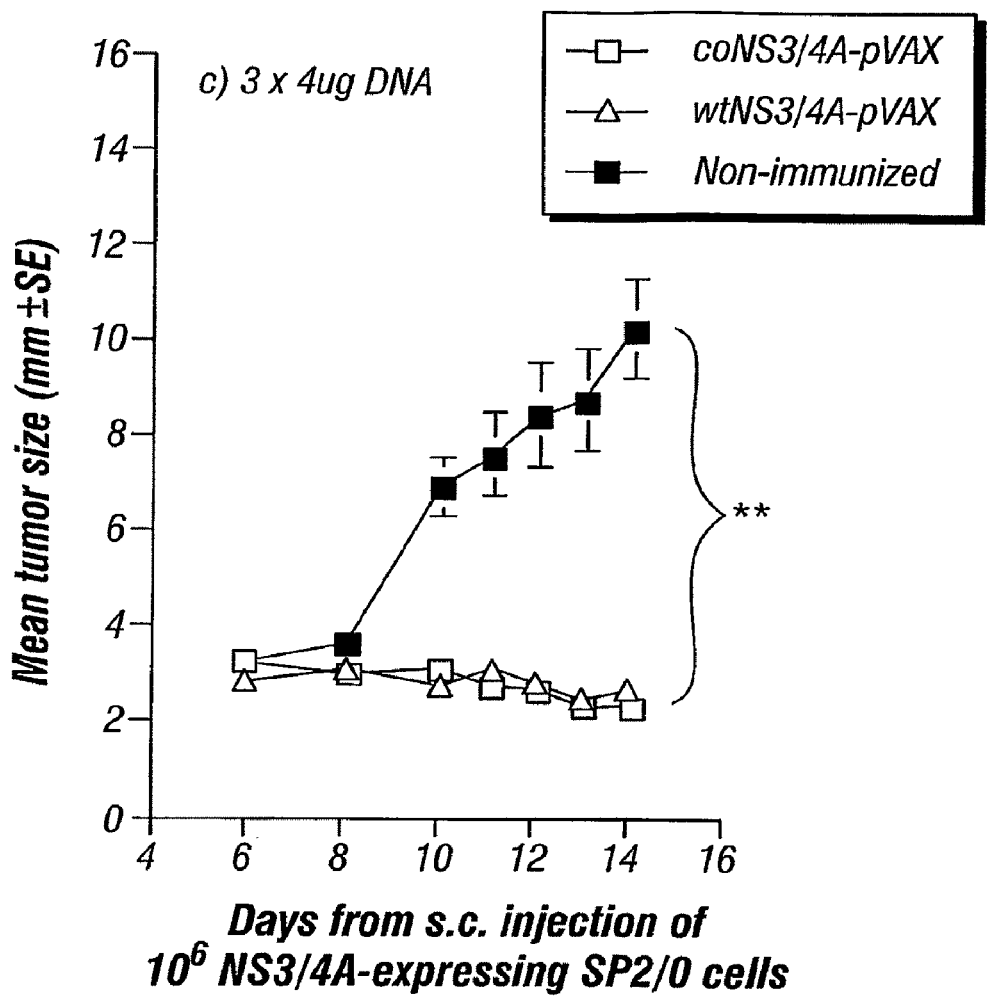

Groups of ten BALB/c mice were immunized once, twice, or thrice with 4 μg of the respective DNA plasmid using the gene gun (FIGS. 12A-12C). The mice were challenged two weeks after the last injection. Accordingly, these experiments provided more evidencer that the coNS3/4A plasmid primed an in vivo functional NS3/4A-specific tumor inhibiting immunity more rapidly than the wild type plasmid (FIGS. 12A-12C). Two doses of the coNS3/4A primed a significantly better NS3/4A-specific tumor inhibiting immunity as compared to the wtNS3/4A plasmid (p<0.05, ANOVA; FIGS. 12A-12C). After three doses the tumor inhibiting immunity was the same. Thus, the data above verified that the codon optimization of the NS3/4A gene primes NS3-specific CTLs more rapidly.

Figure 13:
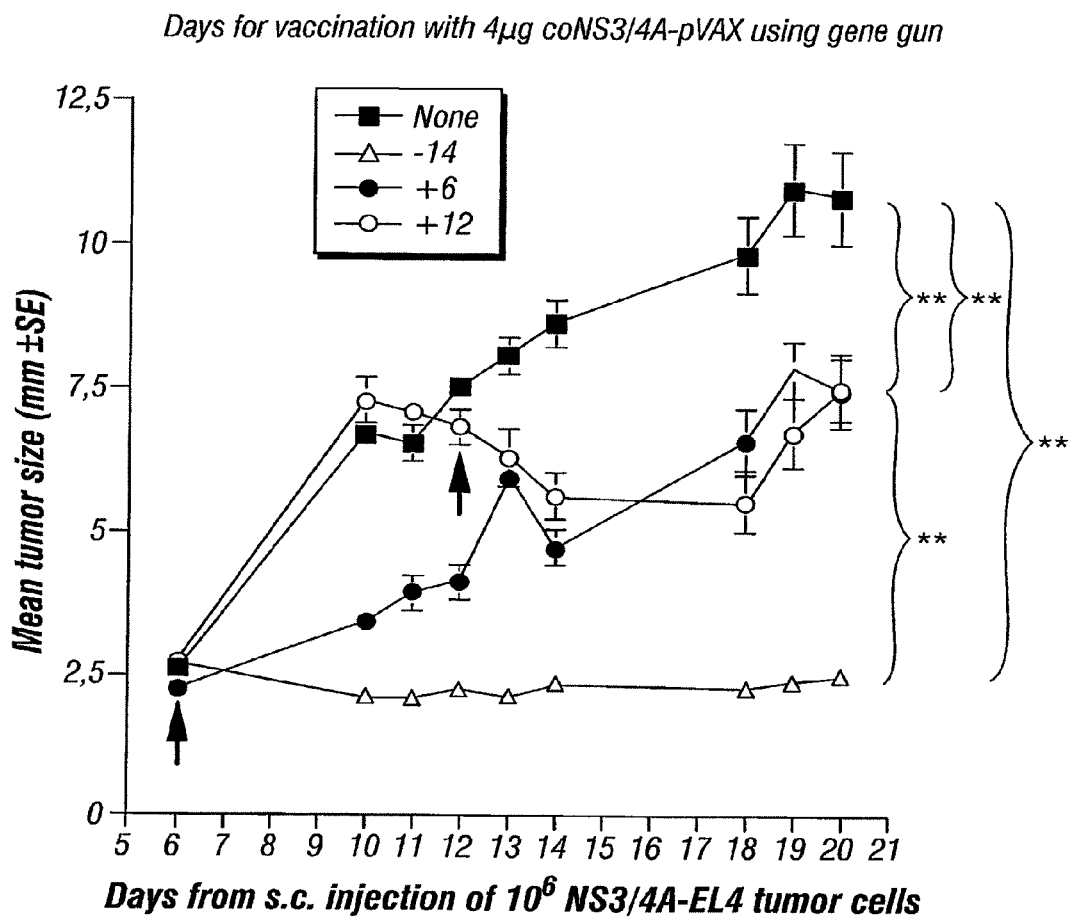

As set forth herein, the NS3/4A gene can be used as a vaccine. Although it had been determined that NS3/4A quickly primed in vivo functional CTLs, the effect of therapeutic immunization after the injection of tumor cells was analyzed next. Groups of ten C57BL/6 mice were challenged with $10^6$ NS3/4A-EL-4 tumor cells. One group was immunized transdermally with of 4 μg coNS3/4A at six days, and another group at 12 days, after tumor challenge. After the therapeutic vaccination both groups had significantly smaller tumors as compared to the nonimmunized control group (p<0.01, respectively, ANOVA; FIG. 13). This confirms that the vaccine rapidly primes CTLs, which are able to home to and infiltrate the NS3/4A-expressing tumors. Thus, gene gun immunization with the coNS3/4A plasmid also works as a therapeutic vaccine. That is, gene gun immunization using the coNS3/4A gene six to 12 days after inoculation of NS3/4A-expressing tumor cells significantly inhibited tumor growth. Overall, a rapid priming of HCV NS3-specific immune responses that are functional in vivo are generated by either DNA based immunization with a codon optimized gene or by mRNA amplification by the SFV replicon. By using these approaches, one can prepare very effective vaccines for the treatment and prevention of chronic HCV infections. The next example described in greater detail some of the materials and methods used in the experiments described herein.

EXAMPLE 8B

Mice

Inbred BALB/c ($H-2^d$) and C57BL/6 ($H-2^b$) mice were obtained from commercial vendors (Möllegard, Denmark). B cell (μMT) deficient mice were kindly provided by Dr Karin Sandstedt, Karolinska Institute, Sweden. CD4 deficient C57BL/6 mice were obtained from the breeding facility at the Microbiology and Tumorbiology Centre, Karolinska Institute. All mice were female and were used at 4-8 weeks of age at the start of the experiments.

Recombinant NS3 ATPase/Helicase Domain Protein

The recombinant NS3 (rNS3) protein was kindly provided by Darrell L. Peterson, Department of Biochemistry, Commonwealth University, VA. The production of recombinant NS3 protein (not including NS4A) in E. Coli has been described in the field. Prior to use the rNS3 protein was dialyzed over night against PBS and sterile filtered.

Generation of a Synthetic Codon Optimized (Co) NS3/4A Gene

The sequence of the previously isolated and sequenced unique wtNS3/4A gene was analyzed for codon usage with respect to the most commonly used codons in human cells. A total of 435 nucleotides were replaced to optimize codon usage for human cells. The sequence was sent to Retrogen Inc (San Diego, Calif.) for generation of a full-length synthetic coNS3/4A gene. The coNS3/4A gene had a sequence homology of 79% with the region at nucleotide positions 3417-5475 of the HCV-1 reference strain. A total of 433 nucleotides differed. On an amino acid level the homology with the HCV-1 strain was 98% (15 amino acids differed).

The full-length codon optimized 2.1 kb DNA fragment of the HCV genotype 1b corresponding to the amino acids 1007 to 1711 encompassing the NS3 and NS4A. NS3/NS4A gene fragment was inserted into a Bam HI and Xba I digested pVAX vector (Invitrogen, San Diego) to give the coNS3/4A-pVAX plasmid. The expression construct was sequenced to ensure correct sequence and reading frame. The protein expression was analysed by an in vitro transcription and translation assay. Plasmids were grown in competent TOP10 E. Coli. (Invitrogen). Plasmid DNA used for in vivo injection, was purified by using Qiagen DNA purification columns according to the manufacturers instructions (Qiagen GmbH, Hilden, FRG). The concentration of the resulting plasmid DNA was determined spectrophotometrically (Dynaquant, Pharmacia Biotech, Uppsala, Sweden). Purified DNA was dissolved in sterile phosphate buffer saline (PBS) at concentrations of 1 mg/ml.

In Vitro Translation Assay

To ensure that the wtNS3/4A and coNS3/4A genes were intact and could be translated, an in vitro transcription assay is using the prokaryotic T7 coupled reticulocyte lysate system (TNT; Promega, Madison, Wis.) was performed. To compare the translation efficiency from the two plasmids the amount input DNA was diluted in serial dilutions (6 ng to 1 ng) prior to addition to the TNT assay.

Transient Transfections

HepG2 cells were transiently transfected by standard protocols. In brief, HepG2 cells were plated into 2.5 $cm^2$ wells ($0.5 \times 10^6$) in DMEM medium the day before transfection. Two μg of each plasmid DNA construct (wtNS3/4A and coNS3/4A) was transfected into HepG2 cells using Fugene 6 Transfection Reagent (Roche). After transfection, the HepG2 cells were incubated for 24-48 hrs.

Protein Sample Preparation and Analysis

Cell lysates were analysed by immunoprecipitation followed by SDS-PAGE. In brief, transient transfected HepG2 cells were lysed in RIPA buffer (0.15M NaCl, 50 mM Tris, 1% Triton-X 100, 1% Na-deoxycholate and 1% SDS). The cell lysates were immunoprecipitated with protein A sepharose and anti-NS3 polyclonal antibody overnight at 4° C. The washed pellets were re-suspended in SDS sample buffer, heated at 100° C. for 5 minutes prior to SDS-PAGE analysis on 4-12% Bis-Tris gel (Invitrogen) and electrotransferred onto Nitrocellulose membranes.

Analysis of NS3 Protein Expression

Detection of NS3 protein was done according to manufacturer's protocol by using a chemiluminescence-linked Western blot kit (WesternBreeze; Invitrogen). NS3 protein expression was detected and quantified as a chemiluminescent signal by using an NS3-specific polyclonal antibody. Chemiluminescent signals were detected by using the GeneGnome (Syngene, Cambridge, UK). Quantification of chemiluminescence Western blots was performed on GeneGnome and units of intensity from each protein band was calculated and compared to a standard curve of rNS3.

Semliki Forest Virus (SFV) Vectors

Baby Hamster Kidney (BHK)-21 cells were maintained in complete BHK medium supplemented with 5% FCS, 10% tryptose phosphate broth, 2 mM glutamine, 20 mM Hepes and antibiotics (streptomycin 10 μg/ml and penicillin 100 IU/ml).

The wtNS3/4A gene was isolated by PCR as Spe1-BStB1 fragment and inserted into the Spe1-BstB1 site of pSFV10Enh containing a 34 amino acid long translational enhancer sequence of capsid followed by the FMDV 2a cleavage peptide. Packaging of recombinant RNA into rSFV particles was done using a two-helper RNA system. Indirect immunofluorescence of infected BHK cells was performed to determine the titre of the recombinant virus stocks.

Immunofluorescence

BHK cells were transient transfected with coNS3/4A-pVAX1 according to standard techniques using Lipofectamine plus reagent (Invitrogen) or infected by rSFV. NS3 protein was detected by indirect immunofluorescence.

Immunization Protocols

Groups (5-10 mice/group) of female BALB/c (H-$2^d$) or C57BL/6 (H-$2^b$) mice, 4-8 weeks old, were immunized by needle injections of 100 µg of plasmid DNA encoding individual or multiple HCV proteins. Plasmid DNA in PBS was given intramuscularly (i.m.) in the tibialis anterior (TA) muscle. Where indicated in the text, the mice were injected i.m. with 50 µL/TA of 0.01 mM cardiotoxin (Latoxan, Rosans, France) in 0.9% sterile saline NaCl, five days prior to DNA immunization. The mice were boosted at four-week intervals.

For gene gun based immunizations, plasmid DNA was linked to gold particles (1 µm) according to protocols supplied by the manufacturer (Bio-Rad Laboratories, Hercules, Calif.). Prior to immunization the abdominal injection area was shaved and the immunization was performed according to the manufacturer's protocol at a helium discharge pressure of 500 psi. Each injection dose contained 4 µg of plasmid DNA. The mice were boosted with the same dose at monthly intervals.

For rSFV particle immunizations, mice were immunized subcutaneously, in the base of the tail, with $1\times10^7$ virus particles diluted in PBS (wtNS3/4A-SFV), in a final volume of 100 µl. Peptide immunization was performed by subcutaneous immunization in the base of the tail with 100 µg peptide mixed 1:1 in complete Freunds adjuvant.

ELISA for Detection of Murine Anti-HCV NS3 Antibodies

Serum for antibody detection and isotyping was collected every second or fourth week after the first immunization by retroorbital bleeding of isofluorane-anesthetized mice. The enzyme immuno assays were performed as previously described.

Cell Lines

The SP2/0-Ag14 myeloma cell line (H-$2^d$) was maintained in DMEM medium supplemented with 10% fetal calf serum (FCS; Sigma Chemicals, St. Louis, Mo.), 2 mM L-Glutamin, 10 mM HEPES, 100 U/ml Penicillin and 100 µg/ml Streptomycin, 1 mM non-essential amino acids, 50 µM β-mercaptoethanol, 1 mM sodium pyruvate (GIBCO-BRL, Gaithesburgh, Md.). SP2/0-Ag14 cells with stable expression of NS3/4A were maintained in 800 µg geneticin (G418)/ml complete DMEM medium.

The EL-4 lymphoma (H-$2^b$) cells were maintained in RPMI 1640 medium supplemented with 10% FCS, 10 mM HEPES, 1 mM sodium pyruvate, 1 mM non-essential amino acids, 50 µM β-mercaptoethanol, 100 U/ml Penicillin and 100 µg/ml Streptomycin (GIBCO-BRL). EL-4 cells with stable expression of NS3/4A were generated by transfection of EL-4 cells with the linearized NS3/4A-pcDNA3.1 plasmid using the SuperFect (Qiagen GmbH, Hilden, FRG) transfection reagent. The transfection procedure was performed according to manufacturer's protocol. Transfected cells were cloned by limiting dilution and selected by addition of 800 µg geneticin (G418)/ml complete RPMI 1640 medium.

RMA-S cells (a kind gift from Professor Klas Kärre, Karolinska Institute, Sweden) were maintained in RPMI 1640 medium supplemented with 5% FCS, 2 mM L-Glutamin, 100 U/ml Penicillin and 100 µg/ml Streptomycin. All cells were grown in a humidified 37° C., 5% $CO_2$ incubator.

In Vivo Depletion of T Cells

CD4 and CD8 T cell subpopulations were depleted in vivo by intraperitoneal injection of purified hybridoma supernatant. A total of 0.4 mg per mouse per injection of anti-CD4 (clone GK1.5) or anti-CD8 (clone 53-6.7) was injected on days −3, −2, and −1 before tumor challenge, and on days 3, 6, 10, and 13 after challenge. Flow cytometric analysis of peripheral blood mononuclear cell populations at days 0, 3, 6, 10, and 13 demonstrated that more than 85% of the CD4 and CD8 T cells were depleted.

In Vivo Challenge with the NS3/4A-expressing Tumor Cells

In vivo challenge of immunized mice with the NS3/4A-expressing SP2/0 myeloma or EL-4 lymphoma cell line was performed according to the method described by Encke et al., supra. In brief, groups of BALB/c or C57BL/6 mice were immunized with different immunogens at weeks zero, four, and eight as described. Two weeks after the last immunisation $1\times10^6$ NS3/4A-expressing SP2/0 or EL-4 cells were injected subcutaneously in the right flank. The kinetics of the tumor growth was determined by measuring the tumor size through the skin at days six to 20. Kinetic tumor development in two groups of mice was compared using the area under the curve (AUC). The mean tumor sizes were compared using the analysis of variance (ANOVA) test. At day 20 all mice were sacrificed.

To test the therapeutic effect of the vaccines groups of mice were inoculated with the tumor cells as described above. After six or 12 days the mice were immunized once. The tumor growth was monitored from day 6 to day 20.

Antibodies and MHC:Ig Fusion Protein

All monoclonal antibodies and MHC:Ig fusion proteins were purchased from BDB Pharmingen (San Diego, Calif.); Anti-CD16/CD32 (Fc-Block™, clone 2.4G2), FITC conjugated anti-CD8 (clone 53-6.7), Cy-Chrome conjugated anti-CD4 (clone RM4-5), FITC conjugated anti-H-2 $D^b$ (clone KH95), recombinant soluble dimeric mouse H-2 $D^b$:Ig, PE conjugated Rat-α Mouse IgG1 (clone X56).

Detection of NS3/4A-specific CTL Activity

Spleen cells from DNA or rSFV immunized C57BL/6 mice were resuspended in complete RPMI 1640 medium supplemented with 10% FCS, 2 mM L-Glutamine, 10 mM HEPES, 100 U/ml Penicillin and 100 µg/ml Streptomycin, 1 mM non-essential amino acids, 50 µM β-mercaptoethanol, 1 mM sodium pyruvate. In vitro stimulation was carried out for five days in 25-ml flasks at a final volume of 12 ml, containing 5 U/ml recombinant murine IL-2 (mIL-2; R&D Systems, Minneapolis, Minn., USA). The restimulation culture contained a total of $25\times10^6$ immune spleen cells and $2.5\times10^6$ irradiated (10,000 rad) syngenic EL-4 cells expressing the NS3/4A protein. After five days in vitro stimulation a standard $^{51}$Cr-release assay was performed. Effector cells were harvested and a four-hour $^{51}$Cr assay was performed in 96-well U-bottom plates in a total volume of 200 µl. A total of $1\times10^6$ target cells (NS3/4A expressing EL-4 cells) was labelled for one hour at +37° C. with 20 µl of $^{51}$Cr (5 mCi/ml) and then washed three times in PBS. Different numbers of effectors and $^{51}$Cr-labeled target cells ($5\times10^3$ cells/well) were added to wells at effector:target (E:T) ratios of 60:1, 20:1, and 7:1. The level of cytolytic activity was determined after incubation of effectors and targets for 4 hour at +37° C. 100 µl supernatant was harvested and the radioactivity was measured with a γ-counter.

Splenocytes from DNA or rSFV immunised mice were harvested from C57BL/6 mice and were resuspended in complete RPMI 1640 medium as previously described. In brief, in vitro stimulation was carried out for five days by mixing 25×10⁶ spleen cells and 25×10⁶ irradiated (2,000 rad) syngeneic splenocytes. The restimulation was performed in the presence of 0.05 µM NS3/4A H-2 $D^b$ binding peptide (sequence GAVQNEVTL (Seq. Id. No. 37)). After restimulation, a four hour $^{51}$Cr-release assay was performed using $^{51}$Cr-labelled peptide pulsed RMA-S cells as targets. Cytotoxic activity was determined at the E:T ratios 60:1, 20:1, and 7:1.

Results were expressed according to the formula: percent specific lysis=(experimental release−spontaneous release)/(maximum release−spontaneous release). Experimental release is the mean counts/minute released by the target cells in presence of effector cells. Maximum release is the radioactivity released after lysis of target cells with 10% Triton X-100. Spontaneous release is the leakage of radioactivity into the medium of target cells.

In vitro T-cell depletion experiments were conducted by incubating effector cells with either an anti-CD4, or anti-CD8, monoclonal antibody containing hybridoma supernatant (clone RL 172.4; anti-CD4, or clone 31M; anti-CD8) for 30 minutes at 4° C. The cells were then washed and incubated at 37° C. for 1 hr with complement (1/20 dilution of low toxicity rabbit complement; Saxon, UK) before performing the CTL assay described above.

Quantification of NS3/4A-specific CTLs by Flow Cytometry

The frequency of NS3-peptide specific CD8+ T cells were analysed by ex-vivo staining of spleen cells from DNA or rSFV immunized mice with recombinant soluble dimeric mouse H-2 $D^b$:Ig fusion protein as previously described. In brief, spleen cells were resuspended in PBS/1% FCS (FACS buffer) and incubated with Fc-blocking antibodies. Cells were then washed and incubated with H-2$D^b$:Ig preloaded with NS3/4A derived peptide. Afterwards, cells were washed and incubated with PE conjugated Rat-α Mouse IgG1 antibody, FITC conjugated α-mouse CD8 antibody and Cy-Chrome α-mouse CD4 antibody. After washing, the cells were diluted in FACS buffer containing Propidium Iodide (PI). Approximately 200,000 total events from each sample were acquired on a FACSCalibur (BDB) and dead cells (PI positive cells) were excluded in the analysis.

Statistical Analysis

Fisher's exact test was used for frequency analysis and Mann-Whitney U-test was used for comparing values from two groups. Kinetic tumor development in two groups of mice was compared using the area under the curve (AUC). AUC values were compared using analysis of variance (ANOVA). The calculations were performed using the Macintosh version of the StatView software (version 5.0).

The compositions described herein may contain other ingredients or compounds in addition to nucleic acids and/or polypeptides, including, but not limited to, various other peptides, adjuvants, binding agents, excipients such as stabilizers (to promote long term storage), emulsifiers, thickening agents, salts, preservatives, solvents, dispersion media, coatings, antibacterial and antifungal agents, isotonic and absorption delaying agents and the like. See e.g., U.S. application Ser. No. 09/929,955 and U.S. application Ser. No. 09/930,591. These compositions are suitable for treatment of animals, particularly mammals, either as a preventive measure to avoid a disease or condition or as a therapeutic to treat animals already afflicted with a disease or condition.

Many other ingredients may also be present in the compositions provided herein. For example, the adjuvant and antigen can be employed in admixture with conventional excipients (e.g., pharmaceutically acceptable organic or inorganic carrier substances suitable for parenteral, enteral (e.g., oral) or topical application that do not deleteriously react with the adjuvant (e.g., ribavirin) and/or antigen). Suitable pharmaceutically acceptable carriers include, but are not limited to, water, salt solutions, alcohols, gum arabic, vegetable oils, benzyl alcohols, polyethylene glycols, gelatine, carbohydrates such as lactose, amylose or starch, magnesium stearate, talc, silicic acid, viscous paraffin, perfume oil, fatty acid monoglycerides and diglycerides, pentaerythritol fatty acid esters, hydroxy methylcellulose, polyvinyl pyrrolidone, etc. Many more suitable carriers are described in Remington's Pharmaceutical Sciences, 15th Edition, Easton:Mack Publishing Company, pages 1405-1412 and 1461-1487 (1975) and The National Formulary XIV, 14th Edition, Washington, American Pharmaceutical Association (1975).

The gene constructs described herein, in particular, can be formulated with or administered in conjunction with agents that increase uptake and/or expression of the gene construct by the cells relative to uptake and/or expression of the gene construct by the cells that occurs when the identical genetic vaccine is administered in the absence of such agents. Such agents and the protocols for administering them in conjunction with gene constructs are described in PCT Patent Application Serial Number PCT/US94/00899 filed Jan. 26, 1994. Examples of such agents include: $CaPO_4$, DEAE dextran, anionic lipids; extracellular matrix-active enzymes; saponins; lectins; estrogenic compounds and steroidal hormones; hydroxylated lower alkyls; dimethyl sulfoxide (DMSO); urea; and benzoic acid esters anilides, amidines, urethanes and the hydrochloride salts thereof, such as those of the family of local anesthetics. In addition, the gene constructs can be encapsulated within/administered in conjunction with lipids/polycationic complexes.

Vaccines and immunogenic compositions can be sterilized and if desired mixed with auxiliary agents, e.g., lubricants, preservatives, stabilizers, wetting agents, emulsifiers, salts for influencing osmotic pressure, buffers, coloring, flavoring and/or aromatic substances and the like that do not deleteriously react with the adjuvant or the administered nucleic acid or peptide.

The effective dose and method of administration of a particular formulation can vary based on the individual patient and the type and stage of the disease, as well as other factors known to those of skill in the art. Therapeutic efficacy and toxicity can be determined by standard pharmaceutical procedures in cell cultures or experimental animals, e.g., ED50 (the dose therapeutically effective in 50% of the population). The data obtained from cell culture assays and animal studies can be used to formulate a range of dosage for human use. The dosage lies preferably within a range of circulating concentrations that include the ED50 with no toxicity. The dosage varies within this range depending upon the type of adjuvant derivative and antigen, the dosage form employed, the sensitivity of the patient, and the route of administration.

Since many adjuvants (e.g., ribavirin) have been on the market for several years, many dosage forms and routes of administration are known. All known dosage forms and routes of administration can be provided within the context of the embodiments described herein. Preferably, an amount of adjuvant that is effective to enhance an immune response to an antigen in an animal can be considered to be an amount that is sufficient to achieve a blood serum level of antigen approximately 0.25-12.5 µg/ml in the animal, preferably, about 2.5 µg/ml. In some embodiments, the amount of adjuvant is determined according to the body weight of the animal to be given the vaccine. Accordingly, the amount of adjuvant in a vaccine formulation can be from about 0.1-6.0 mg/kg body weight.

That is, some embodiments have an amount of adjuvant that corresponds to approximately 0.1-1.0 mg/kg, 1.1-2.0 mg/kg, 2.1-3.0 mg/kg, 3.1-4.0 mg/kg, 4.1-5.0 mg/kg, and 5.1-6.0 mg/kg body weight of an animal. More conventionally, the vaccines contain approximately 0.25 mg-2000 mg of adjuvant. That is, some embodiments have approximately 250 μg, 500 μg, 1 mg, 25 mg, 50 mg, 100 mg, 150 mg, 200 mg, 250 mg, 300 mg, 350 mg, 400 mg, 450 mg, 500 mg, 550 mg, 600 mg, 650 mg, 700 mg, 750 mg, 800 mg, 850 mg, 900 mg, 1 g, 1.1 g, 1.2 g, 1.3 g, 1.4 g, 1.5 g, 1.6 g, 1.7 g, 1.8 g, 1.9 g, and 2 g of adjuvant.

As one of skill in the art will appreciate, the amount of antigens in a vaccine can vary depending on the type of antigen and its immunogenicity. The amount of antigens in the vaccine can vary accordingly. Nevertheless, as a general guide, the vaccines can have approximately 1 μg, 5 μg, 1 μg, 20 μg, 40 μg, 80 μg, 100 μg, 0.25 mg-5 mg, 5-10 mg, 10-100 mg, 100-500 mg, and upwards of 2000 mg of an antigen described herein, for example. Preferably, the amount of antigen is 0.1 μg-1 mg, desirably, 0.1 μg-100 μg, preferably 3 μg-50 μg, and, most preferably, 7 μg, 8 μg, 9 μg, 10 μg, 11 μg-20 μg, when said antigen is a nucleic acid.

In some approaches described herein, the exact amount of adjuvant and/or antigen is chosen by the individual physician in view of the patient to be treated. Further, the amounts of adjuvant can be added in combination to or separately from the same or equivalent amount of antigen and these amounts can be adjusted during a particular vaccination protocol so as to provide sufficient levels in light of patient-specific or antigen-specific considerations. In this vein, patient-specific and antigen-specific factors that can be taken into account include, but are not limited to, the severity of the disease state of the patient, age, and weight of the patient, diet, time and frequency of administration, drug combination(s), reaction sensitivities, and tolerance/response to therapy.

Ribavirin

Nucleoside analogs have been widely used in anti-viral therapies due to their capacity to reduce viral replication. (Hosoya et al., *J. Inf. Dis.*, 168:641-646 (1993)). ribavirin (1-β-D-ribofuranosyl-1,2,4-triazole-3-carboxamide) is a synthetic guanosine analog that has been used to inhibit RNA and DNA virus replication. (Huffman et al., *Antimicrob. Agents. Chemother.*, 3:235 (1973); Sidwell et al., *Science*, 177:705 (1972)). Ribavirin has been shown to be a competitive inhibitor of inositol mono-phosphate (IMP) dehydrogenase (IMPDH), which converts IMP to IMX (which is then converted to GMP). De Clercq, Anti viral Agents: characteristic activity spectrum depending on the molecular target with which they interact, Academic press, Inc., New York N.Y., pp. 1-55 (1993). Intracellular pools of GTP become depleted as a result of long term ribavirin treatment.

In addition to antiviral activity, investigators have observed that some guanosine analogs have an effect on the immune system. (U.S. Pat. Nos. 6,063,772 and 4,950,647). Ribavirin has been shown to inhibit functional humoral immune responses (Peavy et al., *J. Immunol.*, 126:861-864 (1981); Powers et al., *Antimicrob. Agents. Chemother.*, 22:108-114 (1982)) and IgE-mediated modulation of mast cell secretion. (Marquardt et al., *J. Pharmacol. Exp. Therapeutics*, 240:145-149 (1987)). Some investigators report that a daily oral therapy of ribavirin has an immune modulating effect on humans and mice. (Hultgren et al., *J. Gen. Virol.*, 79:2381-2391 (1998) and Cramp et al., *Gastron. Enterol.*, 118:346-355 (2000)). Nevertheless, the current understanding of the effects of ribavirin on the immune system is in its infancy. As disclosed below, ribavirin was found to be a potent adjuvant.

EXAMPLE 9

In a first set of experiments, groups of three to five Balb/c mice (BK Universal, Uppsala, Sweden) were immunized i.p or s.c. (e.g., at the base of the tail) with 10 μg or 100 μg of recombinant hepatitis C virus non-structural 3 (rNS3) protein. The rNS3 was dissolved in phosphate buffered saline (PBS) alone or PBS containing 1 mg ribavirin (obtained from ICN, Costa Mesa, Calif.). Mice were injected with a total volume of 100 μl per injection.

At two and four weeks following i.p. immunization, all mice were bled by retro-orbital sampling. Serum samples were collected and analyzed for the presence of antibodies to rNS3. To determine the antibody titer, an enzyme immunoassay (EIA) was performed. (See e.g., Hultgren et al., *J Gen Virol.* 79:2381-91 (1998) and Hultgren et al., *Clin. Diagn. Lab. Immunol.* 4:630-632 (1997)). The antibody levels were recorded as the highest serum dilution giving an optical density at 405 nm more than twice that of non-immunized mice.

Figure 14:
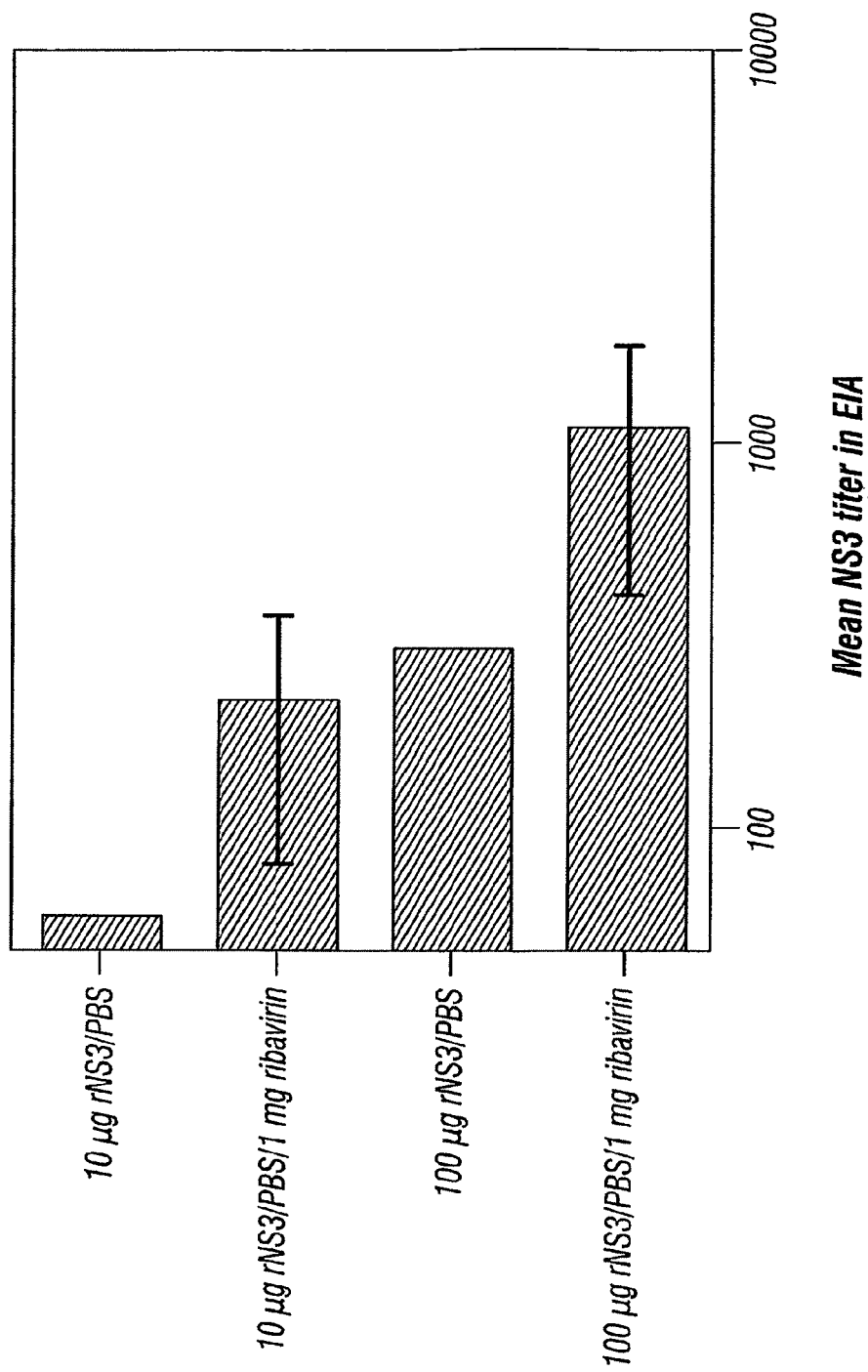
FIG. 14 is a graph showing the humoral response to 10 and 100 µg recombinant Hepatitis C virus (HCV) non structural 3 protein (NS3), as determined by mean end point titres, when a single dose of 1 mg of ribavirin was co-administered.

Mice that received 10 μg or 100 μg rNS3 mixed with 1 mg ribavirin in PBS displayed consistently higher levels of NS3 antibodies. The antibody titer that was detected by EIA at two weeks post-immunization is shown in FIG. 14. The vaccine formulations having 1 mg of ribavirin and either 10 μg or 100 μg of rNS3 induced a significantly greater antibody titer than the vaccine formulations composed of only rNS3.

In a second set of experiments, groups of eight Balb/c mice were immunized intraperitoneally with 10 or 50 μg of rNS3 in 100 μl phosphate buffered saline containing either 0 mg, 1 mg, 3 mg, or 10 mg ribavirin (Sigma). At four, six and eight weeks the mice were bled and serum was separated and frozen. After completion of the study, sera were tested for the levels of antibodies to recombinant NS3, as described above. Mean antibody levels to rNS3 were compared between the groups using Student's t-test (parametric analysis) or Mann-Whitney (non-parametric analysis) and the software package StatView 4.5 (Abacus Concepts, Berkely, Calif.). The adjuvant effect of ribavirin when added in three doses to 10 μg of rNS3 are provided in TABLE 14. The adjuvant effect of ribavirin when added in three doses to 50 μg of rNS3 are provided in TABLE 15. Parametrical comparison of the mean rNS3 antibody titres in mice receiving different 10 μg or 50 μg of rNS3 and different doses of ribavirin are provided in TABLES 15 and 16, respectively. Non-parametrical comparison of mean NS3 antibody titres in mice receiving different 10 μg or 50 μg of rNS3 and different doses of ribavirin are provided in TABLES 17-19, respectively. The values given represent end point titres to recombinant rNS3.

TABLE 14

| Amount ribavirin (mg/dose) | Amount immunogen (μg/dose) | Mouse ID | Antibody titre to rNS3 at indicated week | | |
|---|---|---|---|---|---|
| | | | Week 4 | Week 6 | Week 8 |
| None | 10 | 5:1 | 300 | 1500 | 1500 |
| None | 10 | 5:2 | <60 | 7500 | 1500 |

TABLE 14-continued

| Amount ribavirin (mg/dose) | Amount immunogen (μg/dose) | Mouse ID | Antibody titre to rNS3 at indicated week | | |
|---|---|---|---|---|---|
| | | | Week 4 | Week 6 | Week 8 |
| None | 10 | 5:3 | <60 | 1500 | 300 |
| None | 10 | 5:4 | 60 | 1500 | 1500 |
| None | 10 | 5:5 | <60 | 1500 | nt |
| None | 10 | 5:6 | 60 | 1500 | 1500 |
| None | 10 | 5:7 | <60 | 7500 | 7500 |
| None | 10 | 5:8 | 300 | 37500 | 7500 |
| Group mean titre (mean ± SD) | | | 180 ± 139 | 7500 ± 12421 | 3042 ± 3076 |
| 1 | 10 | 6:1 | 300 | 37500 | 37500 |
| 1 | 10 | 6:2 | <60 | 1500 | 1500 |
| 1 | 10 | 6:3 | 300 | 37500 | 187500 |
| 1 | 10 | 6:4 | 300 | 37500 | 7500 |
| 1 | 10 | 6:5 | 60 | nt | nt |
| 1 | 10 | 6:6 | <60 | 37500 | 7500 |
| 1 | 10 | 6:7 | <60 | 37500 | 7500 |
| 1 | 10 | 6:8 | 300 | 7500 | 7500 |
| Group mean titre (mean ± SD) | | | 252 ± 107 | 28071 ± 16195 | 36642 ± 67565 |
| 3 | 10 | 7:1 | 60 | 37500 | 37500 |
| 3 | 10 | 7:2 | 60 | 37500 | 37500 |
| 3 | 10 | 7:3 | 300 | 7500 | 7500 |
| 3 | 10 | 7:4 | 300 | 37500 | 7500 |
| 3 | 10 | 7:5 | 300 | 37500 | 37500 |
| 3 | 10 | 7:6 | 300 | 37500 | 37500 |
| 3 | 10 | 7:7 | 60 | 7500 | 7500 |
| 3 | 10 | 7:8 | 60 | 37500 | 37500 |
| Group mean titre (mean ± SD) | | | 180 ± 128 | 30000 ± 13887 | 22500 ± 34637 |
| 10 | 10 | 8:1 | 300 | 37500 | 37500 |
| 10 | 10 | 8:2 | 300 | 37500 | 37500 |
| 10 | 10 | 8:3 | <60 | 300 | 300 |
| 10 | 10 | 8:4 | 60 | 7500 | 7500 |
| 10 | 10 | 8:5 | <60 | 300 | 300 |
| 10 | 10 | 8:6 | <60 | 37500 | 37500 |
| 10 | 10 | 8:7 | <60 | 7500 | 7500 |
| 10 | 10 | 8:8 | <60 | nt | nt |
| Group mean titre (mean ± SD) | | | 220 ± 139 | 18300 ± 18199 | 18300 ± 18199 |

TABLE 15

| Amount ribavirin (mg/dose) | Amount immunogen (μg/dose) | Mouse ID | Antibody titre to rNS3 at indicated week | | |
|---|---|---|---|---|---|
| | | | Week 4 | Week 6 | Week 8 |
| None | 50 | 1:1 | 60 | 7500 | 7500 |
| None | 50 | 1:2 | 60 | 7500 | 7500 |
| None | 50 | 1:3 | 60 | 7500 | 7500 |
| None | 50 | 1:4 | <60 | 1500 | 300 |
| None | 50 | 1:5 | 300 | 37500 | 37500 |
| None | 50 | 1:6 | 60 | 7500 | 7500 |
| None | 50 | 1:7 | 60 | 37500 | 7500 |
| None | 50 | 1:8 | — | — | — |
| Group mean titre (mean ± SD) | | | 100 ± 98 | 15214 ± 15380 | 10757 ± 12094 |
| 1 | 50 | 2:1 | 60 | 7500 | 7500 |
| 1 | 50 | 2:2 | 300 | 37500 | 7500 |
| 1 | 50 | 2:3 | 60 | 187500 | 7500 |
| 1 | 50 | 2:4 | 60 | 37500 | 187500 |
| 1 | 50 | 2:5 | 60 | 37500 | 7500 |
| 1 | 50 | 2:6 | 60 | 37500 | 37500 |
| 1 | 50 | 2:7 | 300 | 37500 | 7500 |
| 1 | 50 | 2:8 | 300 | 37500 | 37500 |
| Group mean titre (mean ± SD) | | | 150 ± 124 | 52500 ± 55549 | 37500 ± 62105 |
| 3 | 50 | 3:1 | 60 | 37500 | 7500 |
| 3 | 50 | 3:2 | 300 | 37500 | 37500 |
| 3 | 50 | 3:3 | 300 | 37500 | 7500 |
| 3 | 50 | 3:4 | 60 | 37500 | 7500 |
| 3 | 50 | 3:5 | 300 | 37500 | 7500 |
| 3 | 50 | 3:6 | 60 | 37500 | 7500 |
| 3 | 50 | 3:7 | — | 7500 | 37500 |
| 3 | 50 | 3:8 | 1500 | 7500 | 37500 |
| Group mean titre (mean ± SD) | | | 387 ± 513 | 30000 ± 13887 | 18750 ± 15526 |
| 10 | 50 | 4:1 | 300 | 7500 | 7500 |
| 10 | 50 | 4:2 | 300 | 37500 | 37500 |

TABLE 15-continued

| Amount ribavirin (mg/dose) | Amount immunogen (µg/dose) | Mouse ID | Antibody titre to rNS3 at indicated week | | |
|---|---|---|---|---|---|
| | | | Week 4 | Week 6 | Week 8 |
| 10 | 50 | 4:3 | 60 | 7500 | 7500 |
| 10 | 50 | 4:4 | 60 | 7500 | 7500 |
| 10 | 50 | 4:5 | 60 | 1500 | 1500 |
| 10 | 50 | 4:6 | 60 | 7500 | 37500 |
| 10 | 50 | 4:7 | — | 7500 | 7500 |
| 10 | 50 | 8:8 | 60 | 37500 | 7500 |
| Group mean titre (mean ± SD) | | | 140 ± 124 | 10929 ± 11928 | 15214 ± 15380 |

TABLE 16

| Group | Week | Mean ± SD | Group | Mean ± SD | analysis | p-value |
|---|---|---|---|---|---|---|
| 10 µg NS3/no ribavirin | 4 | 180 ± 139 | 10 µg NS3/ 1 mg ribavirin | 252 ± 107 | Students t-test | 0.4071 |
| | 6 | 7500 ± 12421 | | 28071 ± 16195 | Students t-test | 0.0156* |
| | 8 | 3042 ± 3076 | | 36642 ± 67565 | Students t-test | 0.2133 |
| 10 µg NS3/no ribavirin | 4 | 180 ± 139 | 10 µg NS3/ 3 mg ribavirin | 180 ± 128 | Students t-test | 1.000 |
| | 6 | 7500 ± 12421 | | 30000 ± 13887 | Students t-test | 0.0042** |
| | 8 | 3042 ± 3076 | | 22500 ± 34637 | Students t-test | 0.0077** |
| 10 µg NS3/no ribavirin | 4 | 180 ± 139 | 10 µg NS3/ 10 mg ribavirin | 220 ± 139 | Students t-test | 0.7210 |
| | 6 | 7500 ± 12421 | | 18300 ± 18199 | Students t-test | 0.1974 |
| | 8 | 3042 ± 3076 | | 18300 ± 18199 | Students t-test | 0.0493* |

TABLE 17

| Group | Week | Mean ± SD | Group | Mean ± SD | analysis | p-value |
|---|---|---|---|---|---|---|
| 50 µg NS3/no ribavirin | 4 | 100 ± 98 | 50 µg NS3/ 1 mg ribavirin | 150 ± 124 | Students t-test | 0.4326 |
| | 6 | 15214 ± 15380 | | 52500 ± 55549 | Students t-test | 0.1106 |
| | 8 | 10757 ± 12094 | | 37500 ± 62105 | Students t-test | 0.2847 |
| 50 µg NS3/no ribavirin | 4 | 100 ± 98 | 50 µg NS3/ 3 mg ribavirin | 387 ± 513 | Students t-test | 0.2355 |
| | 6 | 15214 ± 15380 | | 30000 ± 13887 | Students t-test | 0.0721 |
| | 8 | 10757 ± 12094 | | 18750 ± 15526 | Students t-test | 0.2915 |
| 50 µg NS3/no ribavirin | 4 | 100 ± 98 | 50 µg NS3/ 10 mg ribavirin | 140 ± 124 | Students t-test | 0.5490 |
| | 6 | 15214 ± 15380 | | 10929 ± 11928 | Students t-test | 0.5710 |
| | 8 | 10757 ± 12094 | | 15214 ± 15380 | Students t-test | 0.5579 |

Significance levels:
NS = not significant;
* = p < 0.05;
** = p < 0.01;
*** = p < 0.001

TABLE 18

| Group | Week | Mean ± SD | Group | Mean ± SD | analysis | p-value |
|---|---|---|---|---|---|---|
| 10 µg NS3/no ribavirin | 4 | 180 ± 139 | 10 µg NS3/1 mg ribavirin | 252 ± 107 | Mann-Whitney | 0.4280 |
|  | 6 | 7500 ± 12421 |  | 28071 ± 16195 | Mann-Whitney | 0.0253* |
|  | 8 | 3042 ± 3076 |  | 36642 ± 67565 | Mann-Whitney | 0.0245* |
| 10 µg NS3/no ribavirin | 4 | 180 ± 139 | 10 µg NS3/3 mg ribavirin | 180 ± 128 | Mann-Whitney | 0.0736 |
|  | 6 | 7500 ± 12421 |  | 30000 ± 13887 | Mann-Whitney | 0.0050** |
|  | 8 | 3042 ± 3076 |  | 22500 ± 34637 | Mann-Whitney | 0.0034** |
| 10 µg NS3/no ribavirin | 4 | 180 ± 139 | 10 µg NS3/10 mg ribavirin | 220 ± 139 | Mann-Whitney | 0.8986 |
|  | 6 | 7500 ± 12421 |  | 18300 ± 18199 | Mann-Whitney | 0.4346 |
|  | 8 | 3042 ± 3076 |  | 18300 ± 18199 | Mann-Whitney | 0.2102 |

TABLE 19

| Group | Week | Mean ± SD | Group | Mean ± SD | analysis | p-value |
|---|---|---|---|---|---|---|
| 50 µg NS3/no ribavirin | 4 | 100 ± 98 | 50 µg NS3/1 mg ribavirin | 150 ± 124 | Mann-Whitney | 0.1128 |
|  | 6 | 15214 ± 15380 |  | 52500 ± 55549 | Mann-Whitney | 0.0210* |
|  | 8 | 10757 ± 12094 |  | 37500 ± 62105 | Mann-Whitney | 0.1883 |
| 50 µg NS3/no ribavirin | 4 | 100 ± 98 | 50 µg NS3/3 mg ribavirin | 387 ± 513 | Mann-Whitney | 0.1400 |
|  | 6 | 15214 ± 15380 |  | 30000 ± 13887 | Mann-Whitney | 0.0679 |
|  | 8 | 10757 ± 12094 |  | 18750 ± 15526 | Mann-Whitney | 0.2091 |
| 50 µg NS3/no ribavirin | 4 | 100 ± 98 | 50 µg NS3/10 mg ribavirin | 140 ± 124 | Mann-Whitney | 0.4292 |
|  | 6 | 15214 ± 15380 |  | 10929 ± 11928 | Mann-Whitney | 0.9473 |
|  | 8 | 10757 ± 12094 |  | 15214 ± 15380 | Mann-Whitney | 0.6279 |

Significance levels:
NS = not significant;
* = p < 0.05;
** = p < 0.01;
*** = p < 0.001

The data above demonstrates that ribavirin facilitates or enhances an immune response to an HCV antigen or HCV epitopes. A potent immune response to rNS3 was elicited after immunization with a vaccine composition comprising as little as 1 mg ribavirin and 10 µg of antigen. The data above also provide evidence that the amount of ribavirin that is sufficient to facilitate an immune response to an antigen is between 1 and 3 mg per injection for a 25-30 g Balb/c mouse. It should be realized, however, that these amounts are intended for guidance only and should not be interpreted to limit the scope of the invention in any way. Nevertheless, the data shows that vaccine compositions comprising approximately 1 to 3 mg doses of ribavirin induce an immune response that is more than 12 times higher than the immune response elicited in the absence of without ribavirin. Thus, ribavirin has a significant adjuvant effect on the humoral immune response of an animal and thereby, enhances or facilitates the immune response to the antigen. The example below describes experiments that were performed to better understand the amount of ribavirin needed to enhance or facilitate an immune response to an antigen.

EXAMPLE 10

Figure 15:
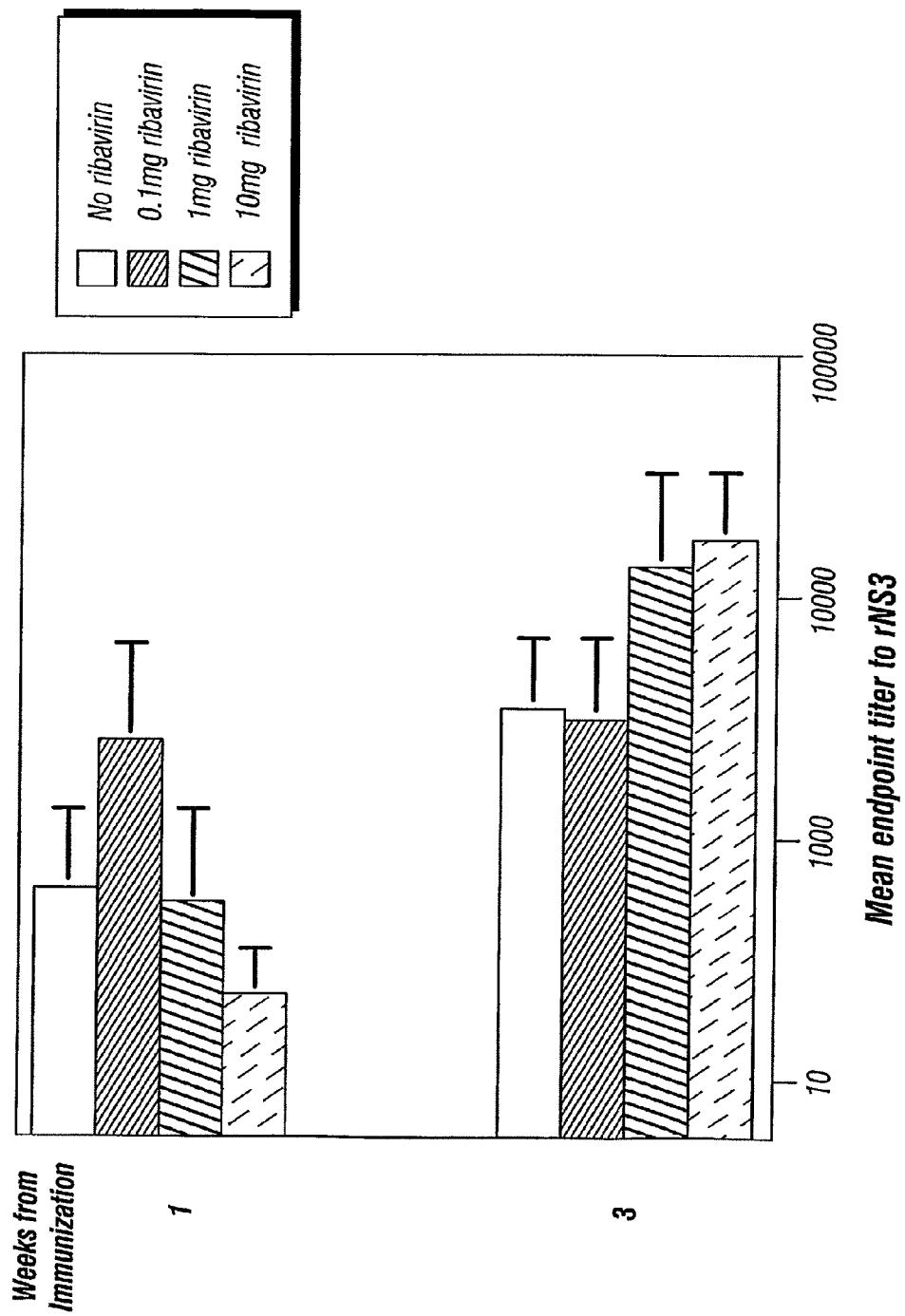
FIG. 15 is a graph showing the humoral response to 20 µg recombinant Hepatitis C virus (HCV) non structural 3 protein (NS3), as determined by mean end point titres, when a single dose of 0.1, 1.0, or 10 mg of ribavirin was co-administered.

To determine a dose of ribavirin that is sufficient to provide an adjuvant effect, the following experiments were performed. In a first set of experiments, groups of mice (three per group) were immunized with a 20 µg rNS3 alone or a mixture of 20 µg rNS3 and 0.1 mg, 1 mg, or 10 mg ribavirin. The levels of antibody to the antigen were then determined by EIA. The mean endpoint titers at weeks 1 and 3 were plotted and are shown in FIG. 15. It was discovered that the adjuvant effect provided by ribavirin had different kinetics depending on the dose of ribavirin provided. For example, even low doses (<1 mg) of ribavirin were found to enhance antibody levels at week one but not at week three, whereas, higher doses (1-10 mg) were found to enhance antibody levels at week three.

A second set of experiments was also performed. In these experiments, groups of mice were injected with vaccine compositions comprising various amounts of ribavirin and rNS3 and the IgG response in these animals was monitored. The vaccine compositions comprised approximately 100 µl phosphate buffered saline and 20 µg rNS3 with or without 0.1 mg, 1.0 mg, or 10 mg ribavirin (Sigma). The mice were bled at week six and rNS3-specific IgG levels were determined by EIA as described previously. As shown in TABLE 20, the adjuvant effects on the sustained antibody levels were most obvious in the dose range of 1 to 10 mg per injection for a 25-30 g mouse.

TABLE 20

| Immunogen | Amount (mg) ribavirin mixed with the immunogen | Mouse ID | Endpoint titre of rNS3 IgG at indicated week | | |
|---|---|---|---|---|---|
| | | | Week 1 | Week 2 | Week 3 |
| 20 µg rNS3 | None | 1 | 60 | 360 | 360 |
| 20 µg rNS3 | None | 2 | 360 | 360 | 2160 |
| 20 µg rNS3 | None | 3 | 360 | 2160 | 2160 |
| | | Mean | 260 ± 173 | 960 ± 1039 | 1560 ± 1039 |
| 20 µg rNS3 | 0.1 | 4 | 2160 | 12960 | 2160 |
| 20 µg rNS3 | 0.1 | 5 | 60 | 60 | 60 |
| 20 µg rNS3 | 0.1 | 6 | <60 | 2160 | 2160 |
| | | | 1110 ± 1484 | 5060 ± 6921 | 1460 ± 1212 |
| 20 µg rNS3 | 1.0 | 7 | <60 | 60 | 12960 |
| 20 µg rNS3 | 1.0 | 8 | <60 | 2160 | 2160 |
| 20 µg rNS3 | 1.0 | 9 | 360 | 2160 | 2160 |
| | | Mean | 360 | 1460 ± 1212 | 5760±6235 |
| 20 µg rNS3 | 10.0 | 10 | 360 | 12960 | 77760 |
| 20 µg rNS3 | 10.0 | 11 | <60 | 2160 | 12960 |
| 20 µg rNS3 | 10.0 | 12 | 360 | 2160 | 2160 |
| | | Mean | 360 | 5760 ± 6235 | 30960 ± 40888 |

In a third set of experiments, the adjuvant effect of ribavirin after primary and booster injections was investigated. In these experiments, mice were given two intraperitoneal injections of a vaccine composition comprising 10 µg rNS3 with or without ribavirin and the IgG subclass responses to the antigen was monitored, as before. Accordingly, mice were immunized with 100 µl phosphate buffered containing 10 µg recombinant NS3 alone, with or without 0.1 or 1.0 mg ribavirin (Sigma) at weeks 0 and 4. The mice were bled at week six and NS3-specific IgG subclasses were determined by EIA as described previously. As shown in TABLE 21, the addition of ribavirin to the immunogen prior to the injection does not change the IgG subclass response in the NS3-specific immune response. Thus, the adjuvant effect of a vaccine composition comprising ribavirin and an antigen can not be explained by a shift in of the Th1/Th2-balance. It appears that another mechanism may be responsible for the adjuvant effect of ribavirin.

TABLE 21

| Immunogen | Amount (mg) ribavirin mixed with the immunogen | Mouse ID | IgG1 | IgG2a | IgG2b | IgG3 |
|---|---|---|---|---|---|---|
| 10 µg rNS3 | None | 1 | 360 | 60 | <60 | 60 |
| 10 µg rNS3 | None | 2 | 360 | <60 | <60 | 60 |
| 10 µg rNS3 | None | 3 | 2160 | 60 | <60 | 360 |
| | | Mean | 960 ± 1039 | 60 | — | 160 ± 173 |
| 10 µg rNS3 | 0.1 | 4 | 360 | <60 | <60 | 60 |
| 10 µg rNS3 | 0.1 | 5 | 60 | <60 | <60 | <60 |
| 10 µg rNS3 | 0.1 | 6 | 2160 | 60 | 60 | 360 |
| | | | 860 ± 1136 | 60 | 60 | 210 ± 212 |
| 10 µg rNS3 | 1.0 | 7 | 2160 | <60 | <60 | 60 |
| 10 µg rNS3 | 1.0 | 8 | 360 | <60 | <60 | <60 |
| 10 µg rNS3 | 1.0 | 9 | 2160 | <60 | <60 | 60 |
| | | Mean | 1560 ± 1039 | — | — | 60 |

The data presented in this example further verify that ribavirin can be administered as an adjuvant and establish that the dose of ribavirin can modulate the kinetics of the adjuvant effect. The example below describes another assay that was performed to evaluate the ability of ribavirin to enhance or facilitate an immune response to an antigen.

EXAMPLE 11

This assay can be used with any ribavirin derivative or combinations of ribavirin derivatives to determine the extent that a particular vaccine formulation modulates a cellular immune response. To determine CD4+ T cell responses to a ribavirin-containing vaccine, groups of mice were immunized s.c. with either 100 µg rNS3 in PBS or 100 µg rNS3 and 1 mg ribavirin in PBS. The mice were sacrificed ten days post-immunization and their lymph nodes were harvested and drained. In vitro recall assays were then performed. (See e.g., Hultgren et al., *J Gen Virol.* 79:2381-91 (1998) and Hultgren et al., *Clin. Diagn. Lab. Immunol.* 4:630-632 (1997)). The amount of CD4+ T cell proliferation was determined at 96 h of culture by the incorporation of [$^3$H] thymidine.

Figure 16:
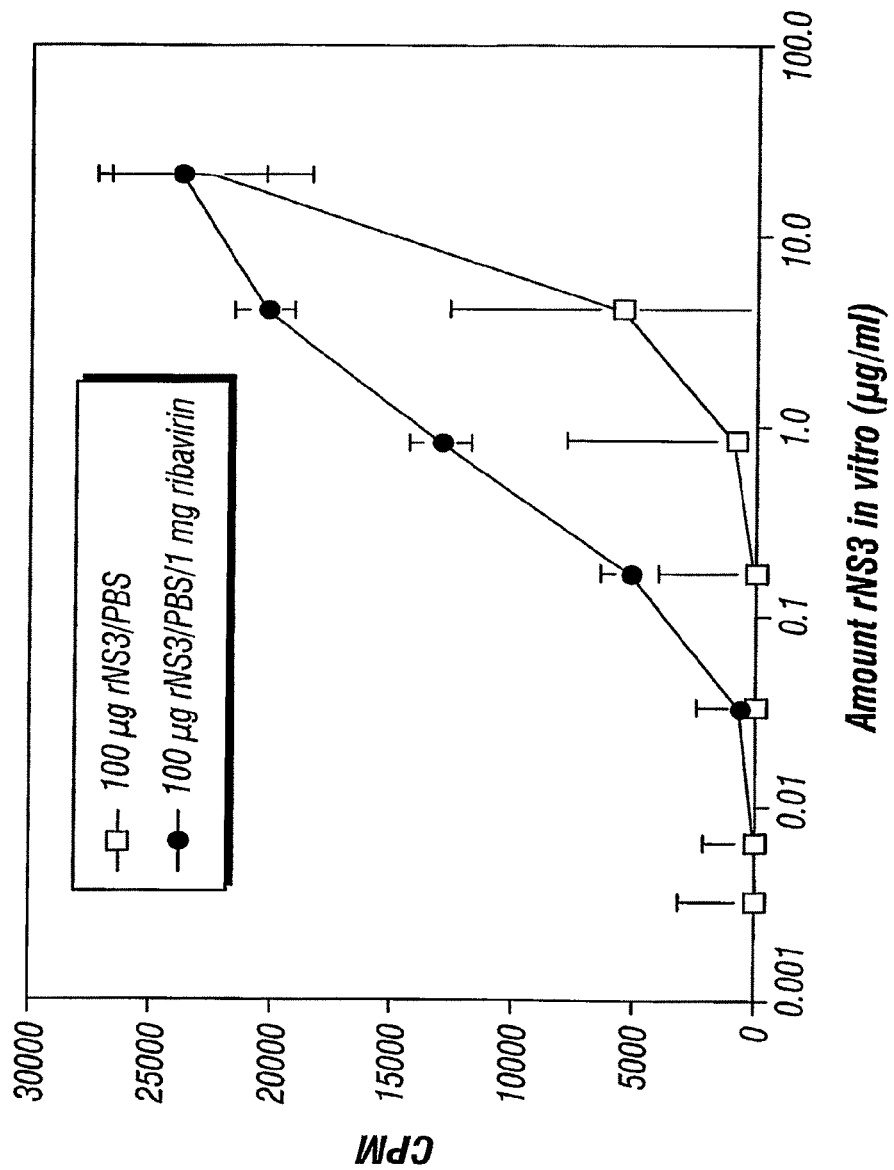
FIG. 16 is a graph showing the effects of a single dose of 1 mg ribavirin on NS3-specific lymph node proliferative responses, as determined by in vitro recall responses.

As shown in FIG. 16, mice that were immunized with 100 µg rNS3 mixed with 1 mg ribavirin had a much greater T cell proliferative response than mice that were immunized with 100 µg rNS3 in PBS. This data provides more evidence that ribavirin enhances or facilitates a cellular immune response (e.g., by promoting the effective priming of T cells).

Additional experiments were conducted to verify that ribavirin enhances the immune response to commercially available vaccine preparations. The example below describes the use of ribavirin in conjunction with a commercial HBV vaccine preparation.

EXAMPLE 12

The adjuvant effect of ribavirin was tested when mixed with two doses of a commercially available vaccine containing HBsAg and alum. (Engerix, SKB). Approximately 0.2 µg or 2 µg of Engerix vaccine was mixed with either PBS or 1 mg ribavirin in PBS and the mixtures were injected intra peritoneally into groups of mice (three per group). A booster containing the same mixture was given on week four and all mice were bled on week six. The serum samples were diluted from 1:60 to 1:37500 and the dilutions were tested by EIA, as described above, except that purified human HBsAg was used as the solid phase antigen. As shown in TABLE 22, vaccine formulations having ribavirin enhanced the response to 2 µg of an existing vaccine despite the fact that the vaccine already contained alum. That is, by adding ribavirin to a suboptimal vaccine dose (i.e., one that does not induce detectable antibodies alone) antibodies became detectable, providing evidence that the addition of ribavirin allows for the use of lower antigen amounts in a vaccine formulation without compromising the immune response.

TABLE 22

| | End point antibody titer to HBsAg in EIA | | | | | | | | | | | |
|---|---|---|---|---|---|---|---|---|---|---|---|---|
| | 0.02 µg Engerix | | | | | | 0.2 µg Engerix | | | | | |
| | No ribavirin | | | 1 mg ribavirin | | | No ribavirin | | | 1 mg ribavirin | | |
| Week | #1 | #2 | #3 | #1 | #2 | #3 | #1 | #2 | #3 | #1 | #2 | #3 |
| 6 | <60 | <60 | <60 | <60 | <60 | <60 | <60 | <60 | <60 | 300 | 60 | <60 |

The ribavirin used in the experiments above was obtained from commercial suppliers (e.g., Sigma and ICN). The ribavirin that can be used with the embodiments described herein can also be obtained from commercial suppliers or can be synthesized. The ribavirin and/or the antigen can be formulated with and without modification. For example, the ribavirin can be modified or derivatized to make a more stable molecule and/or a more potent adjuvant. By one approach, the stability of ribavirin can be enhanced by coupling the molecules to a support such as a hydrophilic polymer (e.g., polyethylene glycol).

Many more ribavirin derivatives can be generated using conventional techniques in rational drug design and combinatorial chemistry. For example, Molecular Simulations Inc. (MSI), as well as many other suppliers, provide software that allows one of skill to build a combinatorial library of organic molecules. The C2.Analog Builder program, for example, can be integrated with MSI's suite of Cerius2 molecular diversity software to develop a library of ribavirin derivatives that can be used with the embodiments described herein. (See e.g., http://msi.com/life/products/cerius2/index.html).

By one approach, the chemical structure of ribavirin is recorded on a computer readable media and is accessed by one or more modeling software application programs. The C2.Analog Builder program in conjunction with C2Diversity program allows the user to generate a very large virtual library based on the diversity of R-groups for each substituent position, for example. Compounds having the same structure as the modeled ribavirin derivatives created in the virtual library are then made using conventional chemistry or can be obtained from a commercial source.

The newly manufactured ribavirin derivatives can then be screened in assays, which determine the extent of adjuvant activity of the molecule and/or the extent of its ability to modulate of an immune response. Some assays may involve virtual drug screening software, such as C2.Ludi. C2.Ludi is a software program that allows a user to explore databases of molecules (e.g., ribavirin derivatives) for their ability to interact with the active site of a protein of interest (e.g., RAC2 or another GTP binding protein). Based upon predicted interactions discovered with the virtual drug screening software, the ribavirin derivatives can be prioritized for further characterization in conventional assays that determine adjuvant activity and/or the extent of a molecule to modulate an immune response. The section below provides more explanation concerning the methods of using the compositions described herein.

Methods of Using the Vaccine Compositions and Immunogen Preparations

Routes of administration of the embodiments described herein include, but are not limited to, transdermal, parenteral, gastrointestinal, transbronchial, and transalveolar. Transdermal administration can be accomplished by application of a cream, rinse, gel, etc. capable of allowing the adjuvant and HCV antigen to penetrate the skin. Parenteral routes of administration include, but are not limited to, electrical or direct injection such as direct injection into a central venous line, intravenous, intramuscular, intraperitoneal, intradermal, or subcutaneous injection. Gastrointestinal routes of administration include, but are not limited to, ingestion and rectal. Transbronchial and transalveolar routes of administration include, but are not limited to, inhalation, either via the mouth or intranasally.

Compositions having the adjuvant and HCV antigen that are suitable for transdermal administration include, but are not limited to, pharmaceutically acceptable suspensions, oils, creams, and ointments applied directly to the skin or incorporated into a protective carrier such as a transdermal device ("transdermal patch"). Examples of suitable creams, ointments, etc. can be found, for instance, in the Physician's Desk Reference. Examples of suitable transdermal devices are described, for instance, in U.S. Pat. No. 4,818,540 issued Apr. 4, 1989 to Chinen, et al.

Compositions having the adjuvant and HCV antigen that are suitable for parenteral administration include, but are not limited to, pharmaceutically acceptable sterile isotonic solutions. Such solutions include, but are not limited to, saline, phosphate buffered saline and oil preparations for injection into a central venous line, intravenous, intramuscular, intraperitoneal, intradermal, or subcutaneous injection.

Compositions having the adjuvant and HCV antigen that are suitable for transbronchial and transalveolar administration include, but not limited to, various types of aerosols for inhalation. Devices suitable for transbronchial and transalveolar administration of these are also embodiments. Such devices include, but are not limited to, atomizers and vaporizers. Many forms of currently available atomizers and vaporizers can be readily adapted to deliver vaccines having ribavirin and an antigen.

Compositions having the adjuvant and HCV antigen that are suitable for gastrointestinal administration include, but not limited to, pharmaceutically acceptable powders, pills or liquids for ingestion and suppositories for rectal administration.

The gene constructs described herein, in particular, may be administered by means including, but not limited to, traditional syringes, needleless injection devices, or "microprojectile bombardment gene guns". Alternatively, the genetic vaccine may be introduced by various means into cells that are removed from the individual. Such means include, for example, ex vivo transfection, electroporation, microinjection and microprojectile bombardment. After the gene construct is taken up by the cells, they are reimplanted into the individual. It is contemplated that otherwise non-immunogenic cells that have gene constructs incorporated therein can be implanted into the individual even if the vaccinated cells were originally taken from another individual.

According to some embodiments, the gene construct is administered to an individual using a needleless injection device. According to some embodiments, the gene construct is simultaneously administered to an individual intradermally, subcutaneously and intramuscularly using a needleless injection device. Needleless injection devices are well known and widely available. One having ordinary skill in the art can, following the teachings herein, use needleless injection devices to deliver genetic material to cells of an individual. Needleless injection devices are well suited to deliver genetic material to all tissue. They are particularly useful to deliver genetic material to skin and muscle cells. In some embodiments, a needleless injection device may be used to propel a liquid that contains DNA molecules toward the surface of the individual's skin. The liquid is propelled at a sufficient velocity such that upon impact with the skin the liquid penetrates the surface of the skin, permeates the skin and muscle tissue therebeneath. Thus, the genetic material is simultaneously administered intradermally, subcutaneously and intramuscularly. In some embodiments, a needleless injection device may be used to deliver genetic material to tissue of other organs in order to introduce a nucleic acid molecule to cells of that organ.

Preferred embodiments concern methods of treating or preventing HCV infection. In these embodiments, an animal in need is provided an HCV antigen (e.g., a peptide antigen or nucleic acid-based antigen, as described herein (SEQ. ID. NOs.: 1-27, 35-36, and 40-220 (including wild-type and codon optimized sequences encoding SEQ ID NOs: 40-220) and an amount of adjuvant sufficient to exhibit an adjuvant activity in said animal. Accordingly, an animal can be identified as one in need by using currently available diagnostic testing or clinical evaluation. The adjuvant and antigen can be provided separately or in combination, and other adjuvants (e.g., oil, alum, or other agents that enhance an immune response) can also be provided to the animal in need.

Other embodiments of the invention include methods of enhancing an immune response to an HCV antigen by providing an animal in need with an amount of adjuvant (e.g., ribavirin) and one or more of SEQ. ID. NOs.: 1-11, 35-36, and 40-220 (or a wild type or codon-optimized nucleic acid encoding SEQ ID NOs: 40-220) or a fragment thereof, preferably SEQ. ID. NOs.: 12-27 that is effective to enhance said immune response. In these embodiments, an animal in need of an enhanced immune response to an antigen is identified by using currently available diagnostic testing or clinical evaluation. By one approach, for example, an uninfected individual is provided with the vaccine compositions described above in an amount sufficient to elicit a cellular and humoral immune response to NS3 so as to protect said individual from becoming infected with HCV. In another embodiment, an HCV-infected individual is identified and provided with a vaccine composition comprising ribavirin and NS3 in an amount sufficient to enhance the cellular and humoral immune response against NS3 so as to reduce or eliminate the HCV infection. Such individual may be in the chronic or acute phase of the infection. In yet another embodiment, an HCV-infected individual suffering from HCC is provided with a composition comprising an adjuvant and the NS3/4A fusion gene in an amount sufficient to elicit a cellular and humoral immune response against NS3-expressing tumor cells.

The next section describes some of the peptide embodiments of the invention.

HCV Peptides

The embodied HCV peptides or derivatives thereof, include but are not limited to, those containing as a primary amino acid sequence all of the amino acid sequence substantially as depicted in the Sequence Listing (SEQ. ID. NOs.: 2-11, 36, and SEQ ID NOs: 40-220) and fragments of SEQ. ID. NOs.: 2-11 and SEQ. ID. NO.: 36 that are at least four amino acids in length (e.g., SEQ. ID. NOs.: 14-16) including altered sequences in which functionally equivalent amino acid residues are substituted for residues within the sequence resulting in a silent change. Preferred fragments of a sequence of SEQ. ID. NOs.: 2-11 and SEQ. ID. NO.: 36 are at least four amino acids and comprise amino acid sequence unique to the discovered NS3/4A peptide or mutants thereof including altered sequences in which functionally equivalent amino acid residues are substituted for residues within the sequence resulting in a silent change. The HCV peptides can be, for example, at least 12-704 amino acids in length (e.g., any number between 12-15, 15-20, 20-25, 25-50, 50-100, 100-150, 150-250, 250-500 or 500-704 amino acids in length).

Embodiments also include HCV peptides that are substantially identical to those described above. That is, HCV peptides that have one or more amino acid residues within SEQ. ID. NOs.: 2-11, 36, and 40-220 and fragments thereof that are substituted by another amino acid of a similar polarity that acts as a functional equivalent, resulting in a silent alteration. Further, the HCV peptides can have one or more amino acid residues fused to SEQ. ID. NOs.: 2-11, 36 and SEQ ID NO: 40-220 or a fragment thereof so long as the fusion does not significantly alter the structure or function (e.g., immunogenic properties) of the HCV peptide. Substitutes for an amino acid within the sequence can be selected from other members of the class to which the amino acid belongs. For example, the non-polar (hydrophobic) amino acids include alanine, leucine, isoleucine, valine, proline, phenylalanine, tryptophan, and methionine. The polar neutral amino acids include glycine, serine, threonine, cysteine, tyrosine, asparagine and glutamine. The positively charged (basic) amino acids include arginine, lysine, and histidine. The negatively charged (acidic) amino acids include aspartic acid and glutamic acid. The aromatic amino acids include phenylalanine, tryptophan, and tyrosine. Accordingly, the peptide embodiments of the invention are said to be consisting essentially of SEQ. ID. NOs.: 2-27, 36 and SEQ ID NOs: 40-220 in light of the modifications described above.

The HCV peptides described herein can be prepared by chemical synthesis methods (such as solid phase peptide synthesis) using techniques known in the art such as those set forth by Merrifield et al., *J. Am. Chem. Soc.* 85:2149 (1964), Houghten et al., *Proc. Natl. Acad. Sci. USA,* 82:51:32 (1985), Stewart and Young (*Solid phase peptide synthesis*, Pierce Chem. Co., Rockford, Ill. (1984), and Creighton, 1983, *Proteins: Structures and Molecular Principles*, W. H. Freeman & Co., N.Y. Such polypeptides can be synthesized with or without a methionine on the amino terminus. Chemically synthesized HCV peptides can be oxidized using methods set forth in these references to form disulfide bridges.

While the HCV peptides described herein can be chemically synthesized, it can be more effective to produce these polypeptides by recombinant DNA technology. Such methods can be used to construct expression vectors containing the HCV nucleotide sequences described above, for example, and appropriate transcriptional and translational control signals. These methods include, for example, in vitro recombinant DNA techniques, synthetic techniques, and in vivo genetic recombination. Alternatively, RNA capable of encoding an HCV nucleotide sequence can be chemically synthesized using, for example, synthesizers. See, for example, the techniques described in *Oligonucleotide Synthesis,* 1984, Gait, M. J. ed., IRL Press, Oxford. Accordingly, several embodiments concern cell lines that have been engineered to express the embodied HCV peptides. For example, some cells are made to express the HCV peptides of SEQ. ID. NOs.: 2-11, 36 and SEQ ID NOs: 40-220 or fragments of these molecules (e.g., SEQ. ID. NOs.: 14-26).

A variety of host-expression vector systems can be utilized to express the embodied HCV peptides. Suitable expression systems include, but are not limited to, microorganisms such as bacteria (e.g., *E. coli* or *B. subtilis*) transformed with recombinant bacteriophage DNA, plasmid DNA or cosmid DNA expression vectors containing HCV nucleotide sequences; yeast (e.g., *Saccharomyces, Pichia*) transformed with recombinant yeast expression vectors containing the HCV nucleotide sequences; insect cell systems infected with recombinant virus expression vectors (e.g., baculovirus) containing the HCV sequences; plant cell systems infected with recombinant virus expression vectors (e.g., cauliflower mosaic virus, CaMV; tobacco mosaic virus, TMV) or transformed with recombinant plasmid expression vectors (e.g., Ti plasmid) containing HCV sequences; or mammalian cell systems (e.g., COS, CHO, BHK, 293, 3T3) harboring recombinant expression constructs containing promoters derived from the genome of mammalian cells (e.g., metallothionein promoter) or from mammalian viruses (e.g., the adenovirus late promoter; the vaccinia virus 7.5K promoter).

In bacterial systems, a number of expression vectors can be advantageously selected depending upon the use intended for the HCV gene product being expressed. For example, when a large quantity of such a protein is to be produced, for the generation of pharmaceutical compositions of HCV peptide or for raising antibodies to the HCV peptide, for example, vectors which direct the expression of high levels of fusion protein products that are readily purified can be desirable. Such vectors include, but are not limited to, the *E. coli* expression vector pUR278 (Ruther et al., *EMBO J.,* 2:1791 (1983), in which the HCV coding sequence can be ligated individually into the vector in frame with the lacZ coding region so that a fusion protein is produced; pIN vectors (Inouye & Inouye, *Nucleic Acids Res.,* 13:3101-3109 (1985); Van Heeke & Schuster, *J. Biol. Chem.,* 264:5503-5509 (1989)); and the like. The pGEX vectors can also be used to express foreign polypeptides as fusion proteins with glutathione S-transferase (GST). In general, such fusion proteins are soluble and can be purified from lysed cells by adsorption to glutathione-agarose beads followed by elution in the presence of free glutathione. The PGEX vectors are designed to include thrombin or factor Xa protease cleavage sites so that the cloned target gene product can be released from the GST moiety.

In an insect system, *Autographa californica* nuclear polyhedrosis virus (AcNPV) is used as a vector to express foreign genes. The virus grows in *Spodoptera frugiperda* cells. The HCV coding sequence can be cloned individually into non-essential regions (for example the polyhedrin gene) of the virus and placed under control of an AcNPV promoter (for example the polyhedrin promoter). Successful insertion of an HCV gene coding sequence will result in inactivation of the polyhedrin gene and production of non-occluded recombinant virus, (i.e., virus lacking the proteinaceous coat coded for by the polyhedrin gene). These recombinant viruses are then used to infect *Spodoptera frugiperda* cells in which the inserted gene is expressed. (See e.g., Smith et al., *J. Virol.* 46: 584 (1983); and Smith, U.S. Pat. No. 4,215,051).

In mammalian host cells, a number of viral-based expression systems can be utilized. In cases where an adenovirus is used as an expression vector, the HCV nucleotide sequence of interest can be ligated to an adenovirus transcription/translation control complex, e.g., the late promoter and tripartite leader sequence. This chimeric gene can then be inserted in the adenovirus genome by in vitro or in vivo recombination. Insertion in a non-essential region of the viral genome (e.g., region E1 or E3) will result in a recombinant virus that is viable and capable of expressing the HCV gene product in infected hosts. (See e.g., Logan & Shenk, *Proc. Natl. Acad. Sci. USA* 81:3655-3659 (1984)). Specific initiation signals can also be required for efficient translation of inserted HCV nucleotide sequences. These signals include the ATG initiation codon and adjacent sequences.

However, in cases where only a portion of the HCV coding sequence is inserted, exogenous translational control signals, including, perhaps, the ATG initiation codon, can be provided. Furthermore, the initiation codon can be in phase with the reading frame of the desired coding sequence to ensure translation of the entire insert. These exogenous translational control signals and initiation codons can be of a variety of origins, both natural and synthetic. The efficiency of expression can be enhanced by the inclusion of appropriate transcription enhancer elements, transcription terminators, etc. (See Bittner et al., *Methods in Enzymol.*, 153:516-544 (1987)).

In addition, a host cell strain can be chosen, which modulates the expression of the inserted sequences, or modifies and processes the gene product in the specific fashion desired. Such modifications (e.g., glycosylation) and processing (e.g., cleavage) of protein products are important for the function of the protein. Different host cells have characteristic and specific mechanisms for the post-translational processing and modification of proteins and gene products. Appropriate cell lines or host systems can be chosen to ensure the correct modification and processing of the foreign protein expressed. To this end, eukaryotic host cells that possess the cellular machinery for proper processing of the primary transcript, glycosylation, and phosphorylation of the gene product can be used. Such mammalian host cells include, but are not limited to, CHO, VERO, BHK, HeLa, COS, MDCK, 293, 3T3, and WI38.

For long-term, high-yield production of recombinant proteins, stable expression is preferred. For example, cell lines that stably express the HCV peptides described above can be engineered. Rather than using expression vectors that contain viral origins of replication, host cells can be transformed with DNA controlled by appropriate expression control elements (e.g., promoter, enhancer sequences, transcription terminators, polyadenylation sites, etc.), and a selectable marker. Following the introduction of the foreign DNA, engineered cells are allowed to grow for 1-2 days in an enriched media, and then are switched to a selective media. The selectable marker in the recombinant plasmid confers resistance to the selection and allows cells to stably integrate the plasmid into their chromosomes and grow to form foci which in turn are cloned and expanded into cell lines. This method is advantageously used to engineer cell lines which express the HCV gene product.

A number of selection systems can be used, including but not limited to the herpes simplex virus thymidine kinase (Wigler, et al., *Cell* 11:223 (1977), hypoxanthine-guanine phosphoribosyltransferase (Szybalska & Szybalski, *Proc. Natl. Acad. Sci. USA* 48:2026 (1962)), and adenine phosphoribosyltransferase (Lowy, et al., *Cell* 22:817 (1980)) genes can be employed in tk$^-$, hgprf$^-$ or aprf$^-$ cells, respectively. Also, antimetabolite resistance can be used as the basis of selection for the following genes: dhfr, which confers resistance to methotrexate (Wigler, et al., *Proc. Natl. Acad. Sci. USA* 77:3567 (1980); O'Hare, et al., *Proc. Natl. Acad. Sci. USA* 78:1527 (1981)); gpt, which confers resistance to mycophenolic acid (Mulligan & Berg, *Proc. Natl. Acad. Sci. USA* 78:2072 (1981)); neo, which confers resistance to the aminoglycoside G-418 (Colberre-Garapin, et al., *J. Mol. Biol.* 150:1 (1981)); and hygro, which confers resistance to hygromycin (Santerre, et al., *Gene* 30:147 (1984)).

Alternatively, any fusion protein can be readily purified by utilizing an antibody specific for the fusion protein being expressed. For example, a system described by Janknecht et al. allows for the ready purification of non-denatured fusion proteins expressed in human cell lines. (Janknecht, et al., *Proc. Natl. Acad. Sci. USA* 88: 8972-8976 (1991)). In this system, the gene of interest is subcloned into a vaccinia recombination plasmid such that the gene's open reading frame is translationally fused to an amino-terminal tag consisting of six histidine residues. Extracts from cells infected with recombinant vaccinia virus are loaded onto Ni$^{2+}$ nitrilo-acetic acid-agarose columns and histidine-tagged proteins are selectively eluted with imidazole-containing buffers. The example below describes a method that was used to express the HCV peptides encoded by the embodied nucleic acids.

EXAMPLE 13

To characterize NS3/4A-pVAX, MSLF1-pVAX, and the NS3/4A mutant constructs, described in Example 1, the plasmids were transcribed and translated in vitro, and the resulting polypeptides were visualized by sodium dodecyl sulfate-polyacrylamide gel electrophoresis (SDS-PAGE). In vitro transcription and translation were performed using the T7 coupled reticulocyte lysate system (Promega, Madison, Wis.) according to the manufacturer's instructions. All in vitro translation reactions of the expression constructs were carried out at 30° C. with $^{35}$S-labeled methionine (Amersham International, Plc, Buckinghamshire, UK). The labeled proteins were separated by 12% SDS-PAGE and visualized by exposure to X-ray film (Hyper Film-MP, Amersham) for 6-18 hours.

The in vitro analysis revealed that all proteins were expressed to high amounts from their respective expression constructs. The rNS3 construct (NS3-pVAX vector) produced a single peptide of approximately 61 kDa, whereas, the mutant constructs (e.g., the TGT construct (NS3/4A-TGT-pVAX) and the RGT construct (NS3/4A-RGT-pVAX)) produced a single polypeptide of approximately 67 kDa, which is identical to the molecular weight of the uncleaved NS3/4A peptide produced from the NS3/4A-pVAX construct. The cleaved product produced from the expressed NS3/4A peptide was approximately 61 kDa, which was identical in size to the rNS3 produced from the NS3-pVAX vector. These results demonstrated that the expression constructs were functional, the NS3/4A construct was enzymatically active, the rNS3 produced a peptide of the predicted size, and the breakpoint mutations completely abolished cleavage at the NS3-NS4A junction.

To compare the translation efficiency from the NS3/4A-pVAX and MSLF1-pVAX plasmids, the amount of input DNA was serially diluted prior to addition to the assay. Serial dilutions of the plasmids revealed that the MSLF1 plasmid gave stronger bands at higher dilutions of the plasmid than the wild-type NS3/4A plasmid, providing evidence that in vitro transcription and translation was more efficient from the MSLF1 plasmid. The NS3/4A-pVAX and MSLF1 plasmids were then analyzed for protein expression using transiently transfected Hep-G2 cells. Similar results were obtained in that the MSLF-1 gene provided more efficient expression of NS3 than the native NS3/4A gene.

The sequences, constructs, vectors, clones, and other materials comprising the embodied HCV nucleic acids and peptides can be in enriched or isolated form. As used herein, "enriched" means that the concentration of the material is many times its natural concentration, for example, at least about 2, 5, 10, 100, or 1000 times its natural concentration, advantageously 0.01%, by weight, preferably at least about 0.1% by weight. Enriched preparations from about 0.5% or more, for example, 1%, 5%, 10%, and 20% by weight are also contemplated. The term "isolated" requires that the material be removed from its original environment (e.g., the natural environment if it is naturally occurring). For example, a naturally-occurring polynucleotide present in a living animal is not isolated, but the same polynucleotide, separated from some or all of the coexisting materials in the natural system, is isolated. It is also advantageous that the sequences be in purified form. The term "purified" does not require absolute purity; rather, it is intended as a relative definition. Isolated proteins have been conventionally purified to electrophoretic homogeneity by Coomassie staining, for example. Purification of starting material or natural material to at least one order of magnitude, preferably two or three orders, and more preferably four or five orders of magnitude is expressly contemplated.

The HCV gene products described herein can also be expressed in plants, insects, and animals so as to create a transgenic organism. Desirable transgenic plant systems having an HCV peptide include *Arabadopsis*, maize, and *Chlamydomonas*. Desirable insect systems having an HCV peptide include, but are not limited to, *D. melanogaster* and *C. elegans*. Animals of any species, including, but not limited to, amphibians, reptiles, birds, mice, hamsters, rats, rabbits, guinea pigs, pigs, micro-pigs, goats, dogs, cats, and non-human primates, e.g., baboons, monkeys, and chimpanzees can be used to generate transgenic animals having an embodied HCV molecule. These transgenic organisms desirably exhibit germline transfer of HCV peptides described herein.

Any technique known in the art is preferably used to introduce the HCV transgene into animals to produce the founder lines of transgenic animals or to knock out or replace existing HCV genes. Such techniques include, but are not limited to pronuclear microinjection (Hoppe, P. C. and Wagner, T. E., 1989, U.S. Pat. No. 4,873,191); retrovirus mediated gene transfer into germ lines (Van der Putten et al., *Proc. Natl. Acad. Sci., USA* 82:6148-6152 (1985)); gene targeting in embryonic stem cells (Thompson et al., *Cell* 56:313-321 (1989)); electroporation of embryos (Lo, *Mol. Cell. Biol.* 3:1803-1814 (1983); and sperm-mediated gene transfer (Lavitrano et al., *Cell* 57:717-723 (1989)); see also Gordon, *Transgenic Animals, Intl. Rev. Cytol.* 115:171-229 (1989).

Following synthesis or expression and isolation or purification of the HCV peptides, the isolated or purified peptide can be used to generate antibodies. Depending on the context, the term "antibodies" can encompass polyclonal, monoclonal, chimeric, single chain, Fab fragments and fragments produced by a Fab expression library. Antibodies that recognize the HCV peptides have many uses including, but not limited to, biotechnological applications, therapeutic/prophylactic applications, and diagnostic applications.

For the production of antibodies, various hosts including goats, rabbits, rats, mice, and humans etc. can be immunized by injection with an HCV peptide. Depending on the host species, various adjuvants can be used to increase immunological response. Such adjuvants include, but are not limited to, ribavirin, Freund's, mineral gels such as aluminum hydroxide, and surface active substances such as lysolecithin, pluronic polyols, polyanions, peptides, oil emulsions, keyhole limpet hemocyanin, and dinitrophenol. BCG (*Bacillus* Calmette-Guerin) and *Corynebacterium parvum* are also potentially useful adjuvants.

Peptides used to induce specific antibodies can have an amino acid sequence consisting of at least four amino acids, and preferably at least 10 to 15 amino acids. By one approach, short stretches of amino acids encoding fragments of NS3/4A are fused with those of another protein such as keyhole limpet hemocyanin such that an antibody is produced against the chimeric molecule. Additionally, a composition comprising ribavirin and an HCV peptide (SEQ. ID. NOs.: 2-11, 40-220 and SEQ. ID. NO.: 36), a fragment thereof containing any number of consecutive amino acids between at least 3-50 (e.g., 3, 4, 6, 8, 10, 12, 15, 20, 25, 30, 35, 40, 45, or 50 amino acids) (e.g., SEQ. ID. NOs.: 4-26), or a nucleic acid encoding one or more of these molecules is administered to an animal, preferably a mammal including a human. While antibodies capable of specifically recognizing HCV can be generated by injecting synthetic 3-mer, 10-mer, and 15-mer peptides that correspond to an HCV peptide into mice, a more diverse set of antibodies can be generated by using recombinant HCV peptides, prepared as described above.

To generate antibodies to an HCV peptide, substantially pure peptide is isolated from a transfected or transformed cell. The concentration of the peptide in the final preparation is adjusted, for example, by concentration on an Amicon filter device, to the level of a few micrograms/ml. Monoclonal or polyclonal antibody to the peptide of interest can then be prepared as follows:

Monoclonal antibodies to an HCV peptide can be prepared using any technique that provides for the production of antibody molecules by continuous cell lines in culture. These include, but are not limited to, the hybridoma technique originally described by Koehler and Milstein (*Nature* 256:495-497 (1975)), the human B-cell hybridoma technique (Kosbor et al. *Immunol Today* 4:72 (1983)); Cote et al *Proc Natl Acad Sci* 80:2026-2030 (1983), and the EBV-hybridoma technique Cole et al. *Monoclonal Antibodies and Cancer Therapy*, Alan R. Liss Inc, New York N.Y., pp 77-96 (1985). In addition, techniques developed for the production of "chimeric antibodies", the splicing of mouse antibody genes to human antibody genes to obtain a molecule with appropriate antigen specificity and biological activity can be used. (Morrison et al. *Proc Natl Acad Sci* 81:6851-6855 (1984); Neuberger et al. *Nature* 312:604-608 (1984); Takeda et al. *Nature* 314:452-454 (1985)). Alternatively, techniques described for the production of single chain antibodies (U.S. Pat. No. 4,946,778) can be adapted to produce HCV-specific single chain antibodies. Antibodies can also be produced by inducing in vivo production in the lymphocyte population or by screening recombinant immunoglobulin libraries or panels of highly specific binding reagents as disclosed in Orlandi et al., *Proc Natl Acad Sci* 86: 3833-3837 (1989), and Winter G. and Milstein C; *Nature* 349:293-299 (1991).

Antibody fragments that contain specific binding sites for an HCV peptide can also be generated. For example, such fragments include, but are not limited to, the $F(ab')_2$ fragments that can be produced by pepsin digestion of the antibody molecule and the Fab fragments that can be generated by reducing the disulfide bridges of the $F(ab')_2$ fragments. Alternatively, Fab expression libraries can be constructed to allow rapid and easy identification of monoclonal Fab fragments with the desired specificity. (Huse W. D. et al. *Science* 256:1275-1281 (1989)).

By one approach, monoclonal antibodies to an HCV peptide are made as follows. Briefly, a mouse is repetitively inoculated with a few micrograms of the selected protein or peptides derived therefrom over a period of a few weeks. The mouse is then sacrificed, and the antibody producing cells of the spleen isolated. The spleen cells are fused in the presence of polyethylene glycol with mouse myeloma cells, and the excess unfused cells destroyed by growth of the system on selective media comprising aminopterin (HAT media). The successfully fused cells are diluted and aliquots of the dilution placed in wells of a microtiter plate where growth of the culture is continued. Antibody-producing clones are identified by detection of antibody in the supernatant fluid of the wells by immunoassay procedures, such as ELISA, as originally described by Engvall, E., *Meth. Enzymol.* 70:419 (1980), and derivative methods thereof. Selected positive clones can be expanded and their monoclonal antibody product harvested for use. Detailed procedures for monoclonal antibody production are described in Davis, L. et al. *Basic Methods in Molecular Biology* Elsevier, New York. Section 21-2.

Polyclonal antiserum containing antibodies to heterogeneous epitopes of a single protein can be prepared by immunizing suitable animals with the expressed protein or peptides derived therefrom described above, which can be unmodified or modified to enhance immunogenicity. Effective polyclonal antibody production is affected by many factors related both to the antigen and the host species. For example, small molecules tend to be less immunogenic than others and can require the use of carriers and adjuvant. Also, host animals vary in response to site of inoculations and dose, with both inadequate or excessive doses of antigen resulting in low titer antisera. Small doses (ng level) of antigen administered at multiple intradermal sites appears to be most reliable. An effective immunization protocol for rabbits can be found in Vaitukaitis, J. et al. *J. Clin. Endocrinol. Metab.* 33:988-991 (1971).

Booster injections are given at regular intervals, and antiserum harvested when antibody titer thereof, as determined semi-quantitatively, for example, by double immunodiffusion in agar against known concentrations of the antigen, begins to fall. See, for example, Ouchterlony, O. et al., Chap. 19 in: *Handbook of Experimental Immunology* D. Wier (ed) Blackwell (1973). Plateau concentration of antibody is usually in the range of 0.1 to 0.2 mg/ml of serum (about 12 µM).

Affinity of the antisera for the antigen is determined by preparing competitive binding curves, as described, for example, by Fisher, D., Chap. 42 in: *Manual of Clinical Immunology*, 2d Ed. (Rose and Friedman, Eds.) Amer. Soc. For Microbiol., Washington, D.C. (1980). Antibody preparations prepared according to either protocol are useful in quantitative immunoassays that determine concentrations of antigen-bearing substances in biological samples; they are also used semi-quantitatively or qualitatively (e.g., in diagnostic embodiments that identify the presence of HCV in biological samples). The next section describes how some of the novel nucleic acids and peptides described above can be used in diagnostics.

Diagnostic Embodiments

Generally, the embodied diagnostics are classified according to whether a nucleic acid or protein-based assay is used. Some diagnostic assays detect the presence or absence of an embodied HCV nucleic acid sequence in a sample obtained from a patient, whereas, other assays seek to identify whether an embodied HCV peptide is present in a biological sample obtained from a patient. Additionally, the manufacture of kits that incorporate the reagents and methods described herein that allow for the rapid detection and identification of HCV are also embodied. These diagnostic kits can include, for example, an embodied nucleic acid probe or antibody, which specifically detects HCV. The detection component of these kits will typically be supplied in combination with one or more of the following reagents. A support capable of absorbing or otherwise binding DNA, RNA, or protein will often be supplied. Available supports include membranes of nitrocellulose, nylon or derivatized nylon that can be characterized by bearing an array of positively charged substituents. One or more restriction enzymes, control reagents, buffers, amplification enzymes, and non-human polynucleotides like calf-thymus or salmon-sperm DNA can be supplied in these kits.

Useful nucleic acid-based diagnostics include, but are not limited to, direct DNA sequencing, Southern Blot analysis, dot blot analysis, nucleic acid amplification, and combinations of these approaches. The starting point for these analysis is isolated or purified nucleic acid from a biological sample obtained from a patient suspected of contracting HCV or a patient at risk of contracting HCV. The nucleic acid is extracted from the sample and can be amplified by RT-PCR and/or DNA amplification using primers that correspond to regions flanking the embodied HCV nucleic acid sequences (e.g., NS3/4A (SEQ. ID. NO.: 1)).

In some embodiments, nucleic acid probes that specifically hybridize with HCV sequences are attached to a support in an ordered array, wherein the nucleic acid probes are attached to distinct regions of the support that do not overlap with each other. Preferably, such an ordered array is designed to be "addressable" where the distinct locations of the probe are recorded and can be accessed as part of an assay procedure. These probes are joined to a support in different known locations. The knowledge of the precise location of each nucleic acid probe makes these "addressable" arrays particularly useful in binding assays. The nucleic acids from a preparation of several biological samples are then labeled by conventional approaches (e.g., radioactivity or fluorescence) and the labeled samples are applied to the array under conditions that permit hybridization.

If a nucleic acid in the samples hybridizes to a probe on the array, then a signal will be detected at a position on the support that corresponds to the location of the hybrid. Since the identity of each labeled sample is known and the region of the support on which the labeled sample was applied is known, an identification of the presence of the polymorphic variant can be rapidly determined. These approaches are easily automated using technology known to those of skill in the art of high throughput diagnostic or detection analysis.

Additionally, an approach opposite to that presented above can be employed. Nucleic acids present in biological samples can be disposed on a support so as to create an addressable array. Preferably, the samples are disposed on the support at known positions that do not overlap. The presence of HCV nucleic acids in each sample is determined by applying labeled nucleic acid probes that complement nucleic acids, which encode HCV peptides, at locations on the array that correspond to the positions at which the biological samples were disposed. Because the identity of the biological sample and its position on the array is known, the identification of a patient that has been infected with HCV can be rapidly determined. These approaches are also easily automated using technology known to those of skill in the art of high throughput diagnostic analysis.

Any addressable array technology known in the art can be employed. One particular embodiment of polynucleotide arrays is known as Genechips™, and has been generally described in U.S. Pat. No. 5,143,854; PCT publications WO 90/15070 and 92/10092. These arrays are generally produced using mechanical synthesis methods or light directed synthesis methods, which incorporate a combination of photolithographic methods and solid phase oligonucleotide synthesis. (Fodor et al., *Science*, 251:767-777, (1991)). The immobilization of arrays of oligonucleotides on solid supports has been rendered possible by the development of a technology generally identified as "Very Large Scale Immobilized Polymer Synthesis" (VLSPIS™) in which, typically, probes are immobilized in a high density array on a solid surface of a chip. Examples of VLSPIS™ technologies are provided in U.S. Pat. Nos. 5,143,854 and 5,412,087 and in PCT Publications WO 90/15070, WO 92/10092 and WO 95/11995, which describe methods for forming oligonucleotide arrays through techniques such as light-directed synthesis techniques. In designing strategies aimed at providing arrays of nucleotides immobilized on solid supports, further presentation strategies were developed to order and display the oligonucleotide arrays on the chips in an attempt to maximize hybridization patterns and diagnostic information. Examples of such presentation strategies are disclosed in PCT Publications WO 94/12305, WO 94/11530, WO 97/29212, and WO 97/31256.

A wide variety of labels and conjugation techniques are known by those skilled in the art and can be used in various nucleic acid assays. There are several ways to produce labeled nucleic acids for hybridization or PCR including, but not limited to, oligolabeling, nick translation, end-labeling, or PCR amplification using a labeled nucleotide. Alternatively, a nucleic acid encoding an HCV peptide can be cloned into a vector for the production of an mRNA probe. Such vectors are known in the art, are commercially available, and can be used to synthesize RNA probes in vitro by addition of an appropriate RNA polymerase such as T7, T3 or SP6 and labeled nucleotides. A number of companies such as Pharmacia Biotech (Piscataway N.J.), Promega (Madison Wis.), and U.S. Biochemical Corp (Cleveland Ohio) supply commercial kits and protocols for these procedures. Suitable reporter molecules or labels include those radionuclides, enzymes, fluorescent, chemiluminescent, or chromogenic agents, as well as, substrates, cofactors, inhibitors, magnetic particles and the like.

The presence of an HCV peptide in a protein sample obtained from a patient can also be detected by using conventional assays and the embodiments described herein. For example, antibodies that are immunoreactive with the disclosed HCV peptides can be used to screen biological samples for the presence of HCV infection. In preferred embodiments, antibodies that are reactive to the embodied HCV peptides are used to immunoprecipitate the disclosed HCV peptides from biological samples or are used to react with proteins obtained from a biological sample on Western or Immunoblots. Favored diagnostic embodiments also include enzyme-linked immunosorbant assays (ELISA), radioimmunoassays (RIA), immunoradiometric assays (IRMA) and immunoenzymatic assays (IEMA), including sandwich assays using monoclonal and/or polyclonal antibodies specific for the disclosed HCV peptides. Exemplary sandwich assays are described by David et al., in U.S. Pat. Nos. 4,376,110 and 4,486,530. Other embodiments employ aspects of the immune-strip technology disclosed in U.S. Pat. Nos. 5,290,678; 5,604,105; 5,710,008; 5,744,358; and 5,747,274.

In another preferred protein-based diagnostic, the antibodies described herein are attached to a support in an ordered array, wherein a plurality of antibodies are attached to distinct regions of the support that do not overlap with each other. As with the nucleic acid-based arrays, the protein-based arrays are ordered arrays that are designed to be "addressable" such that the distinct locations are recorded and can be accessed as part of an assay procedure. These probes are joined to a support in different known locations. The knowledge of the precise location of each probe makes these "addressable" arrays particularly useful in binding assays. For example, an addressable array can comprise a support having several regions to which are joined a plurality of antibody probes that specifically recognize HCV peptides present in a biological sample and differentiate the isotype of HCV identified herein.

By one approach, proteins are obtained from biological samples and are then labeled by conventional approaches (e.g., radioactivity, calorimetrically, or fluorescently). The labeled samples are then applied to the array under conditions that permit binding. If a protein in the sample binds to an antibody probe on the array, then a signal will be detected at a position on the support that corresponds to the location of the antibody-protein complex. Since the identity of each labeled sample is known and the region of the support on which the labeled sample was applied is known, an identification of the presence, concentration, and/or expression level can be rapidly determined. That is, by employing labeled standards of a known concentration of HCV peptide, an investigator can accurately determine the protein concentration of the particular peptide in a tested sample and can also assess the expression level of the HCV peptide. Conventional methods in densitometry can also be used to more accurately determine the concentration or expression level of the HCV peptide. These approaches are easily automated using technology known to those of skill in the art of high throughput diagnostic analysis.

In another embodiment, an approach opposite to that presented above can be employed. Proteins present in biological samples can be disposed on a support so as to create an addressable array. Preferably, the protein samples are disposed on the support at known positions that do not overlap. The presence of an HCV peptide in each sample is then determined by applying labeled antibody probes that recognize epitopes specific for the HCV peptide. Because the identity of the biological sample and its position on the array is known, an identification of the presence, concentration, and/or expression level of an HCV peptide can be rapidly determined.

That is, by employing labeled standards of a known concentration of HCV peptide, an investigator can accurately determine the concentration of peptide in a sample and from this information can assess the expression level of the peptide. Conventional methods in densitometry can also be used to more accurately determine the concentration or expression level of the HCV peptide. These approaches are also easily automated using technology known to those of skill in the art of high throughput diagnostic analysis. As detailed above, any addressable array technology known in the art can be employed. The next section describes more compositions that include the HCV nucleic acids and/or HCV peptides described herein.

Compositions Comprising HCV Nucleic Acids or Peptides

Embodiments of the invention also include NS3/4A fusion proteins or nucleic acids encoding these molecules. For instance, production and purification of recombinant protein may be facilitated by the addition of auxiliary amino acids to form a "tag". Such tags include, but are not limited to, His-6, Flag, Myc and GST. The tags may be added to the C-terminus, N-terminus, or within the NS3/4A amino acid sequence. Further embodiments include NS3/4A fusion proteins with amino or carboxy terminal truncations, or internal deletions, or with additional polypeptide sequences added to the amino or carboxy terminal ends, or added internally. Other embodiments include NS3/4A fusion proteins, or truncated or mutated versions thereof, where the residues of the NS3/4A proteolytic cleavage site have been substituted. Such substitutions include, but are not limited to, sequences where the P1' site is a Ser, Gly, or Pro, or the P1 position is an Arg, or where the P8 to P4' sequence is Ser-Ala-Asp-Leu-Glu-Val-Val-Thr-Ser-Thr-Trp-Val (SEQ. ID. NO.: 15).

More embodiments concern an immunogen comprising the NS3/4A fusion protein, or a truncated, mutated, or modified version thereof, capable of eliciting an enhanced immune response against NS3. The immunogen can be provided in a substantially purified form, which means that the immunogen has been rendered substantially free of other proteins, lipids, carbohydrates or other compounds with which it naturally associates.

Some embodiments contain at least one of the HCV nucleic acids or HCV peptides (e.g., SEQ. ID. NOs.: 1-27, 35, 36 or 40-220) joined to a support. Preferably, these supports are manufactured so as to create a multimeric agent. These multimeric agents provide the HCV peptide or nucleic acid in such a form or in such a way that a sufficient affinity to the molecule is achieved. A multimeric agent having an HCV nucleic acid or peptide can be obtained by joining the desired molecule to a macromolecular support. A "support" can be a termed a carrier, a protein, a resin, a cell membrane, a capsid or portion thereof, or any macromolecular structure used to join or immobilize such molecules. Solid supports include, but are not limited to, the walls of wells of a reaction tray, test tubes, polystyrene beads, magnetic beads, nitrocellulose strips, membranes, microparticles such as latex particles, animal cells, Duracyte®, artificial cells, and others. An HCV nucleic acid or peptide can also be joined to inorganic carriers, such as silicon oxide material (e.g., silica gel, zeolite, diatomaceous earth or aminated glass) by, for example, a covalent linkage through a hydroxy, carboxy or amino group and a reactive group on the carrier.

In several multimeric agents, the macromolecular support has a hydrophobic surface that interacts with a portion of the HCV nucleic acid or peptide by a hydrophobic non-covalent interaction. In some cases, the hydrophobic surface of the support is a polymer such as plastic or any other polymer in which hydrophobic groups have been linked such as polystyrene, polyethylene or polyvinyl. Additionally, HCV nucleic acid or peptide can be covalently bound to carriers including proteins and oligo/polysaccarides (e.g. cellulose, starch, glycogen, chitosane or aminated sepharose). In these later multimeric agents, a reactive group on the molecule, such as a hydroxy or an amino group, is used to join to a reactive group on the carrier so as to create the covalent bond. Additional multimeric agents comprise a support that has other reactive groups that are chemically activated so as to attach the HCV nucleic acid or peptide. For example, cyanogen bromide activated matrices, epoxy activated matrices, thio and thiopropyl gels, nitrophenyl chloroformate and N-hydroxy succinimide chlorformate linkages, or oxirane acrylic supports are used. (Sigma).

Carriers for use in the body, (i.e. for prophylactic or therapeutic applications) are desirably physiological, non-toxic and preferably, non-immunoresponsive. Suitable carriers for use in the body include poly-L-lysine, poly-D, L-alanine, liposomes, capsids that display the desired HCV peptide or nucleic acid, and Chromosorb® (Johns-Manville Products, Denver Co.). Ligand conjugated Chromosorb® (Synsorb-Pk) has been tested in humans for the prevention of hemolytic-uremic syndrome and was reported as not presenting adverse reactions. (Armstrong et al. *J. Infectious Diseases* 171:1042-1045 (1995)). For some embodiments, a "naked" carrier (i.e., lacking an attached HCV nucleic acid or peptide) that has the capacity to attach an HCV nucleic acid or peptide in the body of a organism is administered. By this approach, a "prodrug-type" therapy is envisioned in which the naked carrier is administered separately from the HCV nucleic acid or peptide and, once both are in the body of the organism, the carrier and the HCV nucleic acid or peptide are assembled into a multimeric complex.

The insertion of linkers, (e.g., "λ linkers" engineered to resemble the flexible regions of λ phage) of an appropriate length between the HCV nucleic acid or peptide and the support are also contemplated so as to encourage greater flexibility of the HCV peptide, hybrid, or binding partner and thereby overcome any steric hindrance that can be presented by the support. The determination of an appropriate length of linker that allows for an optimal cellular response or lack thereof, can be determined by screening the HCV nucleic acid or peptide with varying linkers in the assays detailed in the present disclosure.

A composite support comprising more than one type of HCV nucleic acid or peptide is also envisioned. A "composite support" can be a carrier, a resin, or any macromolecular structure used to attach or immobilize two or more different HCV nucleic acids or peptides. As above, the insertion of linkers, such as λ linkers, of an appropriate length between the HCV nucleic acid or peptide and the support is also contemplated so as to encourage greater flexibility in the molecule and thereby overcome any steric hindrance that can occur. The determination of an appropriate length of linker that allows for an optimal cellular response or lack thereof, can be determined by screening the HCV nucleic acid or peptide with varying linkers in the assays detailed in the present disclosure.

In other embodiments, the multimeric and composite supports discussed above can have attached multimerized HCV nucleic acids or peptides so as to create a "multimerized-multimeric support" and a "multimerized-composite support", respectively. A multimerized ligand can, for example, be obtained by coupling two or more HCV nucleic acids or peptides in tandem using conventional techniques in molecular biology. The multimerized form of the HCV nucleic acid or peptide can be advantageous for many applications because of the ability to obtain an agent with a higher affinity, for example. The incorporation of linkers or spacers, such as flexible λ linkers, between the individual domains that make-up the multimerized agent can also be advantageous for some embodiments. The insertion of λ linkers of an appropriate length between protein binding domains, for example, can encourage greater flexibility in the molecule and can overcome steric hindrance. Similarly, the insertion of linkers between the multimerized HCV nucleic acid or peptide and the support can encourage greater flexibility and limit steric hindrance presented by the support. The determination of an appropriate length of linker can be determined by screening the HCV nucleic acids or peptides in the assays detailed in this disclosure.

Embodiments also include vaccine compositions and immunogen preparations comprising the NS3/4A fusion protein, or a truncated or mutated version thereof, and, optionally, an adjuvant. The next section describes some of these compositions in greater detail.

Vaccine Compositions and Immunogenic Preparations

Vaccine compositions and immunogenic preparations comprising, consisting of, or consisting essentially of either an embodied nucleic acid encoding a chimeric NS3/4A peptide or a chimeric NS3/4A polypeptide, or both, are contemplated. These compositions typically contain an adjuvant, but do not necessarily require an adjuvant. That is many of the nucleic acids and peptides described herein function as immunogens when administered neat. The compositions described herein (e.g., the NS3/4A chimeric immunogens and vaccine compositions containing an adjuvant, such as ribavirin) can be manufactured in accordance with conventional methods of galenic pharmacy to produce medicinal agents for administration to animals, e.g., mammals including humans. (See, e.g., U.S. Pat. Nos. 6,680,059 and 6,858,590, hereby expressly incorporated by reference in their entireties).

Various nucleic acid-based vaccines are known and it is contemplated that these compositions and approaches to immunotherapy can be augmented by reformulation with ribavirin (See, e.g. U.S. Pat. Nos. 5,589,466 and 6,235,888, hereby expressly incorporated by reference in their entireties). By one approach, for example, a gene encoding one of the NS3/4A chimeric polypeptides described herein is cloned into an expression vector capable of expressing the polypeptide when introduced into a subject. The expression construct is introduced into the subject in a mixture of adjuvant (e.g., ribavirin) or in conjunction with an adjuvant (e.g., ribavirin). For example, the adjuvant (e.g., ribavirin) is administered shortly after the expression construct at the same site. Alternatively, RNA encoding the NS3/4A chimeric polypeptide of interest is provided to the subject in a mixture with ribavirin or in conjunction with an adjuvant (e.g., ribavirin).

Where the antigen is to be DNA (e.g., preparation of a DNA vaccine composition), suitable promoters include Simian Virus 40 (SV40), Mouse Mammary Tumor Virus (MMTV) promoter, Human Immunodeficiency Virus (HIV) such as the HIV Long Terminal Repeat (LTR) promoter, Moloney virus, ALV, Cytomegalovirus (CMV) such as the CMV immediate early promoter, Epstein Barr Virus (EBV), Rous Sarcoma Virus (RSV) as well as promoters from human genes such as human actin, human myosin, human hemoglobin, human muscle creatine and human metallothionein can be used. Examples of polyadenylation signals useful with some embodiments, especially in the production of a genetic vaccine for humans, include but are not limited to, SV40 polyadenylation signals and LTR polyadenylation signals. In particular, the SV40 polyadenylation signal, which is in pCEP4 plasmid (Invitrogen, San Diego Calif.), referred to as the SV40 polyadenylation signal, is used.

In addition to the regulatory elements required for gene expression, other elements may also be included in a gene construct. Such additional elements include enhancers. The enhancer may be selected from the group including but not limited to: human actin, human myosin, human hemoglobin, human muscle creatine and viral enhancers such as those from CMV, RSV and EBV. Gene constructs can be provided with mammalian origin of replication in order to maintain the construct extrachromosomally and produce multiple copies of the construct in the cell. Plasmids pCEP4 and pREP4 from Invitrogen (San Diego, Calif.) contain the Epstein Barr virus origin of replication and nuclear antigen EBNA-1 coding region, which produces high copy episomal replication without integration. All forms of DNA, whether replicating or non-replicating, which do not become integrated into the genome, and which are expressible, can be used. Preferably, the genetic vaccines comprise ribavirin and a nucleic acid encoding a NS3/4A polypeptide.

More embodiments concern an immunogen comprising the chimeric NS3/4A polypeptide, or a truncated, mutated, or modified version thereof, capable of eliciting an enhanced immune response against a target antigen. The immunogen can be provided in a substantially purified form, which means that the immunogen has been rendered substantially free of other proteins, lipids, carbohydrates or other compounds with which it naturally associates.

Some embodiments contain at least one of the nucleic acids described joined to a support. Preferably, these supports are manufactured so as to create a multimeric agent. These multimeric agents provide the chimeric NS3/4A chimeric polypeptide or encoding nucleic acid in such a form or in such a way that a sufficient affinity to the molecule is achieved. A multimeric agent having a chimeric NS3/4A chimeric polypeptide or encoding nucleic acid can be obtained by joining the desired molecule to a macromolecular support. A "support" can be a termed a carrier, a protein, a resin, a cell membrane, a capsid or portion thereof, or any macromolecular structure used to join or immobilize such molecules. Solid supports include, but are not limited to, the walls of wells of a reaction tray, test tubes, polystyrene beads, magnetic beads, nitrocellulose strips, membranes, microparticles such as latex particles, animal cells, DURACYTE®, artificial cells, and others. A chimeric NS3/4A polypeptide or encoding nucleic acid can also be joined to inorganic carriers, such as silicon oxide material (e.g., silica gel, zeolite, diatomaceous earth or aminated glass) by, for example, a covalent linkage through a hydroxy, carboxy or amino group and a reactive group on the carrier.

In several multimeric agents, the macromolecular support has a hydrophobic surface that interacts with a portion of the chimeric NS3/4A chimeric polypeptide or encoding nucleic acid by a hydrophobic non-covalent interaction. In some cases, the hydrophobic surface of the support is a polymer such as plastic or any other polymer in which hydrophobic groups have been linked such as polystyrene, polyethylene or polyvinyl. Additionally, chimeric NS3/4A polypeptides or encoding nucleic acids can be covalently bound to carriers including proteins and oligo/polysaccharides (e.g. cellulose, starch, glycogen, chitosane, aminated sepharose, or the gal epitope (e.g., gal-α-1, 3 gal-β). In these later multimeric agents, a reactive group on the molecule, such as a hydroxy or an amino group, is used to join to a reactive group on the carrier so as to create the covalent bond. Additional multimeric agents comprise a support that has other reactive groups that are chemically activated so as to attach chimeric NS3/4A polypeptides or encoding nucleic acids. For example, cyanogen bromide activated matrices, epoxy activated matrices, thio and thiopropyl gels, nitrophenyl chloroformate and N-hydroxy succinimide chlorformate linkages, or oxirane acrylic supports are used. (Sigma).

Carriers for use in the body, (i.e. for prophylactic or therapeutic applications) are desirably physiological, non-toxic and preferably, non-immunoresponsive. Suitable carriers for use in the body include poly-L-lysine, poly-D, L-alanine, liposomes, capsids that display the desired NS3/4A chimeric peptide or nucleic acid, and CHROMSORB® (Johns-Manville Products, Denver Co.). Ligand conjugated CHROMSORB® (Synsorb-Pk) has been tested in humans for the prevention of hemolytic-uremic syndrome and was reported as not presenting adverse reactions. (Armstrong et al. J. Infectious Diseases 171:1042-1045 (1995)). For some embodiments, a "naked" carrier (i.e., lacking an attached chimeric NS3/4A chimeric polypeptides or encoding nucleic acids) that has the capacity to attach a chimeric NS3/4A chimeric polypeptide or encoding nucleic acid in the body of a organism is administered. By this approach, a "prodrug-type" therapy is envisioned in which the naked carrier is administered separately from the NS3/4A chimeric polypeptide or encoding nucleic acid and, once both are in the body of the organism, the carrier and NS3/4A chimeric polypeptide or encoding nucleic acid are assembled into a multimeric complex.

The insertion of linkers of an appropriate length between the NS3/4A chimeric polypeptide or encoding nucleic acid and the support are also contemplated so as to encourage greater flexibility of the NS3/4A chimeric polypeptide, encoding nucleic acid, hybrid, or binding partner and thereby overcome any steric hindrance that can be presented by the support. The determination of an appropriate length of linker that allows for an optimal cellular response or lack thereof, can be determined by screening the NS3/4A chimeric polypeptide or encoding nucleic acid with varying linkers in the assays detailed in the present disclosure.

A composite support comprising more than one type of NS3/4A chimeric polypeptide or encoding nucleic acid is also envisioned. A "composite support" can be a carrier, a resin, or any macromolecular structure used to attach or immobilize two or more different NS3/4A chimeric polypeptides or encoding nucleic acids. As above, the insertion of linkers, such as λ linkers, of an appropriate length between the NS3/4A chimeric polypeptide or encoding nucleic acid and the support is also contemplated so as to encourage greater flexibility in the molecule and thereby overcome any steric hindrance that can occur. The determination of an appropriate length of linker that allows for an optimal cellular response or lack thereof, can be determined by screening the NS3/4A chimeric polypeptide or encoding nucleic acid with varying linkers in the assays detailed in the present disclosure.

In other embodiments, the multimeric and composite supports discussed above can have attached multimerized NS3/4A chimeric polypeptides or encoding nucleic acids so as to create a "multimerized-multimeric support" and a "multimerized-composite support", respectively. A multimerized ligand can, for example, be obtained by coupling two or more NS3/4A chimeric polypeptides or encoding nucleic acids in tandem using conventional techniques in molecular biology. The multimerized form of NS3/4A chimeric polypeptides or encoding nucleic acids can be advantageous for many applications because of the ability to obtain an agent with a higher affinity, for example. The incorporation of linkers such as flexible λ linkers, between the individual domains that make-up the multimerized agent can also be advantageous for some embodiments. The insertion of λ linkers of an appropriate length between protein binding domains, for example, can encourage greater flexibility in the molecule and can overcome steric hindrance. Similarly, the insertion of linkers between the multimerized NS3/4A chimeric polypeptides or encoding nucleic acids and the support can encourage greater flexibility and limit steric hindrance presented by the support. The determination of an appropriate length of linker can be determined by screening the NS3/4A chimeric polypeptides or encoding nucleic acid in the assays detailed in this disclosure.

Aspects of the present invention also relate to a modified hepatitis C virus (HCV) NS3/4A protein that is linked to a pendent hapten (e.g., a T cell epitope) through chemically-reactive amino acid residue, which may be, optionally, inserted into or attached to (e.g., a linker on either the N terminal or C terminal end) the NS3/4A sequence. Such an introduced or already present chemically-reactive amino acid residue is characterized in that it has a chemically-reactive side chain that provides a chemical group for pendently linking the NS3/4A polypeptide to the hapten. Typically, the chemically-reactive amino acid residue is a lysine, cysteine, or histidine residue or a carboxyl-containing residue such as aspartic acid or glutamic acid, preferably lysine or a carboxyl-containing residue, and most preferably lysine. The hapten bonded to the chemically-reactive amino acid residue is any compound of interest for generating an immune response, and is typically a T cell epitope. Preferably, the hapten is a polypeptide hapten, a carbohydrate hapten, or a non-peptidal/non-saccharidal (chemical) hapten. In some embodiments, the hapten is a pathogen-related hapten, for example, a T cell epitope provided herein. The word "hapten" is used in this context to describe molecules that are capable of stimulating an immune response (e.g., production of antibody) when chemically coupled to NS3/4A. The word is often used for small nonantigenic molecules in the art, but herein, it merely refers to the molecule that is to be pendently linked to NS3/4A, even if it is antigenic or not small. The chemically-reactive amino acid residue can be at any position within the epitope and NS3/4A polypeptide or attached to either end of these molecules (N terminal or C terminal). As stated above, the introduced chemically-reactive amino acid residue has a chemically-reactive side chain that provides a functional group for derivatizing the NS3/4A polypeptide (e.g., conjugating a T cell epitope to the NS3/4A). Useful side chain functional groups include epsilon-amino groups, beta- or gamma-carboxyl groups, thiol (—SH) groups and aromatic rings (e.g. tyrosine and histidine). The chemically-reactive amino acid residue is typically a lysine, cysteine, or histidine residue or a carboxyl-containing residue such as aspartic acid or glutamic acid. Lysine is a particularly preferred chemically-reactive amino acid residue. In addition of the use of an individual chemically-reactive amino acid residue in the insert such as aspartic acid or lysine, substantially any sequence of the desired length that contains a chemically-reactive amino acid residue can be used.

Any hapten against which antibody production is desired can be linked to an NS3/4A peptide or fragment thereof, as described herein, to form an immunogenic composition. The hapten of interest typically is T cell epitope. The hapten can be a polypeptide, a carbohydrate (saccharide), or a non-polypeptide, non-carbohydrate chemical such as 2,4-dinitrobenzene, however.

Methods for operatively linking individual haptens to a protein or polypeptide through an amino acid residue side chain of the protein or polypeptide to form a pendently-linked immunogenic conjugate, e.g., a branched-chain polypeptide polymer, are well known in the art. Those methods include linking through one or more types of functional groups on various side chains and result in the carrier protein polypeptide backbone being pendently linked—covalently linked (coupled) to the hapten but separated by at least one side chain.

Methods for linking carrier proteins to haptens using each of the above functional groups are described in Erlanger, Method of Enzymology, 70:85 (1980), Aurameas, et al., Scand. J. Immunol., Vol. 8, Suppl. 7, 7-23 (1978) and U.S. Pat. No. 4,493,795 to Nestor et al., all of which are hereby expressly incorporated by reference in their entireties. In addition, a site-directed coupling reaction, as described in Rodwell et al., Biotech., 3, 889-894 (1985), herein expressly incorporated by reference in its entirety, can be carried out so that the biological activity of the polypeptides is not substantially diminished.

Furthermore, as is well known in the art, both the NS3/4A protein or fragment thereof and a polypeptide hapten can be used in their native form or their functional group content can be modified by succinylation of lysine residues or reaction with cysteine-thiolactone. A sulfhydryl group can also be incorporated into either molecule by reaction of amino functions with 2-iminothiolane or the N-hydroxysuccinimide ester of 3-(3-dithiopyridyl)propionate.

The NS3/4A peptide or fragment thereof or hapten can also be modified to incorporate a spacer arm, such as hexamethylene diamine or other bifunctional molecules of similar size, to facilitate the pendent linking.

Methods for covalent bonding of a polypeptide hapten are extremely varied and are well known by workers skilled in the immunological arts. For example, following U.S. Pat. No. 4,818,527, m-maleimidobenzoyl-N-hydroxysuccinimide ester (ICN Biochemicals, Inc.) or succinimidyl 4-(N-maleimidomethyl)cyclohexane-1-carboxylate (SMCC, Pierce), all of which are hereby expressly incorporated by reference in their entireties, is reacted with a NS3/4A protein or fragment thereof to form an activated molecule. That activated carrier is then reacted with a polypeptide that either contains a terminal cysteine or to which an additional amino- or carboxy-terminal cysteine residue has been added to form a covalently bonded NS3/4A conjugate. As an alternative example, the amino group of a polypeptide hapten can be first reacted with N-succinimidyl 3-(2-pyridylthio)propionate (SPDP, Pharmacia), and that thiol-containing polypeptide can be reacted with the activated NS3/4A after reduction. Of course, the sulfur-containing moiety and double bond-containing Michael acceptor can be reversed. These reactions are described in the supplier's literature, and also in Kitagawa, et al., J. Biochem., 79:233 (1976) and in Lachmann et al., in 1986 Synthetic Peptides as Antigens, (Ciba Foundation Symposium 119), pp. 25-40 (Wiley, Chichester: 1986), all of which are hereby expressly incorporated by reference in their entireties.

U.S. Pat. No. 4,767,842, herein expressly incorporated by reference in its entirety, teaches several modes of covalent attachment between a carrier and polypeptide that are useful here. In one method, tolylene diisocyanate is reacted with the NS3/4A or a fragment thereof in a dioxane-buffer solvent at zero degrees C. to form an activated molecule. A polypeptide hapten (e.g., a T cell epitope) is thereafter admixed and reacted with the activated NS3/4A to form the covalently bonded NS3/4A conjugate.

Particularly useful are a large number of heterobifunctional agents that form a disulfide link at one functional group end and a peptide link at the other, including N-succinimidyl-3-(2-pyridyldithio) propionate (SPDP). This reagent creates a disulfide linkage between itself and a thiol in either the NS3/4A or fragment thereof or the hapten, for example a cysteine residue in a polypeptide hapten, and an amide linkage on the coupling partner, for example the amino on a lysine or other free amino group in the NS3/4A. A variety of such disulfide/amide forming agents are known. (See for example Immun. Rev. (1982) 62:185, herein expressly incorporated by reference in its entirety). Other bifunctional coupling agents form a thioether rather than a disulfide linkage. Many of these thioether-forming agents are commercially available and include reactive esters of 6-maleimidocaproic acid, 2-bromoacetic acid, 2-iodoacetic acid, 4-(N-maleimido-methyl) cyclohexane-1-carboxylic acid and the like. The carboxyl groups can be activated by combining them with succinimide or 1-hydroxy-2-nitro-4-sulfonic acid, sodium salt. The particularly preferred coupling agent is succinimidyl 4-(N-maleimidomethyl)cyclohexane-1-carboxylate (SMCC) obtained from Pierce Company, Rockford, Ill. The foregoing list is not meant to be exhaustive, and modifications of the named compounds can clearly be used.

A polypeptide hapten (e.g., a T cell epitope) can be obtained in a number of ways well known in the art. Usual peptide synthesis techniques can be readily utilized. For example, recombinant and PCR-based techniques to produce longer peptides are useful. Because the desired sequences are usually relatively short, solid phase chemical synthesis is useful.

As discussed below, DNA sequences that encode a variety of polypeptide haptens (e.g., T cell epitopes) are known in the art. The coding sequence for peptides of the length contemplated herein can easily be synthesized by chemical techniques, for example, the phosphotriester method of Matteucci et al., J. Am. Chem. Soc. 103:3185 (1981). Of course, by chemically synthesizing the coding sequence, any desired modification can be made simply by substituting the appropriate bases for those encoding the native peptide sequence. The coding sequence can then be provided with appropriate linkers and ligated into expression vectors now commonly available in the art, and the regulating vectors used to transform suitable hosts to produce the desired protein.

A number of such vectors and suitable host systems are now available. For example promoter sequences compatible with bacterial hosts are provided in plasmids containing convenient restriction sites for insertion of the desired coding sequence. Typical of such vector plasmids are, for example, pUC8, and pUC13 available from J. Messing, at the University of Minnesota (see, e.g., Messing et al., Nucleic Acids Res. 9:309 (1981)) or pBR322, available from New England Biolabs. Suitable promoters include, for example, the beta-lactamase (penicillinase) and lactose (lac) promoter systems (Chang. et al., Nature 198:1056 (1977) and the tryptophan (trp) promoter system (Goeddel et al., Nucleic Acids Res. 8:4057 (1980)). The resulting expression vectors are transformed into suitable bacterial hosts using the calcium chloride method described by Cohen, et al., Proc. Natl. Acad. Sci. U.S.A. 69:2110 (1972). Successful transformants may produce the desired polypeptide fragments at higher levels than those found in strains normally producing the intact pili. Of course, yeast or mammalian cell hosts can also be used, employing suitable vectors and control sequences.

Embodiments also include methods of using vaccine compositions and immunogen preparations comprising the NS3/4A chimeric polypeptides or encoding nucleic acids, or a truncated or mutated version thereof, and, optionally, an adjuvant. The next section describes some of these compositions in greater detail.

Methods of Using the Vaccine Compositions and Immunogen Preparations

Routes of administration of the embodiments described herein include, but are not limited to, transdermal, parenteral, gastrointestinal, transbronchial, and transalveolar. Transdermal administration can be accomplished by application of a cream, rinse, gel, etc. capable of allowing the compositions described herein to penetrate the skin. Parenteral routes of administration include, but are not limited to, electrical or direct injection such as direct injection into a central venous line, intravenous, intramuscular, intraperitoneal, intradermal, or subcutaneous injection. Gastrointestinal routes of administration include, but are not limited to, ingestion and rectal. Transbronchial and transalveolar routes of administration include, but are not limited to, inhalation, either via the mouth or intranasally.

Compositions that are suitable for transdermal administration include, but are not limited to, pharmaceutically acceptable suspensions, oils, creams, and ointments applied directly to the skin or incorporated into a protective carrier such as a transdermal device ("transdermal patch"). Examples of suitable creams, ointments, etc. can be found, for instance, in the Physician's Desk Reference. Examples of suitable transdermal devices are described, for instance, in U.S. Pat. No. 4,818,540 issued Apr. 4, 1989 to Chinen, et al., hereby expressly incorporated by reference in its entirety.

Compositions that are suitable for parenteral administration include, but are not limited to, pharmaceutically acceptable sterile isotonic solutions. Such solutions include, but are not limited to, saline, phosphate buffered saline and oil preparations for injection into a central venous line, intravenous, intramuscular, intraperitoneal, intradermal, or subcutaneous injection.

Compositions that are suitable for transbronchial and transalveolar administration include, but not limited to, various types of aerosols for inhalation. Devices suitable for transbronchial and transalveolar administration of these are also embodiments. Such devices include, but are not limited to, atomizers and vaporizers. Many forms of currently available atomizers and vaporizers can be readily adapted to deliver vaccines having ribavirin and an antigen.

Compositions that are suitable for gastrointestinal administration include, but not limited to, pharmaceutically acceptable powders, pills or liquids for ingestion and suppositories for rectal administration.

The nucleic acid constructs described herein, in particular, may be administered by means including, but not limited to, traditional syringes, needleless injection devices, or "microprojectile bombardment gene guns". Alternatively, the genetic vaccine may be introduced by various means into cells that are removed from the individual. Such means include, for example, ex vivo transfection, electroporation, microinjection and microprojectile bombardment. After the gene construct is taken up by the cells, they are reimplanted into the individual. It is contemplated that otherwise nonimmunogenic cells that have gene constructs incorporated therein can be implanted into the individual even if the vaccinated cells were originally taken from another individual.

According to some embodiments, the gene construct is administered to an individual using a needleless injection device. In other embodiments, the gene construct comprising the antigen of interest is provided to an individual in need of an immune response to said antigen using an electroporation device (e.g., a needle device or a needleless device). According to some embodiments, the gene construct is simultaneously administered to an individual intradermally, subcutaneously and intramuscularly using a needleless injection device. Needleless injection devices, multi-needle electroporation devices, and nucleic acid electroporation devices, in general, are well known and widely available (See e.g., U.S. Pat. No. 5,273,525, EP 1240917 B1, U.S. Pat. No. 5,702,359, EP 0874663B1, U.S. Pat. Nos. 6,418,341, 6,763,264 6,055, 453, 6,233,482, 6,068,650, 6,014,584, 6,241,701, 6,516,223, 6,678,556, and 6,110,161, hereby expressly incorporated by reference in their entireties).

One having ordinary skill in the art can, following the teachings herein, use needleless or needled electroporation devices (e.g., providing the nucleic acid construct by hypodermic needle followed by electroporation at the injection site) to deliver genetic material to cells of an individual. These gene construct delivery devices are well suited to deliver genetic material to all tissue. They are particularly useful to deliver genetic material to skin and muscle cells. In some embodiments, a needleless injection device may be used to propel a liquid or dissolvable substrate or carrier that comprises the nucleic acid construct (e.g., ballistic transformation) toward the surface of the individual's skin. The liquid is propelled at a sufficient velocity such that upon impact with the skin the liquid penetrates the surface of the skin, permeates the skin and muscle tissue therebeneath. Thus, the genetic material is simultaneously administered intradermally, subcutaneously and intramuscularly. In some embodiments, a needleless injection device may be used to deliver genetic material to tissue of other organs in order to introduce a nucleic acid molecule to cells of that organ.

Preferred embodiments include methods of enhancing an immune response to a desired antigen by providing an animal in need with an amount of adjuvant (e.g., ribavirin) and one or more of the nucleic acid or polypeptide compositions disclosed herein that is effective to enhance said immune response. In these embodiments, an animal in need of an enhanced immune response to an antigen/target is identified by using currently available diagnostic testing or clinical evaluation. By one approach, for example, an individual infected with a virus, or afflicted with cancer, is provided with the vaccine compositions described above in an amount sufficient to elicit a cellular and humoral immune response to a viral or cancer TCE so as to protect said individual from becoming infected with the virus, or to treat the cancer from which the TCE is derived. In another embodiment, an individual infected with a virus is identified and provided with a vaccine composition comprising ribavirin and either a nucleic acid or polypeptide composition described herein, that includes a TCE from the virus and NS3/4A sequences in an amount sufficient to enhance the cellular and humoral immune response against the viral TCE so as to reduce or eliminate the viral infection.

The following Example describes the systematic mutation of residues in the NS3 protease domain in order to elucidate the potential insertion sites for TCEs or TCEs and linkers, in which the chimeric NS3/4A proteins retain protease activity.

EXAMPLE 14

The serine protease cleavage domain of NS3/NS4A resides in the first 181 amino acids of the peptide (Lin, C. et al., *J. Virol.,* 68(12):8147-8157 (1994)). FIG. 17 depicts the amino acid sequence of the protease cleavage domain of the NS3/NS4A polypeptide from HCV isolate disclosed herein (SEQ ID NO: 39). To identify amino acid residues that affect protease activity in the HCV isolate, mutations were made in each of the 181 amino acids of the protease cleavage domain. Briefly, the NS3/NS4A-pVAX plasmid (described in Example 1) was used as a template for site-directed mutagenesis using the QUICKCHANGE™ mutagenesis kit (Stratagene), following the manufacturer's recommendations. Using this approach, NS3/NS4A-pVAX constructs encoding the polypeptides of (SEQ ID NO's: 40 through 220 and 1329-

1339) were made. These constructs encode NS3/NS4A polypeptides in which every residue other than alanine in (SEQ ID NO: 39) is changed to an alanine, and where every alanine in (SEQ ID NO: 39) is changed to a glycine. The resulting plasmids were sequenced to verify that the NS3/NS4A-pVAX vectors had been correctly made. Plasmids were grown in competent BL21 *E. coli*, and subsequently purified using Qiagen DNA purification columns (Qiagen, Hamburg, Germany) according to the manufacturer's instructions. Purified plasmid DNA was dissolved in phosphate buffered saline (PBS).

The resulting plasmids were transcribed and translated in vitro, and the resulting polypeptides were visualized by sodium dodecyl sulfate-polyacrylamide gel electrophoresis (SDS-PAGE). In vitro transcription and translation were performed using the T7 coupled reticulocyte lysate TNT™ system (Promega, Madison, Wis.) according to the manufacturer's instructions. All in vitro translation reactions of the constructs were carried out at 30° C. with $^{35}$S-labeled methionine (Amersham International, Plc, Buckinghamshire, UK). The labeled proteins were separated by 12% SDS-PAGE and visualized by exposure to X-ray film (Hyper Film-MP, Amersham) for 6-18 hours.

When the assay described above is performed with wtNS3/NS4A-pVAX, the protease activity of wtNS3/NS4A protein (SEQ ID NO: 2) is such that two protein bands are visualized on the autorad of the gel: a protein band of approximately 67 kDa, which is consistent with the size of the NS3/NS4A uncleaved protein, and a protein band of approximately 61 kDa, which corresponds to the NS3 cleavage product from the reaction. Each of the 181 mutant NS3/NS4A-pVAX constructs was tested in the assay described above. For each mutant construct assayed, the amount of uncleaved (67 kDa) versus cleaved NS3/NS4A (61 kDa cleavage product) was compared between the wtNS3/NS4A construct and the NS3/NS4A mutant construct, as a measure of how each mutation affected the protease activity. As shown in Table 23, the following NS3/NS4A constructs have amino acid substitutions that completely abolished protease activity: SEQ ID NOs: 87, 92, 96, 120, 124, 130, 136, 138, 162, 163, 178, 179, 184, 192, 208, and 214. In reference to NS3 protease activity, the term "completely abolished" is meant to refer to polypeptides that have less than, equal to, or any number in between about 10%, 9%, 8%, 7%, 6%, 5%, 4%, 3% 2% and 1% of the NS3 protease activity compared to the protease activity of a wild type NS3 polypeptide or NS3/4A polypeptide (e.g. SEQ ID NO:36). In reference to NS3 protease activity, the term "reduced" is meant to refer to polypeptides that have less than, equal to, or any number in between about 100%, 95%, 90%, 85%, 80%, 75%, 70%, 65%, 60%, 55%, 50%, 45%, 40%, 35%, 30%, 25%, 20%, 15% and 10% of the NS3 protease activity compared to the protease activity of a wild type NS3 polypeptide or NS3/4A polypeptide (e.g., SEQ ID NO:36). The following eight constructs have mutations that result in reduced protease activity: SEQ ID NOs: 83, 133, 145, 147, 165, 182, 183, and 188.

As shown in Table 24, twenty two constructs have substitutions that result in enhanced (SEQ ID NOs: 45, 50, 52, 53, 69, 98, 103, 112, 115, 125, 150, 161, 173, 175, 180, 200, 205, and 216), or greatly enhanced protease activity (SEQ ID NOs: 91, 97, and 197). In reference to NS3 protease activity, the term "enhanced" and "greatly enhanced" is meant to refer to polypeptides that have greater than, equal to, or any number in between about 100%, 101%, 105%, 110%, 115%, 120%, 125%, 130%, 135%, 140%, 145%, 150%, 155%, 160%, 165%, 170%, 175%, 180%, 185%, 190%, 195%, 200%, 210%, 220%, 230%, 240%, 250%, 260%, 270%, 280%, 290%, 300%, 310%, 320%, 330%, 340%, 350%, 360%, 370%, 380%, 390%, 400%, 425%, 450%, 475%, 500%, 600% and 700% of the NS3 protease activity compared to the protease activity of a wild type NS3 polypeptide or NS3/4A polypeptide (e.g., SEQ ID NO:36).

TABLE 23

| Leu44Ala | (SEQ ID NO: 83) | Reduced |
|---|---|---|
| Ile48Ala | (SEQ ID NO: 87) | Abolished |
| Trp53Ala | (SEQ ID NO: 92) | Abolished |
| His57Ala | (SEQ ID NO: 96) | Abolished |
| Asp81Ala | (SEQ ID NO: 120) | Abolished |
| Trp85Ala | (SEQ ID NO: 124) | Abolished |
| Ala91Gly | (SEQ ID NO: 130) | Abolished |
| Leu94Ala | (SEQ ID NO: 133) | Reduced |
| Cys97Ala | (SEQ ID NO: 136) | Abolished |
| Cys99Ala | (SEQ ID NO: 138) | Abolished |
| Leu106Ala | (SEQ ID NO: 145) | Reduced |
| Thr108Ala | (SEQ ID NO: 147) | Reduced |
| Arg123Ala | (SEQ ID NO: 162) | Abolished |
| Gly124Ala | (SEQ ID NO: 163) | Abolished |
| Leu126Ala | (SEQ ID NO: 165) | Reduced |
| Ser139Ala | (SEQ ID NO: 178) | Abolished |
| Gly140Ala | (SEQ ID NO: 179) | Abolished |
| Leu143Ala | (SEQ ID NO: 182) | Reduced |
| Leu144Ala | (SEQ ID NO: 183) | Reduced |
| Cys145Ala | (SEQ ID NO: 184) | Abolished |
| His149Ala | (SEQ ID NO: 188) | Reduced |
| Ile53Ala | (SEQ ID NO: 192) | Abolished |
| Phe169Ala | (SEQ ID NO: 208) | Abolished |
| Leu175Ala | (SEQ ID NO: 214) | Abolished |

TABLE 24

| Mutation | | Activity |
|---|---|---|
| Tyr6Ala | (SEQ ID NO: 45) | Enhanced |
| Arg11Ala | (SEQ ID NO: 50) | Enhanced |
| Leu13Ala | (SEQ ID NO: 52) | Enhanced |
| Leu14Ala | (SED ID NO: 53) | Enhanced |
| Glu30Ala | (SEQ ID NO: 69) | Enhanced |
| Cys52Ala | (SEQ ID NO: 91) | Greatly enhanced |
| Gly58Ala | (SEQ ID NO: 97) | Greatly enhanced |
| Ala59Gly | (SEQ ID NO: 98) | Enhanced |
| Ile64Ala | (SEQ ID NO: 103) | Enhanced |

TABLE 24-continued

| Mutation | | Activity |
|---|---|---|
| Gln73Ala | (SEQ ID NO: 112) | Enhanced |
| Thr76Ala | (SEQ ID NO: 115) | Enhanced |
| Pro86Ala | (SEQ ID NO: 125) | Enhanced |
| Ala111Gly | (SEQ ID NO: 150) | Enhanced |
| Gly122Ala | (SEQ ID NO: 161) | Enhanced |
| Tyr134Ala | (SEQ ID NO: 173) | Enhanced |
| Lys136Ala | (SEQ ID NO: 175) | Enhanced |
| Gly141Ala | (SEQ ID NO: 180) | Enhanced |
| Val158Ala | (SEQ ID NO: 197) | Greatly Enhanced |
| Arg161Ala | (SEQ ID NO: 200) | Enhanced |
| Ala166Gly | (SEQ ID NO: 205) | Enhanced |
| Thr177Ala | (SEQ ID NO: 216) | Enhanced |

Protease activity is associated with viral assembly and maturation (See, e.g., Babe et al., *Cell*, 91:427-430 (1997)). Accordingly, mutant NS3/NS4A polypeptides with altered protease activity and their encoding nucleic acids are useful in the immunogenic compositions described herein. The fragments listed in TABLES 23-24 are preferred immunogens that can be incorporated with or without an adjuvant (e.g., ribavirin) into a composition for administration to an animal so as to induce an immune response in said animal to HCV.

As shown in TABLE 25, the following NS3/4A constructs have amino acid substitutions that did not have a large effect (SEQ ID NOs: 40, 48-49, 54, 56, 60-61, 66, 72, 74-75, 77-79, 82, 85, 89, 100-102, 107-110, 113-114, 121, 131, 144, 146, 148-149, 152-153, 156, 160, 166, 167, 170-171, 177, 181, 185-186, 189-190, 194-195, 198-199, 204, 206, 209, 210, 213, 215, and 217), or did not have any detectable effect on protease activity (SEQ ID NOs: 41-44, 46, 47, 51, 55, 58, 59, 62, 65, 67-68, 70-71, 73, 76, 80-81, 84, 86, 88, 90, 93, 95, 99, 104-106, 111, 116-119, 123, 127-129, 134-135, 137, 139-143, 151, 154-155, 157-159, 164, 168-169, 172, 176, 191, 193, 196, 201-203, 211-212, and 218-220). The fragments listed in TABLE 22 are preferred immunogens that can be incorporated with or without an adjuvant (e.g., ribavirin) into a composition for administration to an animal so as to induce an immune response in said animal to HCV.

TABLE 25

| Mutation | | Activity |
|---|---|---|
| Ala1Gly | (SEQ ID NO: 40) | Little Effect |
| Pro2Ala | (SEQ ID NO: 41) | No Effect |
| Ile3Ala | (SEQ ID NO: 42) | No Effect |
| Thr4Ala | (SED ID NO: 43) | No Effect |
| Ala5Gly | (SEQ ID NO: 44) | No Effect |
| Ala7Gly | (SEQ ID NO: 46) | No Effect |
| Gln8Ala | (SEQ ID NO: 47) | No Effect |
| Gln9Ala | (SEQ ID NO: 48) | Little Effect |

TABLE 25-continued

| Mutation | | Activity |
|---|---|---|
| Thr10Ala | (SEQ ID NO: 49) | Little Effect |
| Gly12Ala | (SEQ ID NO: 51) | No Effect |
| Gly15Ala | (SEQ ID NO: 54) | Little Effect |
| Cys16Ala | (SEQ ID NO: 55) | No Effect |
| Ile17Ala | (SEQ ID NO: 56) | Little Effect |
| Thr19Ala | (SEQ ID NO: 58) | No Effect |
| Ser20Ala | (SEQ ID NO: 59) | No Effect |
| Leu21Ala | (SEQ ID NO: 60) | Little Effect |
| Thr22Ala | (SEQ ID NO: 61) | Little Effect |
| Gly23Ala | (SEQ ID NO: 62) | No Effect |
| Lys26Ala | (SEQ ID NO: 65) | No Effect |
| Asn27Ala | (SEQ ID NO: 66) | Little Effect |
| Gln28Ala | (SEQ ID NO: 67) | No Effect |
| Val29Ala | (SEQ ID NO: 68) | No Effect |
| Gly31Ala | (SEQ ID NO: 70) | No Effect |
| Glu32Ala | (SEQ ID NO: 71) | No Effect |
| Val33Gly | (SEQ ID NO: 72) | Little Effect |
| Gln34Ala | (SEQ ID NO: 73) | No Effect |
| Ile35Ala | (SEQ ID NO: 74) | Little Effect |
| Val36Ala | (SEQ ID NO: 75) | No Effect |
| Ser37Ala | (SEQ ID NO: 76) | Little Effect |
| Thr38Ala | (SEQ ID NO: 77) | Little Effect |
| Ala39Gly | (SEQ ID NO: 78) | Little Effect |
| Ala40Gly | (SEQ ID NO: 79) | Little Effect |
| Gln41Ala | (SEQ ID NO: 80) | No Effect |
| Thr42Ala | (SEQ ID NO: 81) | No Effect |
| Phe43Ala | (SEQ ID NO: 82) | Little Effect |
| Ala45Gly | (SEQ ID NO: 84) | No Effect |
| Thr46Ala | (SEQ ID NO: 85) | Little Effect |
| Cys47Ala | (SEQ ID NO: 86) | No Effect |
| Gln49Ala | (SEQ ID NO: 88) | No Effect |
| Gly50Ala | (SEQ ID NO: 89) | Little Effect |
| Val51Ala | (SEQ ID NO: 90) | Little Effect |
| Thr54Ala | (SEQ ID NO: 93) | No Effect |
| Arg161Ala | (SEQ ID NO: 95) | No Effect |
| Ala56Gly | (SEQ ID NO: 99) | No Effect |
| Phe57Ala | (SEQ ID NO: 100) | Little Effect |
| Leu58Ala | (SEQ ID NO: 101) | No Effect |
| Thr63Ala | (SEQ ID NO: 102) | Little Effect |

TABLE 25-continued

| Mutation | | Activity |
|---|---|---|
| Thr64Ala | (SEQ ID NO: 103) | No Effect |
| Ala65Gly | (SEQ ID NO: 104) | No Effect |
| Ser66Ala | (SEQ ID NO: 105) | No Effect |
| Pro67Ala | (SEQ ID NO: 106) | No Effect |
| Lys68Ala | (SEQ ID NO: 107) | Little Effect |
| Gly69Ala | (SEQ ID NO: 108) | Little Effect |
| Pro70Ala | (SEQ ID NO: 109) | Little Effect |
| Val71Ala | (SEQ ID NO: 110) | Little Effect |
| Ile72Ala | (SEQ ID NO: 111) | Little Effect |
| Met74Ala | (SEQ ID NO: 113) | Little Effect |
| Tyr75Ala | (SEQ ID NO: 114) | Little Effect |
| Gln77Ala | (SEQ ID NO: 116) | No Effect |
| Val78Ala | (SEQ ID NO: 117) | No Effect |
| Asp79Ala | (SEQ ID NO: 118) | No Effect |
| Gln80Ala | (SEQ ID NO: 119) | No Effect |
| Leu82Ala | (SEQ ID NO: 121) | Little Effect |
| Gly84Ala | (SEQ ID NO: 123) | No Effect |
| Pro88Ala | (SEQ ID NO: 127) | No Effect |
| Gln89Ala | (SEQ ID NO: 128) | No Effect |
| Gly90Ala | (SEQ ID NO: 129) | No Effect |
| Arg92Ala | (SEQ ID NO: 131) | Little Effect |
| Thr95Ala | (SEQ ID NO: 134) | No Effect |
| Pro96Ala | (SEQ ID NO: 135) | No Effect |
| Thr98Ala | (SEQ ID NO: 137) | No Effect |
| Gly100Ala | (SEQ ID NO: 139) | No Effect |
| Ser101Ala | (SEQ ID NO: 140) | No Effect |
| Ser102Ala | (SEQ ID NO: 141) | No Effect |
| Asp103Ala | (SEQ ID NO: 142) | No Effect |
| Leu104Ala | (SEQ ID NO: 143) | No Effect |
| Try105Ala | (SEQ ID NO: 144) | Little Effect |
| Val107Ala | (SEQ ID NO: 146) | Little Effect |
| Arg109Ala | (SEQ ID NO: 148) | Little Effect |
| His110Ala | (SEQ ID NO: 149) | Little Effect |
| Asp112Ala | (SEQ ID NO: 151) | No Effect |
| Val113Ala | (SEQ ID NO: 152) | Little Effect |
| Ile114Ala | (SEQ ID NO: 153) | Little Effect |
| Pro115Ala | (SEQ ID NO: 154) | No Effect |
| Val116Ala | (SEQ ID NO: 155) | No Effect |
| Arg118Ala | (SEQ ID NO: 157) | No Effect |
| Arg119Ala | (SEQ ID NO: 158) | Little Effect |
| Gly120Ala | (SEQ ID NO: 159) | No Effect |
| Asp121Ala | (SEQ ID NO: 160) | Little Effect |
| Ser125Ala | (SEQ ID NO: 164) | No Effect |
| Leu127Ala | (SEQ ID NO: 166) | Little Effect |
| Ser128Ala | (SEQ ID NO: 167) | Little Effect |
| Pro129Ala | (SEQ ID NO: 168) | No Effect |
| Arg130Ala | (SEQ ID NO: 169) | No Effect |
| Pro131Ala | (SEQ ID NO: 170) | Little Effect |
| Ile132Ala | (SEQ ID NO: 171) | Little Effect |
| Ser133Ala | (SEQ ID NO: 172) | No Effect |
| Gly137Ala | (SEQ ID NO: 176) | No Effect |
| Ser138Ala | (SEQ ID NO: 177) | Little Effect |
| Pro142Ala | (SEQ ID NO: 181) | Little Effect |
| Pro146Ala | (SEQ ID NO: 185) | Little Effect |
| Ala147Gly | (SEQ ID NO: 186) | Little Effect |
| Ala150Gly | (SEQ ID NO: 189) | Little Effect |
| Val155Gly | (SEQ ID NO: 190) | Little Effect |
| Gly152Ala | (SEQ ID NO: 191) | No Effect |
| Phe154Ala | (SEQ ID NO: 193) | No Effect |
| Arg155Ala | (SEQ ID NO: 194) | Little Effect |
| Ala156Gly | (SEQ ID NO: 195) | Little Effect |
| Ala157Gly | (SEQ ID NO: 196) | No Effect |
| Cys159Ala | (SEQ ID NO: 198) | Little Effect |
| Thr160Ala | (SEQ ID NO: 199) | Little Effect |
| Gly162Ala | (SEQ ID NO: 201) | No Effect |
| Val163Ala | (SEQ ID NO: 202) | No Effect |
| Ala164Gly | (SEQ ID NO: 203) | No Effect |
| Lys165Ala | (SEQ ID NO: 204) | Little Effect |
| Val167Ala | (SEQ ID NO: 206) | Little Effect |
| Ile170Ala | (SEQ ID NO: 209) | Little Effect |
| Pro171Ala | (SEQ ID NO: 210) | Little Effect |
| Val172Ala | (SEQ ID NO: 211) | No Effect |
| Glu173Ala | (SEQ ID NO: 212) | No Effect |
| Ser174Ala | (SEQ ID NO: 213) | Little Effect |
| Glu176Ala | (SEQ ID NO: 215) | Little Effect |
| Thr178Ala | (SEQ ID NO: 217) | Little Effect |
| Met179Ala | (SEQ ID NO: 218) | No Effect |

TABLE 25-continued

| Mutation | | Activity |
|---|---|---|
| Arg180Ala | (SEQ ID NO: 219) | No Effect |
| Ser181Ala | (SEQ ID NO: 220) | No Effect |

The mutant HCV genes and the encoded polypeptides disclosed herein are useful as novel research tools for drug discovery. Specifically, polypeptides exhibiting enhanced protease activity can be used in assays to identify novel compounds that inhibit protease activity. Such screening assays will include assays amenable to high-throughput screening of chemical libraries, making them particularly suitable for identifying small molecule drug candidates. Small molecules contemplated include synthetic organic or inorganic compounds. The assays can be performed in a variety of formats, including protein-protein binding assays, biochemical screening assays, immunoassays and cell based assays, which are well characterized in the art.

The HCV genes encoding polypeptides with altered protease activity are useful in the creation of transgenic organisms, as described herein in paragraphs [0183]-[0184]. Transgenic organisms expressing mutant HCV polypeptides are useful as model organisms for the study of HCV replication and life cycle.

EXAMPLE 15

Two particular mutants, Val1055Ala (corresponding to Val29Ala of SEQ ID NO: 68) and Gln1060Ala (corresponding to Gln34Ala of SEQ ID NO: 73), were tested for their ability to proteolytically cleave the NS3-NS4A junction while not cleaving the human IPS-1 molecule to ΔIPS-1. As detailed in above, Val29Ala of SEQ ID NO: 68 and Gln34Ala of SEQ ID NO: 73 were tested for their ability to affect the protease activity in the HCV isolate. These mutants were found through mutagenesis of the NS3 protease domain wherein the residues depicted in FIG. 18 were replaced with Alanine or Glycine and tested for their effect on cleavage of the NS3-NS4A cleavage site (also depicted in FIG. 18). Also mentioned above, these two mutants did not have a large effect on protease activity in the HCV isolate. These mutants were further tested for their ability to cleave the human IPS-1 molecule to ΔIPS-1.

Cells were cotransfected with a plasmid coding for the human IPS-1 gene as well as a pVAX1 plasmid expressing the mutant NS3/4A gene. 36 hours later the cells were lyse. Cleaved and uncleaved IPS-1 peptides were visualized on an SDS-PAGE gel after a Western blot with antibodies specific for the IPS-1 fragments. As shown in FIGS. 19A and 19B Val1055Ala (corresponding to Val29Ala of SEQ ID NO: 68) and Gln1060Ala (corresponding to Gln34Ala of SEQ ID NO: 73) were not able to cleave IPS-1 to ΔIPS-1.

EXAMPLE 16

A particular mutant, containing two amino acid mutations Val1055Ala and Gln1060Ala (corresponding to Val29Ala and Gln34Ala, respectively, of SEQ ID NO: 1329), is created by combining the mutations present in SEQ ID NOs.: 68 and 73. The residues referred to as 1055 and 1060 vary by 1026 amino acids from the listed sequences as the NS3/4A gene begins at residue 1026 of the HCV polyprotein. This mutant is tested for its affect on the proteolytic cleavage of the NS3-

NS4A junction as in Example 15. Results show that the mutant does not have a large effect on protease activity in the HCV isolate.

This mutant is further tested for its ability to cleave the human IPS-1 molecule to ΔIPS-1 as detailed above. Results show that the IPS-1 gene is not cleaved to ΔIPS-1 by the mutant represented by SEQ ID NO: 1329.

EXAMPLE 17

NS3 protease mutants represented by SEQ ID NOs: 1330-1339 are tested for their ability to affect NS3 protease cleavage at the NS3-NS4A protease cleavage site, as explained in above. Mutants having no effect, little effect, no substantial effect, or heightened effect on protease cleavage at the NS3-NS4A protease cleavage site are selected for further testing.

These mutants are further tested for their ability to cleave the human IPS-1 molecule to ΔIPS-1 as detailed above. Mutants that cannot cleave IPS-1 to ΔIPS-1 are selected as favorable mutants.

EXAMPLE 18

Mutants containing two or more amino acid mutations, created by combining any number of favorable mutants described above, are created. These mutants are tested for their ability to affect NS3 protease cleavage at the NS3-NS4A protease cleavage site, as detailed in above. Mutants having no effect, little effect, no substantial effect, or heightened effect on protease cleavage at the NS3-NS4A protease cleavage site are selected for further testing.

These mutants are further tested for their ability to cleave the human IPS-1 molecule to ΔIPS-1 as detailed above. Mutants that cannot cleave IPS-1 to ΔIPS-1 are selected as favorable mutants.

Although the invention has been described with reference to embodiments and examples, it should be understood that various modifications can be made without departing from the spirit of the invention. Accordingly, the invention is limited only by the following claims.

The next example demonstrates that chimeric NS3/4A nucleic acids and encoded polypeptides described herein prime CTL responses to the T cell epitopes encoded therein.

EXAMPLE 19

The Hepatitis B viral core protein (HBc) has been disclosed as an immunogenic moiety that stimulates the T cell response of an immunized host animal. See, e.g, U.S. Pat. Nos. 4,818,527, 4,882,145 and 5,143,726. More particularly, the sequence of SEQ ID NO:1014 of the Hepatitis B core protein has been shown to elicit a specific T-cell response when administered to mice. To assess the ability of SEQ ID NO:1014 DNA constructs to prime CTLs, the nucleic acid of SEQ ID NO:1015 is cloned into the pVAX1 expression vector (Invitrogen, Carlsbad, Calif.) to create HBcAg-pVAX1.

Plasmids are grown in BL21 *E. coli* cells, and sequenced for accuracy. Plasmid DNA used for in vivo vaccination is purified using Qiagen DNA purification columns, according to the manufacturer's instructions (Qiagen GmbH, Hilden, FRG). The concentration of the resulting plasmid DNA is determined spectrophotometrically (Dynaquant, Pharmacia Biotech, Uppsala, Sweden) and the purified DNA is dissolved in sterile phosphate buffered saline (PBS) at a concentration of 1 mg/ml.

Groups of eight to ten C57/BL6 mice are primed with HBcAg-pVAX1 intra muscularly (i.m.) or using a gene gun.

For i.m. delivery, mice are immunized by needle injections of 100 µg plasmid DNA given intramuscularly to the tibialis anterior (TA) muscle. 5 days prior to DNA immunization, mice are injected intramuscularly with 50 µl per TA muscle of 0.01 mM cardiotoxin (Latoxan) in 0/9% sterile saline. The mice are boosted with a second injection of 100 µg plasmid DNA four weeks subsequent to the first DNA immunization. For gene gun delivery, plasmid DNA is linked to gold particles according to protocols supplied by the manufacturer (Bio-Rad Laboratories, Hercules, Calif.). Prior to immunization, the injection area is shaved and the immunization is performed according to the manufacturer's protocol. Each injection dose contains 4 µg of plasmid DNA. Immunizations are performed on weeks 0 and 4.

The presence of CTLs specific for SEQ ID NO:1014 is assayed using a standard $^{51}$Cr-release assay. Briefly, spleen cells are harvested from mice 14 days after the initial immunization or the booster immunization. Chromium release assays are performed as described in Lazdina, et al. (2003) *J. Gen. Virol.* 84:1-8, herein expressly incorporated by reference in its entirety. Single cell suspensions are prepared. $25 \times 10^6$ splenocytes are restimulated with $25 \times 10^6$ syngenic irradiated (20 Gy) splenocytes pulsed with 0.05 µM peptide, as previously described. Sandberg et al. (2000) *J. Immunol.* 165:25-33, herein expressly incorporated by reference in its entirety. Restimulation cultures are set in 12 ml complete RPMI medium (Gibco). After 5 days, effector cells are harvested and washed twice. RMA-S target cells (Karre et al. (1986) *Nature* 319:675-678) are pulsed with 50 µM peptide for 90 min at 5% $CO_2$ and 37° C. Serial dilutions of effector cells are incubated with $5 \times 10^3$ chromium-labeled peptide pulsed RMA-S target cells in a final volume of 200 µl per well in 96-well plates. After a 4 hour incubation at 5% $CO_2$ and 37° C., 100 µl of supernatant is collected and the radioactivity is determined using a γ counter. The percentage of specific release is calculated according to the formula: (Experimental release−spontaneous release/total release−spontaneous release)×100.

The results of the $^{51}$Cr-release assay is shown in FIG. 20A. i.m. injection of HBcAg-pVAX1 elicits a cellular immune response. By contrast, immunization with HBcAg-pVAX1 via a gene gun does not elicit a cellular immune response. FIG. 20B.

In another set of experiments, the presence of CTLs specific for the SEQ ID NO:1014 is assayed using a standard ELISPOT assay to detect γ-IFN-secreting CTLs. Current Protocols in Immunology, Edited by: John E. Coligan, Ada M. Kruisbeek, David H. Margulies, Ethan M. Shevach, Warren Strober (2001 John Wiley & Sons, NY, N.Y.)

In still another set of experiments, the NS3/4A chimeric polypeptides encoded by the nucleic acids are used to immunize mice, using standard immunization procedures for polypeptides such as those disclosed in co-pending U.S. Patent Application No. 60/685,014, the contents of which is hereby expressly incorporated by reference in its entirety.

In contrast to HBcAg-pVAX1, nucleic acids encoding the NS3/4A peptide can effectively prime CTLs by both intra muscular and gene gun delivery. See, e.g. co-pending U.S. Provisional Patent Application No. 60/685,014. To demonstrate that NS3/4A functions as a T-cell epitope carrier, chimeric NS3/4A nucleic acids that include the TCE encoded by SEQ ID NO:1015, or the encoded polypeptides, are tested for their ability to prime CTLs by both i.m. and gene gun delivery. The NS3/4A-pVAX vector described in Example 1 is used to generate NS3/4A chimeric expression vectors containing in-frame fusions of SEQ ID NO:1015 using standard cloning techniques. See, Ausubel et al., supra. The chimeric NS3/4A expression vectors contain in-frame fusions of SEQ ID NO:1015 to the 5' end of the NS3/4A coding sequence; to the 3' end of the NS3/4A coding sequence, and within the NS3/4A coding sequence such that the epitope of SEQ ID NO:1015 is between amino acids 181 and 182 of SEQ ID NO: 36, between amino acid residues 453 and 513 of SEQ ID NO:36 (e.g., SEQ ID NO:1013, which encodes the NS3/4A chimeric polypeptide of SEQ ID NO:1012) or in analogous positions in any NS3/4A polypeptide, or elsewhere within the NS3/4A polypeptide. The chimeric NS3/4A nucleic acids are delivered to mice either intramuscularly or using a gene gun, as described herein. Specific CTL responses are measured using a $^{51}$Cr-release assay or ELIspot assay.

The ability of the chimeric NS3/4A vectors to prime CTLs is similar whether the vector is administered intramuscularly or using a gene gun, demonstrating that presentation of epitopes in the context of NS3/4A effectively primes CTLs against the epitopes. This example also suggests that the NS3/4A platform is useful for generating immune responses to HBV TCEs that elicit immune responses in humans, (e.g. SEQ ID SEQ ID NO:351).

The following example describes the generation and validation of immunogenic compositions that generate or enhance CTL priming to specific antigens.

EXAMPLE 20

Chimeric NS3/4A nucleic acid constructs encoding at least one TCE juxtaposed to or inserted within various positions along the NS3/4A polypeptide are made and assayed for their ability to prime an immune response to the TCE. Chimeric polypeptides encoded by the NS3/4A chimeric nucleic acids are also assayed for their ability to prime an immune response to the encoded TCE. A TCE to which a CTL response is desired (e.g. any one of the TCEs presented herein, including SEQ ID NOs: 221-271, SEQ ID NOs:809-1011, and SEQ ID NO:1014) is selected. Using standard cloning techniques, the nucleic acid encoding the TCE (e.g. any one of the TCEs presented herein, including SEQ ID NOs: 221-271, SEQ ID NOs:809-1011, and SEQ ID NO:1014) is cloned into the NS3/4A-pVAX vector described in Example 1, or an equivalent thereof (e.g. an NS3/4A-pVAX vector wherein the NS3/4A sequence is selected from the group of SEQ ID NOs: 572-808) to generate a chimeric NS3/4A-pVAX vector. The chimeric NS3/4A-pVAX vectors encode chimeric NS3/4A polypeptides in which the TCE is juxtaposed to the N-terminus or C-terminus of the NS3/4A polypeptide, or is located within the NS3/4A polypeptide (e.g., between amino acids 181 and 182 of SEQ ID NO: 2).

Plasmids that have been sequenced for accuracy are purified and prepared for use in immunization as described in Example 19. Alternatively, polypeptides encoded by said nucleic acids are expressed and used in immunizations as described in Example 19. Mice are primed with the chimeric NS3/4A-pVAX nucleic acids intra muscularly (i.m.) or using a gene gun as described in Example 19, or by another method (e.g., using electroporation (Innovio, Oslo, Sweden) according to the manufacturer's instructions).

The priming of CTLs specific for the TCE (e.g., an epitope listed in presented herein, including SEQ ID NOs: 221-271, SEQ ID NOs:809-1011, and SEQ ID NO:1014) is assayed using a standard $^{51}$Cr-release assay or a standard ELISPOT assay to detect γ-IFN-secreting CTLs. Data from the $^{51}$Cr-release assay or the ELISPOT assay are used to determine preferred sites of insertion of the TCE within the NS3/4A-pVAX vector Chimeric NS3/4A expression vectors contain in-frame fusions of TCEs (e.g., an epitope listed in presented herein, including SEQ ID NOs: 221-271, SEQ ID NOs:809-1011, and SEQ ID NO:1014) to the 5' end of the NS3/4A coding sequence; to the 3' end of the NS3/4A coding sequence, and within the NS3/4A coding sequence such that the TCE is between amino acids 181 and 182 of SEQ ID NO: 36, between amino acid residues 453 and 513 of SEQ ID NO:36, or in analogous positions in any NS3/4A polypeptide, or elsewhere within the NS3/4A polypeptide. The chimeric NS3/4A nucleic acids or encoded polypeptides are delivered to mice either intramuscularly or using a gene gun, as described herein. Specific CTL responses are measured using a $^{51}$Cr-release assay or ELISPOT assay as described in Example 3.

For each TCE, preferred sites of insertion within an NS3/4A nucleic acid, or juxtaposed to the NS3/4A nucleic acid are determined by comparing the immune responses generated by the chimeric nucleic acids or encoded polypeptides. Accordingly, provided herein are methods of making an immunogen that can include the steps of a) identifying a TCE against which an immune response is desired b) generating at least one chimeric NS3/4A nucleic acid in which the DNA sequence encoding the TCE is juxtaposed to or inserted within the NS3/4A sequence (e.g., SEQ ID NO: 1), and c) detecting the immune response generated by the chimeric NS3/4A nucleic acid or encoded polypeptide.

EXAMPLE 21

The Hepatitis B viral core protein (HBc) is an immunogen that stimulates the T cell response of an immunized host animal. See, e.g, U.S. Pat. Nos. 4,818,527, 4,882,145 and 5,143,726, all of which are hereby expressly incorporated by reference in their entireties. In fact, the Hepatitis B core protein (HBcAg) has been shown to elicit a specific T-cell response in immunized mice. It is contemplated that DNA immunogens that are codon-optimized for expression in humans and which encode the HCV NS3/4A platform and fragments of HBcAg separated by NS3 protease cleavage sites will effectively prime HBcAg-specific CTLs, stimulate HBcAg-specific proliferative T cell responses, and induce production of HBcAg-specific antibodies in animals when these DNA immunogens are delivered by various DNA vaccination methodologies. In some embodiments, it is contemplated that the DNA immunogens, which are codon-optimized for expression in humans and which encode the HCV NS3/4A platform and fragments of HBcAg separated by NS3 protease cleavage sites will be more effective at priming HBcAg-specific CTLs, stimulating HBcAg-specific proliferative T cell responses, and inducing production of HBcAg-specific antibodies in animals than conventional DNA immunogens that encode HBcAg antigens and more effective than DNA immunogens that encode the NS3/4A platform and fragments of HBcAg without NS3 protease cleavage sites.

To determine the immunogenicity of codon-optimized DNA constructs encoding the HCV NS3/4A platform and fragments of HBcAg separated by NS3 protease cleavage sites and to compare the efficiency of these constructs with conventional HBcAg-containing constructs with and without the NS3/4A platform, several codon-optimized DNA constructs encoding the HCV NS3/4A platform and fragments of HBcAg separated by NS3 protease cleavage sites including antigenic sequences in various orientations are made (see SEQ ID NOs: 1174-1198 and FIG. 1). Codon-optimized DNA constructs encoding only the HBcAg and/or fragments thereof or encoding the NS3/4A platform and the HBcAg and/or fragments thereof without NS3 protease cleavage sites are also made for comparison. Codon optimized DNA encoding the HCV NS3/4A platform and fragments of HBcAg in various orientations separated by NS3 protease cleavage sites are cloned into the pVAX1 expression vector (Invitrogen, Carlsbad, Calif.) or other suitable DNA vaccination vectors. Once the constructs are made, they are provided to animals by a DNA vaccination methodology (e.g., injection, electroporation, such as MedPulser®, or intranasal or transdermal delivery). Analysis of the presence and amount of HBcAg-specific CTLs can then be made before during and after several introductions of the constructs (e.g., an initial introduction followed by one, two, three, four, or five boosting events). It will be shown that the presence of the HCV NS3/4A platform provides a more robust DNA immunogen, as compared to immunogens that lack the NS3/4A platform, and that the presence of one or more NS3/4A protease cleavage sites within the antigen also improves immunogenicity. It is also expected that the presence of shuffled HBcAg antigenic fragments (e.g., SEQ ID NOs: 1191-1198) within the antigen will provide a greater immune response than the unshuffled native antigen or fragments thereof. The following describes these experiments in greater detail.

Plasmids containing the codon-optimized (human) DNA immunogens encoding the HCV NS3/4A platform and fragments of HBcAg separated by the NS3/4A protease cleavage site will be grown in BL21 E. coli cells, and sequenced for accuracy. Although the fragments of HBcAg are separated by the NS3/4A protease cleavage site, any NS3 protease cleavage site can be used (e.g., NS4A/B, NS4B/5A, and NS5A/B). The NS3/4A platform is separated from the fragments of HBcAg by an NS4A/B cleavage site, although any NS3 protease cleavage site can be used. In the construct, the NS3 platform is separated from the NS4A by the NS3/4A protease cleavage site, although any NS3 protease cleavage site can be used. Plasmids containing the conventional HBcAg sequence and/or fragments thereof will also be grown for comparison. Plasmid DNA used for in vivo vaccination is then purified using Qiagen DNA purification columns, according to the manufacturer's instructions (Qiagen GmbH, Hilden, FRG). The concentration of the resulting plasmid DNA is determined spectrophotometrically (Dynaquant, Pharmacia Biotech, Uppsala, Sweden) and the purified DNA is dissolved in sterile phosphate buffered saline (PBS) at a concentration of approximately 1 mg/ml.

Groups of eight to ten C57/BL6 mice or New Zealand rabbits are primed with an HBcAg-containing construct (see SEQ ID NOs: 1174-1198 and FIG. 1) intranasally, transdermally, intra muscularly (i.m.), or using an electroporation device (e.g., MedPulser®).

If a transdermal or intranasal delivery is evaluated, an amount of plasmid DNA that is sufficient to deliver approximately 70 μg-100 μg of plasmid DNA per dose is formulated with the delivery vehicle. Animals are then provided the plasmid DNA one, two, three, four, or five times at monthly intervals. Prior to transdermal immunization, the delivery area is shaved.

If intramuscular injection is evaluated, animals are immunized i.m with approximately 70-100 μg plasmid DNA at the tibialis anterior (TA) muscle. 5 days prior to DNA immunization, animals may also be injected intramuscularly with 50 μl per TA muscle of 0.01 mM cardiotoxin (Latoxan) in 0/9% sterile saline.

When electroporation is evaluated, animals are immunized i.m with approximately 70-100 μg plasmid DNA at the tibialis anterior (TA) muscle and immediately after injection, the Medpulser® is applied with a 0.5 cm needle array set to deliver two 60 ms pulses of 246 V/cm to the injection site. In mice, one two needle electrode tip is used and when rabbits are used, one four needle electrode tip is used per injection per animal. The procedure can be repeated up to three times in mice and up to five times in rabbits at monthly intervals.

If gene gun delivery is performed, plasmid DNA is linked to gold particles according to protocols supplied by the manufacturer (Bio-Rad Laboratories, Hercules, Calif.). Prior to immunization, the injection area is shaved and the immunization is performed according to the manufacturer's protocol. Each injection dose by gene gun contains 4-100 µg of plasmid DNA. Immunizations are performed on weeks 0 and 4.

The presence of CTLs specific for HBcAg is then assayed using a standard $^{51}$Cr-release assay. Briefly, spleen cells are harvested from immunized animals 14 days after the initial immunization or a booster immunization. Chromium release assays are performed as described in Lazdina, et al. (2003) J. Gen. Virol. 84:1-8, herein expressly incorporated by reference in its entirety. Single cell suspensions are prepared. $25 \times 10^6$ splenocytes are restimulated with $25 \times 10^6$ syngenic irradiated (20 Gy) splenocytes pulsed with 0.05 µM peptide, as previously described. Sandberg et al. (2000) J. Immunol. 165:25-33, herein expressly incorporated by reference in its entirety. Restimulation cultures are set in 12 ml complete RPMI medium (Gibco). After 5 days, effector cells are harvested and washed twice. RMA-S target cells (Karre et al. (1986) Nature 319:675-678) are pulsed with 50 µM peptide for 90 min at 5% $CO_2$ and 37° C. Serial dilutions of effector cells are incubated with $5 \times 10^3$ chromium-labeled peptide pulsed RMA-S target cells in a final volume of 200 µl per well in 96-well plates. After a 4 hour incubation at 5% $CO_2$ and 37° C., 100 µl of supernatant is collected and the radioactivity is determined using a γ counter. The percentage of specific release is calculated according to the formula: (Experimental release–spontaneous release/total release–spontaneous release)×100. The results of the $^{51}$Cr-release assay will show that the presence of the HCV NS3/4A platform provides a more robust DNA immunogen, as compared to immunogens that lack the NS3/4A platform, and that the presence of one or more NS3/4A protease cleavage sites within the antigen also improves immunogenicity. The assay will further show that the presence of shuffled HBcAg antigenic fragments (e.g., SEQ ID NOs: 1191-1198) within the antigen will provide a greater immune response than the unshuffled native antigen or fragments thereof.

In another set of experiments, the presence of γ-IFN-secreting CTLs and T helper (Th) cells to HBcAg in splenocyte or lymph node cultures will be evaluated using a commercially available ELISpot assay. (See Current Protocols in Immunology, Edited by: John E. Coligan, Ada M. Kruisbeek, David H. Margulies, Ethan M. Shevach, Warren Strober (2001 John Wiley & Sons, NY, N.Y.), herein expressly incorporated by reference in its entirety). By this approach, the number of γ-IFN-secreting CTLs or spots is determined at various concentrations of peptide. These experiments will show that the presence of the HCV NS3/4A platform provides a more robust DNA immunogen, as compared to immunogens that lack the NS3/4A platform, and that the presence of one or more NS3/4A protease cleavage sites within the antigen also improves immunogenicity. The assay will further show that the presence of shuffled HBcAg antigenic fragments (e.g., SEQ ID NOs: 1191-1198) within the antigen will provide a greater immune response than the unshuffled native antigen or fragments thereof.

In still another set of experiments, the proliferative responses to HbcAg in whole blood obtained from immunized animals is determined. An amount of whole blood is obtained from the animal (e.g., approximately 4 ml from a rabbit), prior to the first vaccination and two weeks after each vaccination. The blood is collected in Heparin tubes and the plasma and peripheral mononuclear cells (PBMCs) are isolated by gradient centrifugation. The plasma is stored at −80 degrees Centrigrade until analysis for HBcAg-specific antibodies. The presence and amount of antibodies specific for HBcAg in the various samples can be measured using an ELISA assay. The PBMCs are immediately assayed for in vitro proliferative recall responses using a standard 96 h proliferation assay. (See Lazinda et al., J. Gen. Virol. 82:1299-1308 (2001), herein expressly incorporated by reference in its entirety.) In brief, microtiter plates are seeded with approximately 200,000 cells/well and the cells are incubated with media alone, phytohaemagglutinin (PHA) or recombinant HbcAg. After 72 hours, radioactive thymidine is added and 16-24 hours later the cells are harvested, The proliferation is determined as radioactivity of the cells as the counts per minute (cpm) of cells incubated with the antigen divided by the CPM of the cells incubated with the media alone (sample to negative ration; S/N). Groups are compared by the mean S/N ratios at several time points). These experiments will show that the presence of the HCV NS3/4A platform provides a more robust DNA immunogen, as compared to immunogens that lack the NS3/4A platform, and that the presence of one or more NS3/4A protease cleavage sites within the antigen also improves immunogenicity. The assay will also show that the presence of shuffled HBcAg antigenic fragments (e.g., SEQ ID NOs: 1191-1198) within the antigen will provide a greater immune response than the unshuffled native antigen or fragments thereof.

In yet another set of experiments, tumor inhibition assays will be carried out. Two weeks after the last immunization, mice will be challenged using tumor cells expressing the corresponding vaccine antigen, and protection against tumor growth will be measured. These experiments will show that the presence of the HCV NS3/4A platform provides a more robust DNA immunogen, as compared to immunogens that lack the NS3/4A platform, and that the presence of one or more NS3/4A protease cleavage sites within the antigen also improves immunogenicity. The assay will also show that the presence of shuffled HBcAg antigenic fragments (e.g., SEQ ID NOs: 1191-1198) within the antigen will provide a greater immune response than the unshuffled native antigen or fragments thereof.

In still another set of experiments, quantification of HBcAg CTL responses will be measured by flow cytometry (Tetramers and Dimer-X). These experiments will show that the presence of the HCV NS3/4A platform provides a more robust DNA immunogen, as compared to immunogens that lack the NS3/4A platform, and that the presence of one or more NS3/4A protease cleavage sites within the antigen also improves immunogenicity. The assay will also show that the presence of shuffled HBcAg antigenic fragments (e.g., SEQ ID NOs: 1191-1198) within the antigen will provide a greater immune response than the unshuffled native antigen or fragments thereof.

EXAMPLE 22

A similar methodology as that provided in EXAMPLE 21 can be applied to evaluate any DNA immunogen provided herein. More specifically, it is contemplated that DNA immunogens that are codon-optimized for expression in humans and which encode the HCV NS3/4A platform and one or more fragments of the antigens provided in SEQ ID NOs: 1016-1034, SEQ ID NOs: 1146-1173 and SEQ ID NOs:

1210-1328, wherein said fragments are separated by NS3 protease cleavage sites will effectively prime antigen-specific CTLs, stimulate antigen-specific proliferative T cell responses, and induce production of antigen-specific antibodies in animals when these DNA immunogens are delivered by various DNA vaccination methodologies. Examples of antigen fragments of SEQ ID NOs: 1019-1021, SEQ ID NO: 1146, SEQ ID NOs: 1150-1166, SEQ ID NO: 1168, SEQ ID NO: 1170, and SEQ ID NO: 1172 separated by the NS3 protease cleavage site NS3/4A are presented in SEQ ID NOs: 1122-1145. Although the fragments in SEQ ID NOs: 1122-1145 are separated by the NS3/4A protease cleavage site, any NS3 protease cleavage site can be used (e.g., NS4A/B, NS4B/5A, and NS5A/B). Additionally, it is contemplated that DNA immunogens that are codon-optimized for expression in humans and which encode the HCV NS3/4A platform and a plurality of antigenic fragments from the antigens presented in SEQ ID NOs: 1016-1034, SEQ ID NOs: 1146-1173 and SEQ ID NOs: 1210-1328, separated by NS3 protease cleavage sites, including antigenic sequences in various orientations as seen with the HBcAg from earlier examples, will also effectively prime antigen-specific CTLs, stimulate antigen-specific proliferative T cell responses, and induce production of antigen-specific antibodies in animals when these DNA immunogens are delivered by various DNA vaccination methodologies. In some embodiments, it is contemplated that the DNA immunogens, which are codon-optimized for expression in humans and which encode the HCV NS3/4A platform and one or more fragments of the antigens provided in SEQ ID NOs: 1016-1034, SEQ ID NOs: 1146-1173 and SEQ ID NOs: 1210-1328 separated by a NS3 protease cleavage site will be more effective at priming antigen-specific CTLs, stimulating antigen-specific proliferative T cell responses, and inducing production of antigen-specific antibodies in animals than conventional DNA immunogens that encode the antigens alone.

DNA constructs encoding the HCV NS3/4A platform and fragments of the antigens presented in SEQ ID NOs: 1019-1021, SEQ ID NOs: 1146-1173 and SEQ ID NOs: 1210-1328 separated by NS3 protease cleavage sites, including antigenic sequences in various orientations, are made. SEQ ID NOs: 1098-1121 presents codon optimized fragments of antigens presented in SEQ ID NOs: 1019-1021, SEQ ID NO: 1146, SEQ ID NOs: 1150-1166, SEQ ID NO: 1168, SEQ ID NO: 1170, and SEQ ID NO: 1172, wherein the fragments are separated by NS3/4A protease cleavage sites. Although the fragments are separated by NS3/4A protease cleavage sites, any NS3 protease cleavage site can be used. Additionally, although the fragments presented in SEQ ID NOs: 1098-1121 are configured in a naturally occurring order, separated by NS3 protease cleavage sites, fragments in various orientations, similar to the shuffled fragments of HBcAg in SEQ ID NOs: 1191-1198, are made. The shuffled fragments of the antigens presented in SEQ ID NOs: 1019-1021, SEQ ID NO: 1146, SEQ ID NOs: 1150-1166, SEQ ID NO: 1168, SEQ ID NO: 1170, and SEQ ID NO: 1172 are also separated by an NS3 protease cleavage site. Codon-optimized DNA constructs encoding only the fragments of antigen presented in SEQ ID NOs: 1016-1034, SEQ ID NOs: 1146-1173 and SEQ ID NOs: 1210-1328 or encoding the NS3/4A platform and the fragments of antigen presented in SEQ ID NOs: 1016-1034, SEQ ID NOs: 1146-1173 and SEQ ID NOs: 1210-1328 without NS3 protease cleavage sites are also made for comparison. Codon optimized DNA encoding the HCV NS3/4A platform and fragments of antigen presented in SEQ ID NOs: 1016-1034, SEQ ID NOs: 1146-1173 and SEQ ID NOs: 1210-1328 in various orientations separated by NS3 protease cleavage sites are cloned into the pVAX1 expression vector (Invitrogen, Carlsbad, Calif.) or other suitable DNA vaccination vectors. Once the constructs are made, they are provided to animals by a DNA vaccination methodology (e.g., injection, electroporation, such as MedPulser®, or intranasal or transdermal delivery). Analysis of the presence and amount of antigen-specific CTLs can then be made before during and after several introductions of the constructs (e.g., an initial introduction followed by one, two, three, four, or five boosting events). It will be shown that the presence of the HCV NS3/4A platform provides a more robust DNA immunogen, as compared to immunogens that lack the NS3/4A platform, and that the presence of one or more NS3/4A protease cleavage sites within the antigen also improves immunogenicity. It is also expected that the presence of shuffled antigenic fragments within the antigen will provide a greater immune response than the unshuffled native antigen or fragments thereof. The following describes these experiments in greater detail.

Plasmids containing the codon-optimized (human) DNA immunogens encoding the HCV NS3/4A platform and fragments of antigen presented in SEQ ID NOs: 1016-1034, SEQ ID NOs: 1146-1173 and SEQ ID NOs: 1210-1328 separated by the NS3/4A protease cleavage site will be grown in BL21 *E. coli* cells, and sequenced for accuracy. Although the fragments of antigen presented in SEQ ID NOs: 1016-1034, SEQ ID NOs: 1146-1173 and SEQ ID NOs: 1210-1328 are separated by the NS3/4A protease cleavage site, any NS3 protease cleavage site can be used (e.g., NS4A/B, NS4B/5A, and NS5A/B). The NS3/4A platform is separated from the fragments of antigen presented in SEQ ID NOs: 1016-1034, SEQ ID NOs: 1146-1173 and SEQ ID NOs: 1210-1328 by an NS4A/B cleavage site, although any NS3 protease cleavage site can be used. In the construct, the NS3 platform is separated from the NS4A by the NS3/4A protease cleavage site, although any NS3 protease cleavage site can be used. Plasmids containing codon-optimized nucleic acids encoding conventional fragments of antigen presented in SEQ ID NOs: 1016-1034, SEQ ID NOs: 1146-1173 and SEQ ID NOs: 1210-1328 will also be grown for comparison. Plasmid DNA used for in vivo vaccination is then purified using Qiagen DNA purification columns, according to the manufacturer's instructions (Qiagen GmbH, Hilden, FRG). The concentration of the resulting plasmid DNA is determined spectrophotometrically (Dynaquant, Pharmacia Biotech, Uppsala, Sweden) and the purified DNA is dissolved in sterile phosphate buffered saline (PBS) at a concentration of approximately 1 mg/ml.

Groups of eight to ten C57/BL6 mice or New Zealand rabbits are primed with an antigen-containing construct intranasally, transdermally, intra muscularly (i.m.), or using an electroporation device (e.g., MedPulser®).

If a transdermal or intranasal delivery is evaluated, an amount of plasmid DNA that is sufficient to deliver approximately 70 µg-100 µg of plasmid DNA per dose is formulated with the delivery vehicle. Animals are then provided the plasmid DNA one, two, three, four, or five times at monthly intervals. Prior to transdermal immunization, the delivery area is shaved.

If intramuscular injection is evaluated, animals are immunized i.m with approximately 70-100 µg plasmid DNA at the tibialis anterior (TA) muscle. 5 days prior to DNA immunization, animals may also be injected intramuscularly with 50 µl per TA muscle of 0.01 mM cardiotoxin (Latoxan) in 0/9% sterile saline.

When electroporation is evaluated, animals are immunized i.m with approximately 70-100 µg plasmid DNA at the tibialis anterior (TA) muscle and immediately after injection, the Medpulser® is applied with a 0.5 cm needle array set to deliver two 60 ms pulses of 246 V/cm to the injection site. In mice, one two needle electrode tip is used and when rabbits are used, one four needle electrode tip is used per injection per animal. The procedure can be repeated up to three times in mice and up to five times in rabbits at monthly intervals.

If gene gun delivery is performed, plasmid DNA is linked to gold particles according to protocols supplied by the manufacturer (Bio-Rad Laboratories, Hercules, Calif.). Prior to immunization, the injection area is shaved and the immunization is performed according to the manufacturer's protocol. Each injection dose by gene gun contains 4-100 μg of plasmid DNA. Immunizations are performed on weeks 0 and 4.

The presence of CTLs specific for antigen is then assayed using a standard $^{51}$Cr-release assay. Briefly, spleen cells are harvested from immunized animals 14 days after the initial immunization or a booster immunization. Chromium release assays are performed as described in Lazdina, et al. (2003) *J. Gen. Virol.* 84:1-8, herein expressly incorporated by reference in its entirety. Single cell suspensions are prepared. $25\times10^6$ splenocytes are restimulated with $25\times10^6$ syngenic irradiated (20 Gy) splenocytes pulsed with 0.05 μM peptide, as previously described. Sandberg et al. (2000) *J. Immunol.* 165:25-33, herein expressly incorporated by reference in its entirety. Restimulation cultures are set in 12 ml complete RPMI medium (Gibco). After 5 days, effector cells are harvested and washed twice. RMA-S target cells (Karre et al. (1986) *Nature* 319:675-678) are pulsed with 50 μM peptide for 90 min at 5% $CO_2$ and 37° C. Serial dilutions of effector cells are incubated with $5\times10^3$ chromium-labeled peptide pulsed RMA-S target cells in a final volume of 200 μl per well in 96-well plates. After a 4 hour incubation at 5% $CO_2$ and 37° C., 100 μl of supernatant is collected and the radioactivity is determined using a γ counter. The percentage of specific release is calculated according to the formula: (Experimental release−spontaneous release/total release−spontaneous release)×100. The results of the $^{51}$Cr-release assay will show that the presence of the HCV NS3/4A platform provides a more robust DNA immunogen, as compared to immunogens that lack the NS3/4A platform, and that the presence of one or more NS3/4A protease cleavage sites within the antigen also improves immunogenicity. The assay will further show that the presence of shuffled antigenic fragments within the antigen will provide a greater immune response than the unshuffled native antigen or fragments thereof.

In another set of experiments, the presence of γ-IFN-secreting CTLs and T helper (Th) cells to antigens in splenocyte or lymph node cultures will be evaluated using a commercially available ELISpot assay. (See Current Protocols in Immunology, Edited by: John E. Coligan, Ada M. Kruisbeek, David H. Margulies, Ethan M. Shevach, Warren Strober (2001 John Wiley & Sons, NY, N.Y.), herein expressly incorporated by reference in its entirety). By this approach, the number of γ-IFN-secreting CTLs or spots is determined at various concentrations of peptide. These experiments will show that the presence of the HCV NS3/4A platform provides a more robust DNA immunogen, as compared to immunogens that lack the NS3/4A platform, and that the presence of one or more NS3/4A protease cleavage sites within the antigen also improves immunogenicity. The assay will further show that the presence of shuffled antigenic fragments within the antigen will provide a greater immune response than the unshuffled native antigen or fragments thereof.

In still another set of experiments, the proliferative responses to antigen in whole blood obtained from immunized animals is determined. An amount of whole blood is obtained from the animal (e.g., approximately 4 ml from a rabbit), prior to the first vaccination and two weeks after each vaccination. The blood is collected in Heparin tubes and the plasma and peripheral mononuclear cells (PBMCs) are isolated by gradient centrifugation. The plasma is stored at −80 degrees Centrigrade until analysis for antigen-specific antibodies. The presence and amount of antibodies specific for antigen in the various samples can be measured using an ELISA assay. The PBMCs are immediately assayed for in vitro proliferative recall responses using a standard 96 h proliferation assay. (See Lazinda et al., J. Gen. Virol. 82:1299-1308 (2001), herein expressly incorporated by reference in its entirety.) In brief, microtiter plates are seeded with approximately 200,000 cells/well and the cells are incubated with media alone, phytohaemagglutinin (PHA) or recombinant antigen. After 72 hours, radioactive thymidine is added and 16-24 hours later the cells are harvested, The proliferation is determined as radioactivity of the cells as the counts per minute (cpm) of cells incubated with the antigen divided by the CPM of the cells incubated with the media alone (sample to negative ration; S/N). Groups are compared by the mean S/N ratios at several time points). These experiments assay will show that the presence of the HCV NS3/4A platform provides a more robust DNA immunogen, as compared to immunogens that lack the NS3/4A platform, and that the presence of one or more NS3/4A protease cleavage sites within the antigen also improves immunogenicity. The assay will further show that the presence of shuffled antigenic fragments within the antigen will provide a greater immune response than the unshuffled native antigen or fragments thereof.

In yet another set of experiments, tumor inhibition assays will be carried out. Two weeks after the last immunization, mice will be challenged using tumor cells expressing the corresponding vaccine antigen, and protection against tumor growth will be measured. These experiments will show that the presence of the HCV NS3/4A platform provides a more robust DNA immunogen, as compared to immunogens that lack the NS3/4A platform, and that the presence of one or more NS3/4A protease cleavage sites within the antigen also improves immunogenicity. The assay will further show that the presence of shuffled antigenic fragments within the antigen will provide a greater immune response than the unshuffled native antigen or fragments thereof.

In still another set of experiments, quantification of antigen CTL responses will be measured by flow cytometry (Tetramer and Dimer-X). These experiments assay will show that the presence of the HCV NS3/4A platform provides a more robust DNA immunogen, as compared to immunogens that lack the NS3/4A platform, and that the presence of one or more NS3/4A protease cleavage sites within the antigen also improves immunogenicity. The assay will further show that the presence of shuffled antigenic fragments within the antigen will provide a greater immune response than the unshuffled native antigen or fragments thereof.

Although the invention has been described with reference to embodiments and examples, it should be understood that various modification can be made without departing from the spirit of the invention. Accordingly, the invention is limited only by the following claims. All of the patents, patent applications, and references cited herein are expressly incorporated by reference in their entireties.

EXAMPLE 23

Groups of C57/BL6 mice were immunized twice with 50 μg of either plasmid containing a codon optimized NS3/4A gene, a NS3/4A-Betv1 fusion gene containing a protease cleavage site between NS3 and NS4A as well as a protease cleavage site between the NS4A and the birch antigen (SEQ ID NO: 1380), or a NS3/4A-Betv1 fusion gene containing a protease cleavage site between NS3 and NS4A, a protease cleavage site between the NS4A and the birch antigen as well as two additional protease cleavage sites within the birch antigen (SEQ ID NO: 1381) using an electroporation device. Another group of mice were immunized twice with recombinant Betv1 protein (rBetv1) in Freunds incomplete adjuvant. The two immunizations were 4 weeks apart. The mice were sacrificed two weeks after the second immunizations and the lymph nodes and spleens of each group were collected and analyzed.

The presence of γ-IFN-secreting CTLs and T helper (Th) cells to antigens in splenocyte or lymph node cultures were evaluated using a commercially available ELISpot assay. (See Current Protocols in Immunology, Edited by: John E. Coligan, Ada M. Kruisbeek, David H. Margulies, Ethan M. Shevach, Warren Strober (2001 John Wiley & Sons, NY, N.Y.), herein expressly incorporated by reference in its entirety). The spleen and lymph nodes from each group were pooled and immediately tested for the presence of NS3 and birch specific T cells. The ability of NS3-specific and birch-specific Th and CTLs to produce γ-IFN recalled by a concanavalin-A (con-A) as a positive control, media alone as a negative control, native HBcAg, recombinant HBcAg (rHBcAg), various concentrations of NS3/4A CTL peptide, various concentrations of rNS3, and various concentrations of rBetv1 was analyzed via the ELISpot. The results of the ELISpot assay are shown in FIG. 22.

The NS3/4A-Betv1 (major Birch allergen) fusion genes showed that the NS3/4A clearly functions as an adjuvant for IFN-γ production. The NS3/4A-Betv1 fusion genes showed that the liberated NS3/4A-Betv1 fusion gene (SEQ ID NO: 1380) and fragmented NS3/4A-Betv1 fusion gene (SEQ ID NO: 1381) effective prime IFN-γ producing Betv1-specific T cells two weeks after the second injection, where the recombinant Betv1 antigen fails to do. The data suggests the fragmented NS3/4A birch antigen fusion gene (SEQ ID NO: 1381) more effectively primes IFN-γ producing T-cells than the non-fragmented NS3/4A birch antigen fusion gene (SEQ ID NO: 1380).

EXAMPLE 24

Groups of C57/BL6 mice were immunized twice with 50 µg of either plasmid containing a codon optimized NS3/4A gene, a NS3/4A-Betv1 fusion gene containing a protease cleavage site between NS3 and NS4A as well as a protease cleavage site between the NS4A and the birch antigen (SEQ ID NO: 1380), or a NS3/4A-Betv1 fusion gene containing a protease cleavage site between NS3 and NS4A, a protease cleavage site between the NS4A and the birch antigen as well as two additional protease cleavage sites within the birch antigen (SEQ ID NO: 1381) using an electroporation device. Another group of mice were immunized twice with recombinant Betv1 protein (rBetv1) in Freunds incomplete adjuvant. The two immunizations were 4 weeks apart. The mice were bled two weeks after the second immunizations.

Dilutions of the sera were tested on ELISA plates coated with recombinant birch protein. A secondary antibody specific for IgE antibodies was used to detect bound antibody. The results are shown in FIG. 23. The results show that when looking at the priming of IgE to Betv1, the DNA constructs do not prime IgE antibodies whereas the rBetv1 shows birch-specific IgE antibodies. The DNA constructs are thus not allergenic in that they prime a Th1 type response.

EXAMPLE 25

Groups of C57/BL6 mice were immunized twice with 50 µg using an electroporation device with either plasmid containing:
  a plasmid encoding a codon optimized NS3/4A gene,
  a naked pVAX-1 plasmid
  a plasmid containing a gene encoding HBcAg
  a plasmid containing an NS3/4A-HBcAg fusion gene as follows:
    C1 (SEQ ID NO: 1382) having an active protease but no protease cleavage site anywhere on the fusion gene
    C2 (SEQ ID NO: 1383) having an inactive protease and no protease cleavage site anywhere on the fusion gene
    C3 (SEQ ID NO: 1384) having an active protease and a protease cleavage site between NS3 and NS4A but no protease cleavage site anywhere else on the fusion gene
    C4 (SEQ ID NO: 1385) having an active protease and a protease cleavage site between NS3 and NS4A and a protease cleavage site between NS4A and HBcAg
    C5 (SEQ ID NO: 1386) having an active protease and a protease cleavage site between NS3 and NS4A a protease cleavage site between NS4A and HBcAg and 3 protease cleavage sites within the HBcAg which is in a naturally occurring order
    C5 (SEQ ID NO: 1386) having an active protease and a protease cleavage site between NS3 and NS4A a protease cleavage site between NS4A and HBcAg and 3 protease cleavage sites within the HBcAg which is in a naturally occurring order
    C6 (SEQ ID NO: 1387) having an active protease and a protease cleavage site between NS3 and NS4A a protease cleavage site between NS4A and HBcAg and 3 protease cleavage sites within the HBcAg which is in a non-naturally occurring order The two immunizations were 4 weeks apart. The mice were sacrificed two weeks after the second immunizations and the lymph nodes and spleen from each mouse was collected.

The presence of CTLs specific for antigen was then assayed using a standard $^{51}$Cr-release assay. Briefly, the collected cells were harvested from immunized animals 14 days after the booster immunization. Chromium release assays were performed as described in Lazdina, et al. (2003) *J. Gen. Virol.* 84: 1-8, herein expressly incorporated by reference in its entirety. Single cell suspensions are prepared. $25 \times 10^6$ splenocytes were restimulated with $25 \times 10^6$ syngenic irradiated (20 Gy) splenocytes pulsed with 0.05 µM peptide, as previously described. Sandberg et al. (2000) *J. Immunol.* 165:25-33, herein expressly incorporated by reference in its entirety. Restimulation cultures were set in 12 ml complete RPMI medium (Gibco). After 5 days, effector cells were harvested and washed twice. RMA-S target cells (Karre et al. (1986) *Nature* 319:675-678) were pulsed with 50 µM peptide for 90 min at 5% $CO_2$ and 37° C. Serial dilutions of effector cells were incubated with $5 \times 10^3$ chromium-labeled peptide pulsed RMA-S target cells in a final volume of 200 µl per well in 96-well plates. After a 4 hour incubation at 5% $CO_2$ and 37° C., 100 µl of supernatant was collected and the radioactivity was determined using a γ counter. The percentage of specific release was calculated according to the formula: (Experimental release−spontaneous release/total release−spontaneous release)×100. The results of the $^{51}$Cr-release assay is presented in FIG. 24. NS3/4A clearly functions as an effective adjuvant for lytic CTL priming. The peak CTL levels for the non-fragmented HBcAg were higher compared to all other constructs.

SEQUENCE LISTING (1387 sequences)

SEQ ID NO: 1 - DNA, 2061 bp, Artificial Sequence
  Hepatitis C virus NS3/4A coding region
atggcgcctatcacggcctatgcccagcagacaaggggccttttgggatgcataatcaccagcttgaccggccgggacaaaaaccaggtggagggtgaggttcagatcgtgtcaactgctgcccagactttcttggcaacctgcattaacggggtgtgttggactgtctaccatggagccggaacaaggaccattgcgtcacctaagggtcctgttatccagatgtacaccaatgtggaccaagacctcgtaggctggcccgctccccaaggtgcccgctcattaacaccatgcacttgcggctcctcggacctttacctggtcacgaggcacgccgatgtcattcctgtgcgccgacggggtgatggcaggggcagcctgctttcgccccggcctatctcttacttgaaaggctcctcgggaggccctctgctgtgccccgcaggacatgccgtaggcatattcagagccgcggtatgcacccgtggagtggctaaggcggtggacttcatccccgtagagagcttagagacaaccatgaggtccccggtgttctcagacaactcctccccaccagcagtgccccagagctaccaagtggcccacctgcatgctcccaccggcagcggtaagagcaccaaggtcccggccgcatacgcagctcagggctacaaggtgctggtgctcaacccctccgttgctgcaacaatgggctttggtgcttacatgtccaaggcccatgggattgatcctaacatcaggactggggtgaggacaattactactggcagcccgatcacgtattccacctacggcaagttccttgccgacggcgggtgttcagggggtgcttatgacataataatttgtgacgagtgccactccacggatgcaacatccatcttgggcattggcactgtccttgaccaagcagagaccgcgggggcgagactgactgtgctcgccaccgctacccctccgggctccgtcactgtgccccatcctaacatcgaggaggttgctctgtccactaccggagagatccccttttatggcaaggctattccccttgaagcaattaagggggggagacatctcatcttctgccactcaaagaagaagtgcgacgagctcgccgcaaaactggtcgcgttgggcgtcaatgccgtggcttactaccgcggccttgatgtgtccgtcatcccgaccagtggtgacgttgtcgtcgtggcaactgacgccctcatgaccggctttaccggcgacttcgattcggtgatagactgcaacacgtgtgtcacccagacagtcgacttcagccttgaccctaccttcaccattgagacaatcacgcttccccaggatgctgtctcccgtactcaacgtcggggtaggactggcagagggaagccaggcatctacagatttgtggcaccgggggagcgtccttctggcatgtttgactcgtctgtcctctgcgagtgctatgacgcgggttgtgcttggtatgagcttacgcccgccgagaccacagttaggctacgagcatacatgaacaccccgggacttcccgtgtgccaagaccatcttgaattttgggagggcgtctttacgggtctcacccacatagacgcccacttcctatcccagacaaagcagagtggggaaaaccttccctatctggtagcgtaccaagccaccgtgtgcgctagagctcaagcccctcccccgtcgtgggaccagatgtggaagtgcttgatccgtctcaagcccaccctccatgggccaacacctctgctatatagactgggcgctgtccagaatgaagtcaccctgacgcacccagtcaccaagtatatcatgacatgtatgtcggctgacctggaggtcgtcacgagtacctgggtgctcgttggcggcgttctggctgctttggccgcgtattgcctatccacaggctgcgtggtcatagtaggtaggattgtcttgtccggaaagccggcaatcatacccgacagggaagtcctctaccgggagttcgatgaaatggaagagtgctga

SEQ ID NO: 2 - protein, 686 aa, Artificial Sequence
  Hepatitis C virus NS3/4A peptide
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 3 - protein, 686 aa, Artificial Sequence
  Mutant Hepatitis C virus NS3/4A
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTGTWVLVGGVLAALAAYCLSTGCVVIVGRIVLSGKPAIIPDREVLYREFDEMEEC

SEQ ID NO: 4 - protein, 686 aa, Artificial Sequence
  Mutant Hepatitis C virus NS3/4A
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVRGTWVLVGGVLAALAAYCLSTGCVVIVGRIVLSGKPAIIPDREVLYREFDEMEEC

SEQ ID NO: 5 - protein, 686 aa, Artificial Sequence
  Mutant Hepatitis C virus NS3/4A
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTPTWVLVGGVLAALAAYCLSTGCVVIVGRIVLSGKPAIIPDREVLYREFDEMEEC

SEQ ID NO: 6 - protein, 686 aa, Artificial Sequence
  Mutant Hepatitis C virus NS3/4A
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVRPTWVLVGGVLAALAAYCLSTGCVVIVGRIVLSGKPAIIPDREVLYREFDEMEEC

SEQ ID NO: 7 - protein, 686 aa, Artificial Sequence
  Mutant Hepatitis C virus NS3/4A
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVRPAWVLVGGVLAALAAYCLSTGCVVIVGRIVLSGKPAIIPDREVLYREFDEMEEC

SEQ ID NO: 8 - protein, 686 aa, Artificial Sequence
  Mutant Hepatitis C virus NS3/4A
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVCSTWVLVGGVLAALAAYCLSTGCVVIVGRIVLSGKPAIIPDREVLYREFDEMEEC

SEQ ID NO: 9 - protein, 686 aa, Artificial Sequence
  Mutant Hepatitis C virus NS3/4A
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVCCSTWVLVGGVLAALAAYCLSTGCVVIVGRIVLSGKPAIIPDREVLYREFDEMEEC

SEQ ID NO: 10 - protein, 686 aa, Artificial Sequence
  Mutant Hepatitis C virus NS3/4A
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVSSSTWVLVGGVLAALAAYCLSTGCVVIVGRIVLSGKPAIIPDREVLYREFDEMEEC

SEQ ID NO: 11 - protein, 686 aa, Artificial Sequence
  Mutant Hepatitis C virus NS3/4A
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADSSSSCSTWVLVGGVLAALAAYCLSTGCVVIVGRIVLSGKPAIIPDREVLYREFDEMEEC

SEQ ID NO: 12 - protein, 632 aa, Artificial Sequence
  Hepatitis C virus NS3 peptide
MAPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVT

SEQ ID NO: 13 - protein, 54 aa, Artificial Sequence
  Hepatitis C virus NS4A peptide
STWVLVGGVLAALAAYCLSTGCVVIVGRIVLSGKPAIIPDREVLYREFDEMEEC

SEQ ID NO: 14 - protein, 25 aa, Artificial Sequence
  Hepatitis C virus NS3/4A peptide
TKYMTCMSADLEVVTSTWVLVGGVL

SEQ ID NO: 15 - protein, 12 aa, Artificial Sequence
  Hepatitis C virus NS3/4A peptide
SADLEVVTSTWV

SEQ ID NO: 16 - protein, 25 aa, Artificial Sequence
  Mutant Hepatitis C virus NS3/4A peptide
TKYMTCMSADLEVVTGTWVLVGGVL

SEQ ID NO: 17 - protein, 25 aa, Artificial Sequence
  Mutant Hepatitis C virus NS3/4A peptide
TKYMTCMSADLEVVRGTWVLVGGVL

SEQ ID NO: 18 - protein, 25 aa, Artificial Sequence
  Mutant Hepatitis C virus NS3/4A peptide
TKYMTCMSADLEVVTPTWVLVGGVL

SEQ ID NO: 19 - protein, 25 aa, Artificial Sequence
  Mutant Hepatitis C virus NS3/4A peptide
TKYMTCMSADLEVVRPTWVLVGGVL

SEQ ID NO: 20 - protein, 25 aa, Artificial Sequence
  Mutant Hepatitis C virus NS3/4A peptide
TKYMTCMSADLEVVRPAWVLVGGVL

SEQ ID NO: 21 - protein, 25 aa, Artificial Sequence
  Mutant Hepatitis C virus NS3/4A peptide
TKYMTCMSADLEVVCSTWVLVGGVL

SEQ ID NO: 22 - protein, 25 aa, Artificial Sequence
  Mutant Hepatitis C virus NS3/4A peptide
TKYMTCMSADLEVCCSTWVLVGGVL

SEQ ID NO: 23 - protein, 25 aa, Artificial Sequence
  Mutant Hepatitis C virus NS3/4A peptide
TKYMTCMSADLEVSSSTWVLVGGVL

SEQ ID NO: 24 - protein, 25 aa, Artificial Sequence
  Mutant Hepatitis C virus NS3/4A peptide
TKYMTCMSADSSSSCSTWVLVGGVL

SEQ ID NO: 25 - protein, 25 aa, Artificial Sequence
  Mutant Hepatitis C virus NS3/4A peptide
TKYMTCMSADVVVVTSTWVLVGGVL

SEQ ID NO: 26 - protein, 18 aa, Artificial Sequence
  Mutant Hepatitis C virus NS5A/B peptide
SSEDVVCCSMWVLVGGVL

SEQ ID NO: 27 - protein, 16 aa, Artificial Sequence
  Hepatitis C virus NS5 peptide
ASEDVVCCSMSYTWTG

SEQ ID NO: 28 - DNA, 30 bp, Artificial Sequence
  cloning oligonucleotide
ccgtctagatcagcactcttccatttcatc

SEQ ID NO: 29 - DNA, 30 bp, Artificial Sequence
  cloning oligonucleotide
cctgaattcatggcgcctatcacggcctat

SEQ ID NO: 30 - DNA, 24 bp, Artificial Sequence
  cloning oligonucleotide
ccacgcggccgcgacgacctacag

SEQ ID NO: 31 - DNA, 33 bp, Artificial Sequence
  cloning oligonucleotide
ctggaggtcgtcacgcctacctgggtgctcgtt

SEQ ID NO: 32 - DNA, 33 bp, Artificial Sequence
  cloning oligonucleotide
accgagcacccaggtaggcgtgacgacctccag

SEQ ID NO: 33 - DNA, 33 bp, Artificial Sequence
  cloning oligonucleotide
ctggaggtcgtccgcggtacctgggtgctcgtt

SEQ ID NO: 34 - DNA, 33 bp, Artificial Sequence
  cloning oligonucleotide
accgagcacccaggtaccgcggacgacctccag

SEQ ID NO: 35 - DNA, 2078 bp, Artificial Sequence
  Codon optimized hepatitis C virus NS3/4A coding region
  CDS (12)...(2072)
gaattcgcaccatggcccccatcaccgcctacgcccagcagacccgcggcctgctgggctgcatcatcaccagcctgaccggccgcgacaagaaccaggtggagggcgaggtgcagatcgtgagcaccgccgcccagaccttcctggccacctgcatcaacggcgtgtgctggaccgtgtaccacggcgccggcacccgcaccatcgccagccccaagggccccgtgatccagatgtacaccaacgtggaccaggacctggtgggctggcccgccccccagggcgcccgcagcctgaccccctgcacctgcggcagcagcgacctgtacctggtgacccgccacgccgacgtgatccccgtgcgccgccgcggcgacggccgcggcagcctgctgagcccccgccccatcagctacctgaagggcagcagcggcggccccctgctgtgccccgccggccacgccgtgggcatcttccgcgccgccgtgtgcacccgcggcgtggccaaggccgtggacttcatccccgtggagagcctggagaccaccatgcgcagccccgtgttcagcgacaacagcagcccccccgccgtgccccagagctaccaggtggcccacctgcacgcccccaccggcagcggcaagagcaccaaggtgcccgccgcctacgccgcccagggctacaaggtgctggtgctgaaccccagcgtggccgccaccatgggcttcggcgcctacatgagcaaggcccacggcatcgaccccaacatccgcaccggcgtgcgcaccatcaccaccggcagccccatcacctacagcacctacggcaagttcctggccgacggcggctgcagcggcggcgcctacgacatcatcatctgcgacgagtgccacagcaccgacgccaccagcatcctgggcatcggcaccgtgctggaccaggccgagaccgccggcgcccgcctgaccgtgctggccaccgccaccccccccggcagcgtgaccgtgccccaccccaacatcgaggaggtggccctgagcaccaccggcgagatccccttctacggcaaggccatccccctggaggccatcaagggcggccgccacctgatcttctgccacagcaagaagaagtgcgacgagctggccgccaagctggtggccctgggcgtgaacgccgtggcctactaccgcggcctggacgtgagcgtgatccccaccagcggcgacgtggtggtggtggccaccgacgccctgatgaccggcttcaccggcgacttcgacagcgtgatcgactgcaacacctgcgtgacccagaccgtggacttcagcctggaccccaccttcaccatcgagaccatcaccctgccccaggacgccgtgagccgcacccagcgccgcggccgcaccggccgcggcaagcccggcatctaccgcttcgtggcccccggcgagcgccccagcggcatgttcgacagcagcgtgctgtgcgagtgctacgacgccggctgcgcctggtacgagctgacccccgccgagaccaccgtgcgcctgcgcgcctacatgaacacccccggcctgcccgtgtgccaggaccacctggagttctgggagggcgtgttcaccggcctgacccacatcgacgcccacttcctgagccagaccaagcagagcggcgagaacctgccctacctggtggcctaccaggccaccgtgtgcgcccgcgcccaggcccccccccccagctgggaccagatgtggaagtgcctgatccgcctgaagcccaccctgcacggccccacccccctgctgtaccgcctgggcgccgtgcagaacgaggtgaccctgacccaccccgtgaccaagtacatcatgacctgcatgagcgccgacctggaggtggtgaccagcacctgggtgctggtgggcggcgtgctggccgccctggccgcctactgcctgagcaccggctgcgtggtgatcgtgggccgcatcgtgctgagcggcaagcccgccatcatccccgaccgcgaggtgctgtaccgcgagttcgacgagatggaggagtgctgatctaga

SEQ ID NO: 36 - protein, 686 aa, Artificial Sequence; identical to SEQ ID NO: 2
  Codon optimized hepatitis c virus NS3/4A coding region

SEQ ID NO: 37 - protein, 9 aa, Artificial Sequence
  Artificial Peptide, NS3/4A H-2D Binding Peptide
GAVQNEVTL

SEQ ID NO: 38 - protein, 9 aa, Artificial Sequence
  Artificial Peptide, H-2D Control Peptide
KAVYNFATM

SEQ ID NO: 39 - protein, 181 aa, Artificial Sequence
  Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRS

SEQ ID NO: 40 - protein, 685 aa, Artificial Sequence
  Mutant Hepatitis C virus NS3/4A peptide
GPITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 41 - protein, 685 aa, Artificial Sequence
  Mutant Hepatitis C virus NS3/4A peptide
AAITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 42 - protein, 685 aa, Artificial Sequence
  Mutant Hepatitis C virus NS3/4A peptide
APATAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 43 - protein, 685 aa, Artificial Sequence
  Mutant Hepatitis C virus NS3/4A peptide
APIAAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 44 - protein, 685 aa, Artificial Sequence
  Mutant Hepatitis C virus NS3/4A peptide
APITGYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 45 - protein, 685 aa, Artificial Sequence
  Mutant Hepatitis C virus NS3/4A peptide
APITAAAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 46 - protein, 685 aa, Artificial Sequence
  Mutant Hepatitis C virus NS3/4A peptide
APITAYGQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 47 - protein, 685 aa, Artificial Sequence
  Mutant Hepatitis C virus NS3/4A peptide
APITAYAAQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 48 - protein, 685 aa, Artificial Sequence
  Mutant Hepatitis C virus NS3/4A peptide
APITAYAQATRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 49 - protein, 685 aa, Artificial Sequence
  Mutant Hepatitis C virus NS3/4A peptide
APITAYAQQARGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 50 - protein, 685 aa, Artificial Sequence
  Mutant Hepatitis C virus NS3/4A peptide
APITAYAQQTAGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 51 - protein, 685 aa, Artificial Sequence
  Mutant Hepatitis C virus NS3/4A peptide
APITAYAQQTRALLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 52 - protein, 685 aa, Artificial Sequence
  Mutant Hepatitis C virus NS3/4A peptide
APITAYAQQTRGALGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 53 - protein, 685 aa, Artificial Sequence
  Mutant Hepatitis C virus NS3/4A peptide
APITAYAQQTRGLAGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 54 - protein, 685 aa, Artificial Sequence
  Mutant Hepatitis C virus NS3/4A peptide
APITAYAQQTRGLLACIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 55 - protein, 685 aa, Artificial Sequence
  Mutant Hepatitis C virus NS3/4A peptide
APITAYAQQTRGLLGAIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 56 - protein, 685 aa, Artificial Sequence
  Mutant Hepatitis C virus NS3/4A peptide
APITAYAQQTRGLLGCAITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 57 - protein, 685 aa, Artificial Sequence
  Mutant Hepatitis C virus NS3/4A peptide
APITAYAQQTRGLLGCIATSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 58 - protein, 685 aa, Artificial Sequence
  Mutant Hepatitis C virus NS3/4A peptide
APITAYAQQTRGLLGCIIASLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 59 - protein, 685 aa, Artificial Sequence
  Mutant Hepatitis C virus NS3/4A peptide
APITAYAQQTRGLLGCIITALTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 60 - protein, 685 aa, Artificial Sequence
  Mutant Hepatitis C virus NS3/4A peptide
APITAYAQQTRGLLGCIITSATGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 61 - protein, 685 aa, Artificial Sequence
  Mutant Hepatitis C virus NS3/4A peptide
APITAYAQQTRGLLGCIITSLAGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 62 - protein, 685 aa, Artificial Sequence
  Mutant Hepatitis C virus NS3/4A peptide
APITAYAQQTRGLLGCIITSLTARDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 63 - protein, 685 aa, Artificial Sequence
  Mutant Hepatitis C virus NS3/4A peptide
APITAYAQQTRGLLGCIITSLTGADKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 64 - protein, 685 aa, Artificial Sequence
  Mutant Hepatitis C virus NS3/4A peptide
APITAYAQQTRGLLGCIITSLTGRAKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 65 - protein, 685 aa, Artificial Sequence
  Mutant Hepatitis C virus NS3/4A peptide
APITAYAQQTRGLLGCIITSLTGRDANQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 66 - protein, 685 aa, Artificial Sequence
  Mutant Hepatitis C virus NS3/4A peptide
APITAYAQQTRGLLGCIITSLTGRDKAQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 67 - protein, 685 aa, Artificial Sequence
  Mutant Hepatitis C virus NS3/4A peptide
APITAYAQQTRGLLGCIITSLTGRDKNAVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 68 - protein, 685 aa, Artificial Sequence
  Mutant Hepatitis C virus NS3/4A peptide
APITAYAQQTRGLLGCIITSLTGRDKNQAEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 69 - protein, 685 aa, Artificial Sequence
  Mutant Hepatitis C virus NS3/4A peptide
APITAYAQQTRGLLGCIITSLTGRDKNQVAGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 70 - protein, 685 aa, Artificial Sequence
  Mutant Hepatitis C virus NS3/4A peptide
APITAYAQQTRGLLGCIITSLTGRDKNQVEAEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 71 - protein, 685 aa, Artificial Sequence
  Mutant Hepatitis C virus NS3/4A peptide
APITAYAQQTRGLLGCIITSLTGRDKNQVEGAVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 72 - protein, 685 aa, Artificial Sequence
  Mutant Hepatitis C virus NS3/4A peptide
APITAYAQQTRGLLGCIITSLTGRDKNQVEGEAQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 73 - protein, 685 aa, Artificial Sequence
  Mutant Hepatitis C virus NS3/4A peptide
APITAYAQQTRGLLGCIITSLTGRDKNQVEGEVAIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 74 - protein, 685 aa, Artificial Sequence
  Mutant Hepatitis C virus NS3/4A peptide
APITAYAQQTRGLLGCIITSLTGRDKNQVEGEVQAVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 75 - protein, 685 aa, Artificial Sequence
  Mutant Hepatitis C virus NS3/4A peptide
APITAYAQQTRGLLGCIITSLTGRDKNQVEGEVQIASTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 76 - protein, 685 aa, Artificial Sequence
  Mutant Hepatitis C virus NS3/4A peptide
APITAYAQQTRGLLGCIITSLTGRDKNQVEGEVQIVATAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 77 - protein, 685 aa, Artificial Sequence
  Mutant Hepatitis C virus NS3/4A peptide
APITAYAQQTRGLLGCIITSLTGRDKNQVEGEVQIVSAAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 78 - protein, 685 aa, Artificial Sequence
  Mutant Hepatitis C virus NS3/4A peptide
APITAYAQQTRGLLGCIITSLTGRDKNQVEGEVQIVSTGAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 79 - protein, 685 aa, Artificial Sequence
  Mutant Hepatitis C virus NS3/4A peptide
APITAYAQQTRGLLGCIITSLTGRDKNQVEGEVQIVSTAGQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 80 - protein, 685 aa, Artificial Sequence
  Mutant Hepatitis C virus NS3/4A peptide
APITAYAQQTRGLLGCIITSLTGRDKNQVEGEVQIVSTAAATFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 81 - protein, 685 aa, Artificial Sequence
  Mutant Hepatitis C virus NS3/4A peptide
APITAYAQQTRGLLGCIITSLTGRDKNQVEGEVQIVSTAAQAFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 82 - protein, 685 aa, Artificial Sequence
  Mutant Hepatitis C virus NS3/4A peptide
APITAYAQQTRGLLGCIITSLTGRDKNQVEGEVQIVSTAAQTALATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 83 - protein, 685 aa, Artificial Sequence
  Mutant Hepatitis C virus NS3/4A peptide
APITAYAQQTRGLLGCIITSLTGRDKNQVEGEVQIVSTAAQTFAATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 84 - protein, 685 aa, Artificial Sequence
  Mutant Hepatitis C virus NS3/4A peptide
APITAYAQQTRGLLGCIITSLTGRDKNQVEGEVQIVSTAAQTFLGTCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 85 - protein, 685 aa, Artificial Sequence
  Mutant Hepatitis C virus NS3/4A peptide
APITAYAQQTRGLLGCIITSLTGRDKNQVEGEVQIVSTAAQTFLAACINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 86 - protein, 685 aa, Artificial Sequence
  Mutant Hepatitis C virus NS3/4A peptide
APITAYAQQTRGLLGCIITSLTGRDKNQVEGEVQIVSTAAQTFLATAINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 87 - protein, 685 aa, Artificial Sequence
  Mutant Hepatitis C virus NS3/4A peptide
APITAYAQQTRGLLGCIITSLTGRDKNQVEGEVQIVSTAAQTFLATCANGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 88 - protein, 685 aa, Artificial Sequence
  Mutant Hepatitis C virus NS3/4A peptide
APITAYAQQTRGLLGCIITSLTGRDKNQVEGEVQIVSTAAQTFLATCIAGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 89 - protein, 685 aa, Artificial Sequence
  Mutant Hepatitis C virus NS3/4A peptide
APITAYAQQTRGLLGCIITSLTGRDKNQVEGEVQIVSTAAQTFLATCINAVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 90 - protein, 685 aa, Artificial Sequence
  Mutant Hepatitis C virus NS3/4A peptide
APITAYAQQTRGLLGCIITSLTGRDKNQVEGEVQIVSTAAQTFLATCINGACWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 91 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVAWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 92 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCATVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 93 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWAVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 94 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTAYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 95 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVAHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 96 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYAGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 97 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHAAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 98 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGGGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 99 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAATRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 100 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGARTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 101 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTATIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 102 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRAIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 103 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTAASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 104 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIGSPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 105 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIAAPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 106 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASAKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 107 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPAGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 108 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKAPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 109 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGAVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 110 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPAIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 111 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVAQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 112 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIAMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 113 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQAYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 114 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMATNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 115 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYANVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 116 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTAVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 117 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNADQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 118 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVAQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 119 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDADLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 120 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQALVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 121 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDAVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 122 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLAGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 123 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVAWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 124 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGAPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 125 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWAAPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 126 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPGPQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 127 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAAQGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 128 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPAGARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 129 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQAARSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 130 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGGRSLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 131 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGAASLTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 132 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARALTPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 133 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSATPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 134 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLAPCTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 135 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTACTCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 136 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPATCGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 137 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCACGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 138 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTAGSSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 139 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCASSDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 140 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGASDLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 141 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSADLYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 142 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSALYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 143 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDAYLVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 144 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLALVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 145 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYAVTRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 146 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLATRHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 147 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVARHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 148 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTAHADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 149 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRAADVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 150 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHGDVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 151 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHAAVIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 152 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADAIPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 153 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVAPVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 154 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIAVRRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 155 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPARRRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 156 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVARRGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 157 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRARGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 158 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRAGDGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 159 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRADGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 160 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGAGRGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 161 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDARGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 162 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGAGSLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 163 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRASLLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 164 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGALLSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 165 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSALSPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 166 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLASPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 167 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLAPRPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 168 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSARPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 169 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPAPISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 170 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRAISYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 171 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPASYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 172 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPIAYLKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 173 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISALKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 174 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYAKGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 175 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLAGSSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 176 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKASSGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 177 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGASGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 178 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSAGGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 179 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSAGPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 180 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGAPLLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 181 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGALLCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 182 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPALCPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 183 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLACPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 184 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLAPAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 185 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCAAGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 186 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPGGHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 187 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAAHAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 188 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGAAVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 189 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHGVGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 190 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAAGIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 191 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVAIFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 192 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGAFRAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 193 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIARAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 194 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFAAAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 195 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRGAVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 196 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAGVCTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 197 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAACTRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 198 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVATRGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 199 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCARGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 200 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTAGVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 201 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRAVAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 202 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGAAKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 203 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVGKAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 204 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAAAVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 205 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKGVDFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 206 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAADFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 207 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVAFIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 208 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDAIPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 209 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFAPVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 210 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIAVESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 211 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPAESLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 212 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVASLETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 213 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVEALETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 214 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESAETTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 215 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLATTMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 216 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLEATMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 217 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETAMRSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 218 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTARSPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 219 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMASPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 220 - protein, 685 aa, Artificial Sequence
  Mutant Hepatitis C virus NS3/4A peptide
APITAYAQQTRGLLGCIITSLTGRDKNQVEGEVQIVSTAAQTFLATCINGVCWTVYHGAGTRTIASPKGPVIQMYTNVDQDLVGWPAPQGARSLTPCTCGSSDLYLVTRHADVIPVRRRGDGRGSLLSPRPISYLKGSSGGPLLCPAGHAVGIFRAAVCTRGVAKAVDFIPVESLETTMRAPVFSDNSSPPAVPQSYQVAHLHAPTGSGKSTKVPAAYAAQGYKVLVLNPSVAATMGFGAYMSKAHGIDPNIRTGVRTITTGSPITYSTYGKFLADGGCSGGAYDIIICDECHSTDATSILGIGTVLDQAETAGARLTVLATATPPGSVTVPHPNIEEVALSTTGEIPFYGKAIPLEAIKGGRHLIFCHSKKKCDELAAKLVALGVNAVAYYRGLDVSVIPTSGDVVVVATDALMTGFTGDFDSVIDCNTCVTQTVDFSLDPTFTIETITLPQDAVSRTQRRGRTGRGKPGIYRFVAPGERPSGMFDSSVLCECYDAGCAWYELTPAETTVRLRAYMNTPGLPVCQDHLEFWEGVFTGLTHIDAHFLSQTKQSGENLPYLVAYQATVCARAQAPPPSWDQMWKCLIRLKPTLHGPTPLLYRLGAVQNEVTLTHPVTKYIMTCMSADLEVVTSTWVLVGGVLAALAAYCLSTGCVVIVGRIVLSGKPAIIPDREVLYREFDEMEEC

SEQ ID NO: 221 - protein, 21 aa, Escherichia coli
FDFGLRPSTAYTKSKAKDVVE

SEQ ID NO: 222 - protein, 9 aa, Epstein-Barr Virus
YLLEMLWRL

SEQ ID NO: 223 - protein, 9 aa, Epstein-Barr Virus
YFLEILWGL

SEQ ID NO: 224 - protein, 9 aa, Epstein-Barr Virus
YLLEILWRL

SEQ ID NO: 225 - protein, 9 aa, Epstein-Barr Virus
YLQQNWWTL

SEQ ID NO: 226 - protein, 9 aa, Epstein-Barr Virus
LLLALLFWL

SEQ ID NO: 227 - protein, 9 aa, Epstein-Barr Virus
LLVDLLWLL

SEQ ID NO: 228 - protein, 9 aa, Epstein-Barr Virus
LLLIALWNL

SEQ ID NO: 229 - protein, 9 aa, Epstein-Barr Virus
WLLLFLAIL

SEQ ID NO: 230 - protein, 9 aa, Epstein-Barr Virus
TLLVDLLWL

SEQ ID NO: 231 - protein, 9 aa, Epstein-Barr Virus
LLWLLLFLA

SEQ ID NO: 232 - protein, 9 aa, Epstein-Barr Virus
ILLIIALYL

SEQ ID NO: 233 - protein, 9 aa, Epstein-Barr Virus
VLFIFGCLL

SEQ ID NO: 234 - protein, 9 aa, Epstein-Barr Virus
RLGATIWQL

SEQ ID NO: 235 - protein, 9 aa, Epstein-Barr Virus
ILYFIAFAL

SEQ ID NO: 236 - protein, 9 aa, Epstein-Barr Virus
SLVIVTTFV

SEQ ID NO: 237 - protein, 9 aa, Epstein-Barr Virus
LMIIPLINV

SEQ ID NO: 238 - protein, 9 aa, Epstein-Barr Virus
TLFIGSHVV

SEQ ID NO: 239 - protein, 9 aa, Epstein-Barr Virus
LIPETVPYI

SEQ ID NO: 240 - protein, 9 aa, Epstein-Barr Virus
QLTPHTKAV

SEQ ID NO: 241 - protein, 10 aa, Epstein-Barr Virus
QNGALAINTF

SEQ ID NO: 242 - protein, 10 aa, Epstein-Barr Virus
LLDFVRFMGV

SEQ ID NO: 243 - protein, 9 aa, Epstein-Barr Virus
QAKWRLQTL

SEQ ID NO: 244 - protein, 8 aa, Epstein-Barr Virus
RYSIFFDY

SEQ ID NO: 245 - protein, 9 aa, Epstein-Barr Virus
HLAAQGMAY

SEQ ID NO: 246 - protein, 9 aa, Epstein-Barr Virus
YPLHEQHGM

SEQ ID NO: 247 - protein, 9 aa, Epstein-Barr Virus
SVRDRLARL

SEQ ID NO: 248 - protein, 9 aa, Epstein-Barr Virus
AVLLHEESM

SEQ ID NO: 249 - protein, 9 aa, Epstein-Barr Virus
VSFIEFVGW

SEQ ID NO: 250 - protein, 9 aa, Epstein-Barr Virus
FRKAQIQGL

SEQ ID NO: 251 - protein, 9 aa, Epstein-Barr Virus
PYLFWLAAI

SEQ ID NO: 252 - protein, 11 aa, Epstein-Barr Virus
TVFYNIPPMPL

SEQ ID NO: 253 - protein, 16 aa, Epstein-Barr Virus
PGDQLPGFSDGRACPV

SEQ ID NO: 254 - protein, 10 aa, Epstein-Barr Virus
VEITPYKPTW

SEQ ID NO: 255 - protein, 9 aa, Epstein-Barr Virus
TYSAGIVQI

SEQ ID NO: 256 - protein, 9 aa, Hepatitis B Virus
AQIFNKPYW

SEQ ID NO: 257 - protein, 9 aa, Hepatitis B Virus
AGVDNRECI

SEQ ID NO: 258 - protein, 9 aa, Homo sapiens
EADPTGHSY

SEQ ID NO: 259 - protein, 9 aa, Homo sapiens
KMVELVHFL

SEQ ID NO: 260 - protein, 10 aa, Homo sapiens
KMVELVHFLL

SEQ ID NO: 261 - protein, 10 aa, Homo sapiens
LVFGIELMEV

SEQ ID NO: 262 - protein, 9 aa, Homo sapiens
KVLEYVIKV

SEQ ID NO: 263 - protein, 10 aa, Homo sapiens
KVADLVGFLL

SEQ ID NO: 264 - protein, 9 aa, Homo sapiens
KVAEFVHFL

SEQ ID NO: 265 - protein, 9 aa, Homo sapiens
CILESLFRA

SEQ ID NO: 266 - protein, 9 aa, Homo sapiens
FLWGPRALA

SEQ ID NO: 267 - protein, 10 aa, Homo sapiens
VMIAMEGGHA

SEQ ID NO: 268 - protein, 9 aa, Homo sapiens
LVLGTLEEV

SEQ ID NO: 269 - protein, 9 aa, Homo sapiens
ALREEEEGV

SEQ ID NO: 270 - protein, 10 aa, Homo sapiens
ALAETSYVKV

SEQ ID NO: 271 - protein, 9 aa, Homo sapiens
YVIKVSARV

SEQ ID NO: 272 - protein, 9 aa, Homo sapiens
RALAETSYV

SEQ ID NO: 273 - protein, 9 aa, Human Immunodeficiency Virus (HIV)
AVDLSHFLK

SEQ ID NO: 274 - protein, 9 aa, Epstein-Barr Virus
IVTDFSVIK

SEQ ID NO: 275 - protein, 10 aa, Hepatitis B Virus
FLPSDFFPSV

SEQ ID NO: 276 - protein, 9 aa, Human Immunodeficiency Virus (HIV)
ILKEPVHGV

SEQ ID NO: 277 - protein, 8 aa, Human T Cell Leukemia Virus
LFGYPVYV

SEQ ID NO: 278 - protein, 9 aa, Influenza A Virus
GILGFVFTL

SEQ ID NO: 279 - protein, 10 aa, Human Cytomegalovirus (HCMV)
IAGNSAYEYV

SEQ ID NO: 280 - protein, 22 aa, Plasmodium falciparum
GIEYLNKIQNSLSTEWSPCSVT

SEQ ID NO: 281 - protein, 19 aa, Plasmodium vivax
YLDKVRATVGTEWTPCSVT

SEQ ID NO: 282 - protein, 20 aa, Plasmodium yoelli
EFVKQISSQLTEEWSQCSVT

SEQ ID NO: 283 - protein, 9 aa, Homo sapiens
LLGRNSFEV

SEQ ID NO: 284 - protein, 9 aa, Hepatitis B Virus
WLSLLVPFV

SEQ ID NO: 285 - protein, 17 aa, Homo sapiens
RFRELVSEFSRMARDPQ

SEQ ID NO: 286 - protein, 10 aa, Human Immunodeficiency Virus (HIV)
QVPLRPMTYK

SEQ ID NO: 287 - protein, 11 aa, Human Immunodeficiency Virus (HIV)
RLRDLLLIVTR

SEQ ID NO: 288 - protein, 11 aa, Hepatitis C Virus
STLPETTTVRR

SEQ ID NO: 289 - protein, 9 aa, Influenza A Virus
SRYWAIRTR

SEQ ID NO: 290 - protein, 10 aa, Human Immunodeficiency Virus (HIV)
KRWIILGLNK

SEQ ID NO: 291 - protein, 8 aa, Plasmodium falciparum
KPKDELDY

SEQ ID NO: 292 - protein, 8 aa, Plasmodium falciparum
KSKDLEDY

SEQ ID NO: 293 - protein, 8 aa, Plasmodium falciparum
KPNDKSLY

SEQ ID NO: 294 - protein, 9 aa, Human Immunodeficiency Virus (HIV)
TPYDINQML

SEQ ID NO: 295 - protein, 9 aa, Plasmodium falciparum
KPIVQYDNF

SEQ ID NO: 296 - protein, 9 aa, Homo sapiens
YPAEITLTW

SEQ ID NO: 297 - protein, 8 aa, Human Immunodeficiency Virus (HIV)
YLKDQQLL

SEQ ID NO: 298 - protein, 9 aa, Influenza A Virus
ELRSRYWAI

SEQ ID NO: 299 - protein, 9 aa, Epstein-Barr Virus
FLRGRAYGI

SEQ ID NO: 300 - protein, 9 aa, Human Immunodeficiency Virus (HIV)
GEIYKRWII

SEQ ID NO: 301 - protein, 9 aa, Human Immunodeficiency Virus (HIV)
DCKTILKAL

SEQ ID NO: 302 - protein, 9 aa, Human Immunodeficiency Virus (HIV)
DPKVKQWPL

SEQ ID NO: 303 - protein, 9 aa, Human Immunodeficiency Virus (HIV)
YLKDQQLYL

SEQ ID NO: 304 - protein, 9 aa, Human Immunodeficiency Virus (HIV)
GGKKKYKLK

SEQ ID NO: 305 - protein, 9 aa, Hepatitis B Virus
LLAQFTSAI

SEQ ID NO: 306 - protein, 10 aa, Hepatitis B Virus
LLVPFVQWFV

SEQ ID NO: 307 - protein, 9 aa, Hepatitis B Virus
WLSLLVPFV

SEQ ID NO: 308 - protein, 9 aa, Hepatitis B Virus
FLLAQFTSA

SEQ ID NO: 309 - protein, 9 aa, Hepatitis B Virus
FLLSLGIHL

SEQ ID NO: 310 - protein, 9 aa, Hepatitis B Virus
ALMPLYACI

SEQ ID NO: 311 - protein, 10 aa, Hepatitis B Virus
ILLLCLIFLL

SEQ ID NO: 312 - protein, 9 aa, Hepatitis B Virus
KLHLYSHPI

SEQ ID NO: 313 - protein, 9 aa, Hepatitis B Virus
VLLDYQGML

SEQ ID NO: 314 - protein, 10 aa, Hepatitis B Virus
LLPIFFCLWV

SEQ ID NO: 315 - protein, 9 aa, Hepatitis B Virus
VLQAGFFLL

SEQ ID NO: 316 - protein, 10 aa, Hepatitis B Virus
YLHTLWKAGI

SEQ ID NO: 317 - protein, 10 aa, Hepatitis B Virus
YLHTLWKAGV

SEQ ID NO: 318 - protein, 9 aa, Hepatitis B Virus
PLLPIFFCL

SEQ ID NO: 319 - protein, 10 aa, Hepatitis B Virus
ILSTLPETTV

SEQ ID NO: 320 - protein, 10 aa, Hepatitis C Virus
LLFNILGGWV

SEQ ID NO: 321 - protein, 10 aa, Hepatitis C Virus
LLALLSCLTV

SEQ ID NO: 322 - protein, 9 aa, Hepatitis C Virus
YLVAYQATV

SEQ ID NO: 323 - protein, 9 aa, Hepatitis C Virus
FLLLADARV

SEQ ID NO: 324 - protein, 9 aa, Hepatitis C Virus
ILAGYGAGV

SEQ ID NO: 325 - protein, 9 aa, Hepatitis C Virus
DLMGYIPLV

SEQ ID NO: 326 - protein, 10 aa, Hepatitis C Virus
YLLPRRGPRL

SEQ ID NO: 327 - protein, 9 aa, Hepatitis C Virus
ALSTGLIHL

SEQ ID NO: 328 - protein, 10 aa, Hepatitis C Virus
LLALLSCLTI

SEQ ID NO: 329 - protein, 10 aa, Hepatitis C Virus
RLIVFPDLGV

SEQ ID NO: 330 - protein, 10 aa, Hepatitis C Virus
RLHGLSAFSL

SEQ ID NO: 331 - protein, 10 aa, Hepatitis C Virus
ILGGWVAAQL

SEQ ID NO: 332 - protein, 9 aa, Hepatitis C Virus
SMVGNWAKV

SEQ ID NO: 333 - protein, 9 aa, Hepatitis C Virus
YLVTRHADV

SEQ ID NO: 334 - protein, 10 aa, Hepatitis C Virus
VLAALAAYCL

SEQ ID NO: 335 - protein, 9 aa, Human Papilloma Virus (HPV)
LLMGTLGIV

SEQ ID NO: 336 - protein, 9 aa, Human Papilloma Virus (HPV)
YMLDLQPET

SEQ ID NO: 337 - protein, 9 aa, Human Papilloma Virus (HPV)
FAFRDLCIV

SEQ ID NO: 338 - protein, 9 aa, Human Papilloma Virus (HPV)
TLGIVCPIC

SEQ ID NO: 339 - protein, 9 aa, Human Papilloma Virus (HPV)
TLHEYMLDL

SEQ ID NO: 340 - protein, 9 aa, Human Papilloma Virus (HPV)
GTLGIVCPI

SEQ ID NO: 341 - protein, 9 aa, Human Papilloma Virus (HPV)
MLDLQPETT

SEQ ID NO: 342 - protein, 10 aa, Human Papilloma Virus (HPV)
TIHDIILECV

SEQ ID NO: 343 - protein, 9 aa, Human Immunodeficiency Virus (HIV)
VLAEAMSQV

SEQ ID NO: 344 - protein, 10 aa, Human Immunodeficiency Virus (HIV)
LLWKGEGAVV

SEQ ID NO: 345 - protein, 9 aa, Human Immunodeficiency Virus (HIV)
LLWKGEGAV

SEQ ID NO: 346 - protein, 9 aa, Human Immunodeficiency Virus (HIV)
ILKEPVHGV

SEQ ID NO: 347 - protein, 9 aa, Human Immunodeficiency Virus (HIV)
IVGAETFYV

SEQ ID NO: 348 - protein, 9 aa, Human Immunodeficiency Virus (HIV)
IIGAETFYV

SEQ ID NO: 349 - protein, 9 aa, Human Immunodeficiency Virus (HIV)
LWVTVYYGV

SEQ ID NO: 350 - protein, 9 aa, Human Immunodeficiency Virus (HIV)
LMVTVYYGV

SEQ ID NO: 351 - protein, 17 aa, Hepatitis B Virus
ATVELLSFLPSDFFPSV

SEQ ID NO: 352 - protein, 20 aa, Hepatitis B Virus
TNMGLKFRQLLWFHISCLTF

SEQ ID NO: 353 - protein, 20 aa, Hepatitis B Virus
ASARFSWLSLLVPFVQWFVG

SEQ ID NO: 354 - protein, 20 aa, Hepatitis B Virus
LSPTVWLSVIWMMWYWGPSL

SEQ ID NO: 355 - protein, 20 aa, Hepatitis B Virus
NCTCIPIPSSWAFGKFLWEW

SEQ ID NO: 356 - protein, 20 aa, Hepatitis B Virus
ASARFSWLSLLVPFVQWFVG

SEQ ID NO: 357 - protein, 22 aa, Hepatitis B Virus
TNMGLKFRQLLWLSPTVWLSVI

SEQ ID NO: 358 - protein, 13 aa, Hepatitis B Virus
TPPAYRPPNAPIL

SEQ ID NO: 359 - protein, 10 aa, Hepatitis B Virus
WMMWYWGPSL

SEQ ID NO: 360 - protein, 16 aa, Mycobacterium leprae
LEDPYEKIGAELVKEV

SEQ ID NO: 361 - protein, 15 aa, Mycobacterium leprae
EQIAATAAISAGDQS

SEQ ID NO: 362 - protein, 15 aa, Mycobacterium leprae
AGDQSIGDLIAEAMD

SEQ ID NO: 363 - protein, 15 aa, Mycobacterium leprae
VEGAGDTDAIAGRVA

SEQ ID NO: 364 - protein, 15 aa, Mycobacterium leprae
AGGVAVIKAGAATEV

SEQ ID NO: 365 - protein, 15 aa, Mycobacterium leprae
GDEATGANIVKVALE

SEQ ID NO: 366 - protein, 15 aa, Mycobacterium leprae
LQNAASIAGLFLTTE

SEQ ID NO: 367 - protein, 15 aa, Mycobacterium leprae
AGGGVTLLQAAPALD

SEQ ID NO: 368 - protein, 13 aa, Mycobacterium leprae
RVAQIRTEIENSD

SEQ ID NO: 369 - protein, 13 aa, Mycobacterium leprae
LLQAAPALDKLKL

SEQ ID NO: 370 - protein, 13 aa, Mycobacterium leprae
PEKTAAPASDPTG

SEQ ID NO: 371 - protein, 16 aa, Mycobacterium tuberculosis
LEDPYEKIGAELVKEV

SEQ ID NO: 372 - protein, 15 aa, Mycobacterium tuberculosis
EQIAATAAISAGDQS

SEQ ID NO: 373 - protein, 15 aa, Mycobacterium tuberculosis
AGDQSIGDLIAEAMD

SEQ ID NO: 374 - protein, 15 aa, Mycobacterium tuberculosis
VEGAGDTDAIAGRVA

SEQ ID NO: 375 - protein, 15 aa, Mycobacterium tuberculosis
AGGVAVIKAGAATEV

SEQ ID NO: 376 - protein, 15 aa, Mycobacterium tuberculosis
GDEATGANTVKVALE

SEQ ID NO: 377 - protein, 15 aa, Mycobacterium tuberculosis
LQNAASIAGLFLTTE

SEQ ID NO: 378 - protein, 15 aa, Mycobacterium tuberculosis
AGGGVTLLQAAPALD

SEQ ID NO: 379 - protein, 14 aa, Mycobacterium tuberculosis
RVQAQIRTEIENSD

SEQ ID NO: 380 - protein, 13 aa, Mycobacterium tuberculosis
LLQAAPALDKLKL

SEQ ID NO: 381 - protein, 9 aa, Mycobacterium tuberculosis
LPAKFLEGF

SEQ ID NO: 382 - protein, 18 aa, Mycobacterium tuberculosis
YLQVPSPSMGRDIKVQFQ

SEQ ID NO: 383 - protein, 18 aa, Mycobacterium tuberculosis
GRDIKVQFQSGGNNSPAV

SEQ ID NO: 384 - protein, 18 aa, Mycobacterium tuberculosis
GCQTYKEWTLLTSELPQW

SEQ ID NO: 385 - protein, 9 aa, Mycobacterium tuberculosis
IPAEFLENF

SEQ ID NO: 386 - protein, 9 aa, Mycobacterium tuberculosis
WPTLIGLAM

SEQ ID NO: 387 - protein, 9 aa, Mycobacterium tuberculosis
IPAKFLEGL

SEQ ID NO: 388 - protein, 9 aa, Mycobacterium tuberculosis
MPVGGQSSF

SEQ ID NO: 389 - protein, 10 aa, Mycobacterium tuberculosis
MPVGGQSSFY

SEQ ID NO: 390 - protein, 18 aa, Mycobacterium tuberculosis
MSQIMYNYPAMMAHAGDM

SEQ ID NO: 391 - protein, 16 aa, Mycobacterium tuberculosis
ITYQGWQTQWNQALED

SEQ ID NO: 392 - protein, 11 aa, Mycobacterium tuberculosis
ATFAAPVALAA

SEQ ID NO: 393 - protein, 11 aa, Mycobacterium tuberculosis
SGATIPQGEQS

SEQ ID NO: 394 - protein, 25 aa, Mycobacterium tuberculosis
AVAASNNPELTTLTAALSGQLNPQV

SEQ ID NO: 395 - protein, 21 aa, Mycobacterium tuberculosis
ALSGQLNPQVNLVDTLNSGQY

SEQ ID NO: 396 - protein, 26 aa, Mycobacterium tuberculosis
FSKLPASTIDELKTNSSLLTSILTYH

SEQ ID NO: 397 - protein, 24 aa, Mycobacterium tuberculosis
GNADVVCGGVSTANATVYMIDSVL

SEQ ID NO: 398 - protein, 25 aa, Mycobacterium tuberculosis
AVAASNNPELTTLTAALSGQLNPQV

SEQ ID NO: 399 - protein, 21 aa, Mycobacterium tuberculosis
ALSGQLNPQVNLVDTLNSGQY

SEQ ID NO: 400 - protein, 26 aa, Mycobacterium tuberculosis
FSKLPASTIDELKTNSSLLTSILTYH

SEQ ID NO: 401 - protein, 24 aa, Mycobacterium tuberculosis
GNADVVCGGVSTANATVYMIDSVL

SEQ ID NO: 402 - protein, 15 aa, Mycobacterium tuberculosis
ATTVYMIDSVLMPPA

SEQ ID NO: 403 - protein, 20 aa, Mycobacterium tuberculosis
MTEQQWNFAGIEAAASAIQG

SEQ ID NO: 404 - protein, 13 aa, Mycobacterium tuberculosis
EQQWNFAGIEAAA

SEQ ID NO: 405 - protein, 9 aa, Mycobacterium tuberculosis
WNFAGIEAA

SEQ ID NO: 406 - protein, 20 aa, Mycobacterium tuberculosis
VQGVQQKWDATATELNNALQ

SEQ ID NO: 407 - protein, 24 aa, Mycobacterium tuberculosis
AWGGSGSEAYQGVQQKWDATATEL

SEQ ID NO: 408 - protein, 24 aa, Mycobacterium tuberculosis
QGVQQKWDATATELNNALQNLART

SEQ ID NO: 409 - protein, 24 aa, Mycobacterium tuberculosis
LARTISEAGQAMASTEGNVTGMFA

SEQ ID NO: 410 - protein, 13 aa, Mycobacterium tuberculosis
EQQWNFAGIEAAA

SEQ ID NO: 411 - protein, 20 aa, Streptococcus mutans
NNNDVNIDRTLVAKQSVVKF

SEQ ID NO: 412 - protein, 20 aa, Streptococcus mutans
QLKTADLPAGRDETTSFVLV

SEQ ID NO: 413 - protein, 20 aa, Streptococcus mutans
LATFNADLTKSVATIYPTVV

SEQ ID NO: 414 - protein, 8 aa, Chlamydia pneumoniae
GDYVFDRI

SEQ ID NO: 415 - protein, 9 aa, Chlamydia pneumoniae
SLLGNATAL

SEQ ID NO: 416 - protein, 9 aa, Chlamydia pneumoniae
QAVANGGAI

SEQ ID NO: 417 - protein, 9 aa, Chlamydia pneumoniae
RGAFCDKEF

SEQ ID NO: 418 - protein, 10 aa, Chlamydia pneumoniae
CYGRLYSVKV

SEQ ID NO: 419 - protein, 10 aa, Chlamydia pneumoniae
KYNEEARKKI

SEQ ID NO: 420 - protein, 9 aa, Chlamydia pneumoniae
GPKGRHVVI

SEQ ID NO: 421 - protein, 9 aa, Escherichia coli
TPHPARIGL

SEQ ID NO: 422 - protein, 15 aa, Salmonella typhimurium
LIQCMLKKTMLSINQ

SEQ ID NO: 423 - protein, 9 aa, Listeria monocytogenes
GYKDGNEYI

SEQ ID NO: 424 - protein, 20 aa, Borrelia burgdorferi
VVKEGTVTLSKNISKSGEVS

SEQ ID NO: 425 - protein, 9 aa, Lymphocytic Choriomeningitis Virus
FQPQNGQFI

SEQ ID NO: 426 - protein, 9 aa, Lymphocytic Choriomeningitis Virus
RPQASGVYM

SEQ ID NO: 427 - protein, 9 aa, Lymphocytic Choriomeningitis Virus
PYIACRTSI

SEQ ID NO: 428 - protein, 10 aa, Lymphocytic Choriomeningitis Virus
MYPIACRTSI

SEQ ID NO: 429 - protein, 10 aa, Lymphocytic Choriomeningitis Virus
WPYIACRTSI

SEQ ID NO: 430 - protein, 13 aa, Lassa Fever Virus
FGTMPSLTLACLT

SEQ ID NO: 431 - protein, 12 aa, Lassa Fever Virus
FGMPSLTIACMC

SEQ ID NO: 432 - protein, 13 aa, Lassa Fever Virus
QGQVDLNDAVQAL

SEQ ID NO: 433 - protein, 13 aa, Lassa Fever Virus
QGQADLNDVIQSL

SEQ ID NO: 434 - protein, 13 aa, Lassa Fever Virus
ALGMFISDTPGER

SEQ ID NO: 435 - protein, 13 aa, Lassa Fever Virus
SLGMFVSDTPGER

SEQ ID NO: 436 - protein, 13 aa, Lassa Fever Virus
QLDPNAKTWMDIE

SEQ ID NO: 437 - protein, 13 aa, Lassa Fever Virus
NLIPNAKTWMDIE

SEQ ID NO: 438 - protein, 13 aa, Lassa Fever Virus
VWDQFKDLCHMHT

SEQ ID NO: 439 - protein, 13 aa, Lassa Fever Virus
VWDQFKDLCHMHT

SEQ ID NO: 440 - protein, 13 aa, Lassa Fever Virus
IWDEYKHLCRMHT

SEQ ID NO: 441 - protein, 8 aa, Human Immunodeficiency Virus (HIV)
FPVTPQVP

SEQ ID NO: 442 - protein, 9 aa, Human Immunodeficiency Virus (HIV)
FPVTPRVPL

SEQ ID NO: 443 - protein, 9 aa, Human Immunodeficiency Virus (HIV)
TPQVPLRPM

SEQ ID NO: 444 - protein, 9 aa, Human Immunodeficiency Virus (HIV)
YPLTFGWCY

SEQ ID NO: 445 - protein, 9 aa, Human Immunodeficiency Virus (HIV)
PLTFGWCYK

SEQ ID NO: 446 - protein, 9 aa, Human Immunodeficiency Virus (HIV)
LTFGWCYKL

SEQ ID NO: 447 - protein, 9 aa, Human Immunodeficiency Virus (HIV)
EIYKRWIIL

SEQ ID NO: 448 - protein, 8 aa, Human Immunodeficiency Virus (HIV)
ILGLNKIV

SEQ ID NO: 449 - protein, 11 aa, Human Immunodeficiency Virus (HIV)
ILGLNKIVRMY

SEQ ID NO: 450 - protein, 18 aa, Hepatitis B Virus
QAGFFLLTRILTIPQSLD

SEQ ID NO: 451 - protein, 20 aa, Hepatitis B Virus
SCCCTKPTDGNCTCIPIPSS

SEQ ID NO: 452 - protein, 12 aa, Hepatitis B Virus
WEWASVRFSWLS

SEQ ID NO: 453 - protein, 14 aa, Hepatitis B Virus
LPLLPIFFCLWVYI

SEQ ID NO: 454 - protein, 9 aa, Human Papilloma Virus
RAHYNIVTF

SEQ ID NO: 455 - protein, 35 aa, Human Papilloma Virus
GQAEPDRAHYNIVTFCCKCDSTLRLCVQSTHVDIR

SEQ ID NO: 456 - protein, 9 aa, Epstein-Barr Virus
RRIYDLIEL

SEQ ID NO: 457 - protein, 9 aa, Epstein-Barr Virus
RKIYDLIEL

SEQ ID NO: 458 - protein, 9 aa, Epstein-Barr Virus
FRKAQIQGL

SEQ ID NO: 459 - protein, 8 aa, Epstein-Barr Virus
HRCQAIRK

SEQ ID NO: 460 - protein, 11 aa, Epstein-Barr Virus
RRARSLSAERY

SEQ ID NO: 461 - protein, 17 aa, Epstein-Barr Virus
DWTGGALLVLYSFALML

SEQ ID NO: 462 - protein, 10 aa, Epstein-Barr Virus
ALLVLYSFAL

SEQ ID NO: 463 - protein, 9 aa, Epstein-Barr Virus
LLVLYSFAL

SEQ ID NO: 464 - protein, 9 aa, Epstein-Barr Virus
VLYSFALML

SEQ ID NO: 465 - protein, 18 aa, Epstein-Barr Virus
LVLGIWIYLLEMLWRRLG

SEQ ID NO: 466 - protein, 17 aa, Epstein-Barr Virus
LIIALYLQQNWWTLLVD

SEQ ID NO: 467 - protein, 9 aa, Epstein-Barr Virus
IALYLQQNW

SEQ ID NO: 468 - protein, 9 aa, Epstein-Barr Virus
ALYLQQNWW

SEQ ID NO: 469 - protein, 9 aa, Epstein-Barr Virus
QNWWTLLVD

SEQ ID NO: 470 - protein, 9 aa, Epstein-Barr Virus
LYLQQNWWT

SEQ ID NO: 471 - protein, 17 aa, Epstein-Barr Virus
LIWMYYHGQRHSDEHHH

SEQ ID NO: 472 - protein, 9 aa, Epstein-Barr Virus
QRHSDEHHH

SEQ ID NO: 473 - protein, 9 aa, Epstein-Barr Virus
GQRHSDEHH

SEQ ID NO: 474 - protein, 9 aa, Epstein-Barr Virus
YYHGQRHSD

SEQ ID NO: 475 - protein, 9 aa, Epstein-Barr Virus
WMYYHGQRH

SEQ ID NO: 476 - protein, 17 aa, Epstein-Barr Virus
TDDSGHESDSNSNEGRH

SEQ ID NO: 477 - protein, 9 aa, Epstein-Barr Virus
ESDSNSNEG

SEQ ID NO: 478 - protein, 9 aa, Epstein-Barr Virus
DSNSNEGRH

SEQ ID NO: 479 - protein, 17 aa, Epstein-Barr Virus
PHSPSDSAGNDGGPPQL

SEQ ID NO: 480 - protein, 9 aa, Epstein-Barr Virus
AGNDGGPPQ

SEQ ID NO: 481 - protein, 9 aa, Epstein-Barr Virus
PSDSAGNDG

SEQ ID NO: 482 - protein, 17 aa, Epstein-Barr Virus
RHSDEHHHDDSLPHPQQ

SEQ ID NO: 483 - protein, 10 aa, Epstein-Barr Virus
EENLLDVFRM

SEQ ID NO: 484 - protein, 15 aa, Epstein-Barr Virus
LVSDYCNVLNKEFTA

SEQ ID NO: 485 - protein, 16 aa, Epstein-Barr Virus
FFIQQAPSNRVMIPAT

SEQ ID NO: 486 - protein, 15 aa, Epstein-Barr Virus
RVMIPATIGTAMYKL

SEQ ID NO: 487 - protein, 15 aa, Epstein-Barr Virus
KHSRVRAYTYSKVLG

SEQ ID NO: 488 - protein, 15 aa, Epstein-Barr Virus
RALIKTLPRASYSSH

SEQ ID NO: 489 - protein, 15 aa, Epstein-Barr Virus
ERPIFPHPSKPTFLP

SEQ ID NO: 490 - protein, 15 aa, Epstein-Barr Virus
EVCQPRKIRPFHPPG

SEQ ID NO: 491 - protein, 16 aa, Epstein-Barr Virus
QKEEAAICGQMDDLSH

SEQ ID NO: 492 - protein, 10 aa, Epstein-Barr Virus
DYCNVLNKEF

SEQ ID NO: 493 - protein, 9 aa, Epstein-Barr Virus
ATIGTAMYK

SEQ ID NO: 494 - protein, 9 aa, Epstein-Barr Virus
FLRGRAYGL

SEQ ID NO: 495 - protein, 10 aa, Epstein-Barr Virus
AVFDRKSDAK

SEQ ID NO: 496 - protein, 10 aa, Epstein-Barr Virus
RRIYLDLIEL

SEQ ID NO: 497 - protein, 9 aa, Epstein-Barr Virus
LLWTLVVLL

SEQ ID NO: 498 - protein, 9 aa, Epstein-Barr Virus
CLGGLLTMV

SEQ ID NO: 499 - protein, 9 aa, Epstein-Barr Virus
IEDPPFNSL

SEQ ID NO: 500 - protein, 11 aa, Epstein-Barr Virus
SSCSSCPLSKI

SEQ ID NO: 501 - protein, 9 aa, Epstein-Barr Virus
TYGPVFMCL

SEQ ID NO: 502 - protein, 9 aa, Epstein-Barr Virus
APENAYQAY

SEQ ID NO: 503 - protein, 8 aa, Epstein-Barr Virus
RAKFKQLL

SEQ ID NO: 504 - protein, 9 aa, Epstein-Barr Virus
GLCTLVAML

SEQ ID NO: 505 - protein, 9 aa, Epstein-Barr Virus
TLDYKPLSV

SEQ ID NO: 506 - protein, 10 aa, Epstein-Barr Virus
QNGALAINTE

SEQ ID NO: 507 - protein, 10 aa, Epstein-Barr Virus
EENLLDFVRF

SEQ ID NO: 508 - protein, 9 aa, Epstein-Barr Virus
HPLTNNLPL

SEQ ID NO: 509 - protein, 14 aa, Hepatitis C Virus
GYKVLVLNPSVAAT

SEQ ID NO: 510 - protein, 9 aa, Hantaan Virus
NAHEGQLVI

SEQ ID NO: 511 - protein, 9 aa, Hantaan Virus
ISNQEPLKL

SEQ ID NO: 512 - protein, 15 aa, Dengue Virus
LIGFRKEIGRMLNIL

SEQ ID NO: 513 - protein, 15 aa, Dengue Virus
KGPLRMVLAFITFLR

SEQ ID NO: 514 - protein, 15 aa, Rotavirus
RNFDTIRLSFQLVER

SEQ ID NO: 515 - protein, 14 aa, Rotavirus
RLSFQLVRPPNMTP

SEQ ID NO: 516 - protein, 14 aa, Rotavirus
VRPPNMTPAVANLF

SEQ ID NO: 517 - protein, 15 aa, Measles Virus
LSEIKGVIVHRLEAV

SEQ ID NO: 518 - protein, 9 aa, Trypanosoma cruzi
IYNVGQVSI

SEQ ID NO: 519 - protein, 15 aa, Trypanosoma cruzi
SHNFTLVASVIIEEA

SEQ ID NO: 520 - protein, 15 aa, Trypanosoma cruzi
LVASVIIEEAPSGNT

SEQ ID NO: 521 - protein, 20 aa, Trypanosoma gondii
TDPGDVVIEELFNRIPETSV

SEQ ID NO: 522 - protein, 18 aa, Trypanosoma gondii
LQLIRLAASLQHYGLVHA

SEQ ID NO: 523 - protein, 24 aa, Trypanosoma gondii
IEWIYRRCKNIPQPVRALLEGFLR

SEQ ID NO: 524 - protein, 17 aa, Babesia bovis
EYLVNKVLYMATMNYKT

SEQ ID NO: 525 - protein, 13 aa, Babesia bovis
EAPWYKRWIKKFR

SEQ ID NO: 526 - protein, 12 aa, Babesia bovis
FREAPQATKHFL

SEQ ID NO: 527 - protein, 15 aa, Babesia bovis
FREAPQATKHFLDEN

SEQ ID NO: 528 - protein, 15 aa, Babesia bovis
FREAPQATKHFLGEN

SEQ ID NO: 529 - protein, 29 aa, Babesia bovis
FVVSLLKKNVVRDPESNDVENFASQYFYM

SEQ ID NO: 530 - protein, 31 aa, Babesia bovis
VNSEKVDADDAGNAETQQLPDDAENEVRADD

SEQ ID NO: 531 - protein, 20 aa, Plasmodium vivax
NFVGKFLELQIPGHTDLLHL

SEQ ID NO: 532 - protein, 20 aa, Plasmodium vivax
FNQLMHVINFHYDLLRANVH

SEQ ID NO: 533 - protein, 20 aa, Plasmodium vivax
LDMLKKVVLGLWKPLDNIKD

SEQ ID NO: 534 - protein, 19 aa, Plasmodium vivax
LEYYLREKAKMAGTLIPES

SEQ ID NO: 535 - protein, 20 aa, Plasmodium vivax
KKIKAFLETSNNKAAAPAQS

SEQ ID NO: 536 - protein, 20 aa, Plasmodium vivax
SKDQIKKLTSLKNKLERRQN

SEQ ID NO: 537 - protein, 16 aa, Plasmodium falciparum
DPNANPNVDPNANPNV

SEQ ID NO: 538 - protein, 23 aa, Plasmodium falciparum
FGYRKPLDNIKDNVGKMEDYIKK

SEQ ID NO: 539 - protein, 23 aa, Plasmodium falciparum
SKLNSLNNPHNVLQNFSVFFNKK

SEQ ID NO: 540 - protein, 22 aa, Plasmodium falciparum
GYRKPLDNIKDNVGKMEDYIKK

SEQ ID NO: 541 - protein, 21 aa, Plasmodium falciparum
KLNSLNNPHNVLQNFSVFFNK

SEQ ID NO: 542 - protein, 21 aa, Plasmodium falciparum
TKILLKHYKGLVKYYNGESSP

SEQ ID NO: 543 - protein, 21 aa, Plasmodium falciparum
HGTKYLIDGYEEINELLYKLN

SEQ ID NO: 544 - protein, 20 aa, Plasmodium falciparum
VTHESYQELVKKLEALEDAV

SEQ ID NO: 545 - protein, 20 aa, Plasmodium falciparum
GLFHKEKMILNEEEITTKGA

SEQ ID NO: 546 - protein, 20 aa, Plasmodium falciparum
DSNIMNSINNVMDEIDFFEK

SEQ ID NO: 547 - protein, 22 aa, Plasmodium falciparum
DDYTEYDLTEIDNILVKMFKTN

SEQ ID NO: 548 - protein, 21 aa, Plasmodium falciparum
LTMSNVKNVSQTNFKSLLRNL

SEQ ID NO: 549 - protein, 19 aa, Plasmodium falciparum
HTLETVNISDVNDFQISKY

SEQ ID NO: 550 - protein, 20 aa, Plasmodium falciparum
DDEEDLDEFKPIVQYDNFQD

SEQ ID NO: 551 - protein, 19 aa, Plasmodium falciparum
EENIGIKELEDLIEKNENL

SEQ ID NO: 552 - protein, 18 aa, Plasmodium falciparum
DDLDEGIEKSSEELSEEK

SEQ ID NO: 553 - protein, 15 aa, Plasmodium falciparum
IKKGKKYEKTKDNNF

SEQ ID NO: 554 - protein, 22 aa, Plasmodium falciparum
DNEILQIVDELSEDITKYFMKL

SEQ ID NO: 555 - protein, 35 aa, Plasmodium falciparum
EQQQSDLEQERLAKEKLQEQQSDLEQERRAKEKLQ

SEQ ID NO: 556 - protein, 14 aa, Clostridium tetani
QYIKANSKFIGITE

SEQ ID NO: 557 - protein, 17 aa, Plasmodium falciparum
KIAKMEKASSVFNVVNS

SEQ ID NO: 558 - protein, 21 aa, Plasmodium falciparum
DIEKKIAKMEKASSVFNVVNS

SEQ ID NO: 559 - protein, 14 aa, Gallus gallus
ISQAVHAAHAEINE

SEQ ID NO: 560 - protein, 13 aa, Influenza Virus
PKYVKQNTLKLAT

SEQ ID NO: 561 - protein, 20 aa, Corneybacterium diptheriae
NLFQVVHWSYNRPAYSPGYV

SEQ ID NO: 562 - protein, 20 aa, Hepatitis B Virus
MDIDPYKEFGATVELLSFLP

SEQ ID NO: 563 - protein, 20 aa, Hepatitis B Virus
PHHYALRQAILCWGELMYLA

SEQ ID NO: 564 - protein, 20 aa, Hepatitis B Virus
LLWFHISCLTFGRETVIEYL

SEQ ID NO: 565 - protein, 15 aa, Hepatitis B Virus
EYLVSFGVWIRTPPA

SEQ ID NO: 566 - protein, 20 aa, Hepatitis B Virus
VSFGVWIRTPPAYRPPNAPI

SEQ ID NO: 567 - protein, 21 aa, Escherichia coli
DEVFATYYFNKNMSTYVDYII

SEQ ID NO: 568 - protein, 20 aa, Plasmodium falciparum
EYLNKIQNSLSTEWSPCSVT

SEQ ID NO: 569 - protein, 21 aa, Escherichia coli
FDFGLRPSTAYTKSKAKDVVE

SEQ ID NO: 570 - protein, 21 aa, Escherichia coli
DEVFATYYFNKNMSTYVDYII

SEQ ID NO: 571 - protein, 20 aa, Escherichia coli
NKNMSTYVDYIINQIDSKNK

SEQ ID NO: 572 - DNA, 9538 bp, Hepatitis C Virus
gccagccccctgatgggggcgacactccaccatagatcactcccctgtgaggaactactgtcttcacgcagaaagcgtctagccatggcgttagtatgagtgtcgtgcagcctccaggcccccccctcccgggagagccatagtggtctgcggaaccggtgagtacaccggaattgccaggacgaccgggtcctttcttggatcaatcccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacaaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcacaacctcgtggaaggcgacaacctatccccaaggctcgccggcccgagggcaggacctgggctcagcccgggtacccttggcccctctacggcaatgagggcctggggtgggcagaatggctcctgtcaccccgtggctctcggcccagttggggccccacggacccccggcgtaggtcgcgtaatttgggtaaggtcatcgataccctcacatgcggcttcgccgacctcatggggtacattccgctcgtcggcgcccccctggggggcgctgccagggccctggcgcatggcgtccgggttctggaggacggcgtgaactacgcaacagggaatctccccggttgctctttctctatcttcctcctggctttgctgtcctgtttgaccatcccagcttccgcttatgaagtgcgcaacgtgtccggggtgtaccatgtcacgaacgactgctccaactcaagtattgtgtatggggcggcggacatgatcatgcacacccccgggtgcgtgccctgcgtccgggagaacaattcctctcgttgctgggtagcgcttacccccacgctcgcggccaggaacaggagcatccccactacgacaatacgacgccatgtcgatttgctcgttggggcggctgctttctgctccgccatgtacgtgggggatctctgcggatctgtcttcctcgtctcccagctgttcactttctcacctcgccggtatgagacagtacaagactgcaattgctcgctctatcccggccacgtatcaggtcatcgcatggcttgggatatgatgatgaactggtcacctacagcagccttggtggtatcgcagctactccggatcccacaagccgtcgtggacatggtgacgggggcccactggggagtcctggcgggccttgcctactattccatggtggggaactgggctaaggtcttgattgtgatgctactctttgccggcgttgacgggagaaccacccatgtaacgggggggcaaacaggccggaccaccctgggcattacggccatgtttgcgtttggcccgcatcaaaagctccaactcattaacaccaatggcagctggcacatcaacaggaccgccctgaactgcaatgactctctcaacactgggttcctagctgcgctgttttacgcacgcaagttcaactcgtctggatgcccagagcgcatggccagctgccgccccattgacaagtttgttcagggatggggtcccatcactcatgctgtgcctgacaacttggaccagaggccttactgctggcactacgcgccccaaccgtgcggtatcatacccgcgtcacaggtgtgtggtccagtgtattgtttcaccccaagccccgttgtggtggggacgaccgaccgtttcggcgcccctacttacacctggggggagaatgagacggacgtgctgctccttaacaacacgcggccgccgcaaggcaactggttcggctgtacatggatgaatggcaccgggttcgccaagacgtgcggaggccccccatgtaacatcgggggggtcggcaacaacaccttgacctgccctacggattgcttccgcaagcaccccgaggccacttacaccaaatgcggctcggggccctggttgacgcctaggtgcatggttgactacccatacagactttggcactacccctgcactgtcaacttcaccatctttaaagttaggatgtatgtggggggtgtggagcacaggctcaccgccgcgtgcaattggactcgaggagagcgttgtgacttggaggacagggacagatcagaacttagcccgctgctactgtccacgacagagtggcaggtgctgccctgctccttcaccaccctaccggctttgtccaccggtctgatccacctccatcagaacatcgtggacgtgcaatacctgtatggcgtggggtcagcggtcgtctccattgtcatcaagtgggagtatatcctgctgctcttccttctcctcgcggacgcacgcgtctgcgcctgcttatggatgatgctgctgatagcccaggctgaggccgctttggaaaacctggtggtcctcaatgcggcgtccgtggccggagcgcatggcactctctccttccttgtgttcttctgtgctgcctggtacatcaagggtaggctggtccctggggcggcatatgctttttacggcgtatgcccgctgctcctgctcctgctggcgttaccaccacgagcatacgccatggaccgggagatggctgcatcgtgcgggggcgcggttttcataggtctagtactcttgaccttgtcgccacactacaaaccatttctcgccaggctcatatggtggttacaatactttatcaccagggccgaggcgctagtacaggtgtggatcccccccctcaacgttcgggggggccgcgatgccatcatcctcctcacgtgcgcggtccatccggggctgatttttgaagtcaccaaaatcttgctcgccatacttggtccgctcacgatactccaggctggcctaaccagagtgccgtacttcgtgcgcgctcaagggctcattcgtgcgtgcatgttggtgcggaaagtcgctgggggccactatgttcaaatggctttcatgaagctggccgcactgacgggcacgtacgtttacaaccatcttactccgctgcaggactgggcccacgcgggcctacgagaccttgcggtggcagttgagcccgtcgtcttctctgacatggagaccaagatcatcacctggggggcagacaccgcggcgtgtggggacatcatctcaggtctacccgtctccgcccgaagggggagggagatacttctgggaccggccgacagttttgaggggcgggggtggcgactccttgcccctatcacggcctactcccaacagacgcggggccttcttggcagtatcatcaccagcctcacaggtcgggataagaaccgggtcgagggggaggttcaagtggtctccaccgcaacgcaatctttcctggcgacctgtatcaacggcgtgtgctggactgtctaccatggtgccggctcaaagaccctagccgggccaaagggtccaattacccaaatgtacaccaatgtagaccaggacctcgtcggctggccggcgccctccggggcgcgttccctgacatcatgcacctgcggcagttcggacctttacttggtcacgagacatgctgacgtcattccggtgcgccggcggggcgacagcagggggagcctactttcccccaggcctgtctcctacttgaagggctcctcgggtggtccgctgctctgcccctcagggcatactgtgggcatcttccgggctgctgtgtgcacccggggggttgcgaaggcggtggactttatacccgtagagtctatggaaaccactatgcggtctccggtcttcacggacaactcatctcccccggccgtaccgcagacattccaagtggcccatctacacgcccccaccggcagcggtaagagcactaaagtgccggctgcatatgcagcccaagggtataaggtactcgtcctgaacccgtccgttgccgccaccctaggttttggggcgtatatgtctaaggcacatggtattgaccctaacattagaactggggtaaggaccatcaccacgggcgcccccatcacgtattccacctatggcaagttccttgccgacggtggttgttctgggggcgcctatgacatcataatatgtgatgagtgccactcaactgactcgacttccatcttgggcattggcacagtcctggaccaagcggagacggctggagcgcggctcgtcgtgctcgccaccgctacgcctccgggatcggtcaccgtgccacaccccaacatcgaggaggtggccttgtccaatactggagagatccccttctatggcaaagccatccccatcgagaccatcaaggggggaaggcatctcatcttctgtcactccaagaagaaatgtgatgagctcgccgcaaagctgtcggcccttggaatcaatgctgtagcgtactaccggggcctggatgtgtccgtcataccgacaagcggagacgccgttgtcgtggcaacagacgctctcatgacgggctataccggcgactttgactcggtgaccgactgcaacacgtgtgtcacccagacagtcgacttcagcttggaccctaccttcaccatcgaaacgacaaccgtgcctcaagactcggtgtcgcgctcgcagcggcgaggcaggactggtaggggcagagggggcatatacaggtttgtgattccaggggagcggccctcaggcatgttcgattcttcggtcctgtgtgagtgttatgacgcgggctgcgcttggtatgagctcacgcccgccgagaccacggtcaggttgcgggcttacctgaatacaccagggttgcccgtctgccaggaccacctggagttctgggagggcgtcttcacaggcctcacccacatagatgcccacttcttgtcccagactaaacaggcaggagacaacttcccctacctggtagcataccaggctacagtgtgcgccagggcccaggctccacctccatcgtgggatcaaatgtggaagtgtctcatacggctaaagccgacgctacacgggccaacacccctgttgtataggctaggggccgttcaaaacgaggtcaccctcacacaccccataaccaaatacatcatgacatgcatgtcggctgacctagaggtcgtcactagcacttgggtgctggtgggcggggtcctcgcagccctggccgcgtactgcctaacaacgggcagcgtggtcattgtgggcaggatcattttgtctgggaggccggctatcatccccgacagggaagttctctaccgggagttcgatgaaatggaagagtgcgcctcacacctcccttacatcgaacagggaatacagctcgccgagcaattcaagcagaaggcgctcgggttgctgcaaacggccaccaagcaagcggaggctgccgcccccgtggtggagtccaagtggcgtaccctagaggccttctgggcgaagcacatgtggaatttcatcagcgggatacagtacctagcaggcttgtccactctgcctgggaatcccgcgatagcatcattgatggcattcacagcctctatcaccagcccgctcaccatccaacataccctcctgtttaacatcttgggggggtgggtggccgcccaacccgccccccccagcgctgcttcagctttcgtaggcgctggcattgccggcgcggctgttggtagcataggtgttgggaaggtgcttgtggacgttttggcgggttatggagcaggggtggcaggcgctctcgtggcctttaaggtcatgagcggtgaagtgccctccactgaggacctggtcaacttactccttgccatcctctctcctggtgccctggtcgtcggagttgtgtgcgcggcaatactgcgtcggcatgtgggcccaggggagggggctgtgcagtgggtgaaccggttgatagcgttcgcttcgcggggtaaccatgtttcccccacgcactatgtgcccgagagcgacgctgcagcgcgtgtcacccagattctctccagccttaccatcactcagctgttgaagaggctccaccagtggattaatgaggactgctccacaccatgctccggctcgtggctcagggatgtttgggactggatatgcacggtgttgaccgacttcaagacctggctccagtccaagctcctgccgcggttgccaggagttcctttcctttcatgccaacgtgggtacaggggagtctggcgaggggatggcatcatgcacaccacctgcccatgtggagcacaaatcactggacatgtcaagaacggctccatgaggattgttgggccaaaaacctgtagcaacacgtggcatggaacattccccatcaacacatacaccacgggcccctgcacaccctccccagcgccaaactattccaaggcgttgtggcgggtggctgctgaggagtacgtggaggtcacgcgggtgggggatttccattacgtgacgggcatgaccactgacaacgtaaaatgcccatgccaggttccggcccccgaattctttacagaactggacggggtgcggctacacaggtacgctccggcgtgcaaacctctcctacgggatgaggtcacactccaggtcgggctcaaccaatacccggtcgggtcacagctcccatgtgagcccgaaccggatgtaacagtgctcacctccatgctcaccgacccctcccacatcacagcagagacggctaagcgtaggctggctagggggtctggggtctccccttccttggccagctcttcggctagccagttgtctgcgccttccttgaaggcgacatgcactacccatcatgactccccagatgctgacctcattgaggccaacctcctgtggcggcaggagatgggcgggaacatcacccgcgtggagtcagagaatagggtagtaattctagactcttttgacccgcttcgagcggaagaggatgagagggaaatatccgttgcggcggatatcttgcggaaaaccaagaaatttccctcagcgatgcccatatgggcacgcccggactacaacccaccactgctggagtcttggaagaacccggactacgtccctccggtggtacacgggtgcccattgtcacctaccagggcccctccaataccgcctccacggaggaagaggacagttgtcttgacagaatccgccgtgtcttctgccttggcggagcttgctacaaagaccttcggcagctccgaatcgtcggccgtcgacagcggcacagcgaccgccccccccggccagtcctctgatgacggtggtacgggatccgacgttgagtcgtactcctccatgcccccccttgagggggagccgggggaccccgatctcagcgacgggtcttggtctactgtaagcgaggaggctagcgaggacgtcgtctgctgctcaatgtcctacacgtggacgggtgccctgatcacgccatgcgccgcggaggagagcaagctgcccatcaatgcgctgagcaactctttgctgcgtcaccacaacatggtctatgccacaacatcccgcagcgcaagccagcggcagaagaaggtcacctttgacagactgcaagtcctggacgaccactaccgggacgtgctcaaggagatgaaggcgaaggcgtccacagttaaggctaagcttctatccgtagaagaagcctgcaagctgacgcccccacattcggccagatccaagtttggctatggggcaaaggacgtccggaacctgtccagcaaggccgttaaccacatccactccgtgtggaaggacttgctggaagacgatgaaacaccaatcaataccaccatcatggcaaaaaatgaggtcttctgtgttcaaccagaaaaaggaggccgcaagccagctcgccttatcgtattcccagatttaggggtccgcgtgtgcgagaaaatggccctctacgacgtggtctccactcttcctcaggccgtgatgggctcctcatacgggtttcagtactctcctggacagcgggtcgagttcttggtgaatgcctggaaatcaaagaagaaccccatgggcttcgcatatgacgcccgctgttttgactcaacggtcaccgagaatgatatccgtgttgaggagtcaatttaccaatgttgtgacttagcccccgaggccagacaggccataaggtcgctcacagagcggctttacatcgggggccccctgactaactcaaaagggcagaactgcggttatcgccggtgccgcgccagcggcgtgctgacgaccaggtgcggtaatacccttacatgtcacttgaaggcctctgcagcctgtcgagctgcaaagctccaggattgcacgatgctcgtgtgcggagatgaccttgtcgttatctgtgaaagcgcgggaacccaggaggatgcggcgagcctacgagtcttcacggaggctatgactaggtattccgccccccccggggacccgccccaaccggagtacgacttggagctaataacatcatgctcctccaacgtgtcggtcgcgcacgatgcatctggcaaacgggtatactacctcacccgcgaccccaccaccccccttgcgcgggctgcgtgggagacagctaggcacactccagtcaactcctggctaggcaacattatcatgtatgcgcccaccttatgggcaagaatgattctgatgactcacttcttctccatccttctagctcaggagcaacttgaaaaagccctagattgtcagatctacggggccacttactccattgaaccacttgacctacctcagatcattcagcgactccatggtcttagcgcattttcactccatagttactctccaggtgagatcaatagggtggcttcatgcctcaggaaacttggggtaccgcccttgcgagtctggagacatcgggccagaagtgtccgcgctaagctactgtcccaaggggggagggccgccacttgtggcaaatacctcttcaattgggcagtaaggaccaagctcaaactcactccaattccggctgcgtcccagttggacttgtccggctggttcgttgctggttacagcgggggagacatatatcacagcctgtctcgtgcccgaccccgctggttcatgtggtgcctactcctactctctgtaggggtaggcatctacttgctccccaaccggtgaacggggagctaaacactccaggccaataggccgtcctgttttttttttttttttttggtggctccatcttagccctagtcacggctagctgtgaaaggtccgtgagccgcatgactgcagagagtgctgatactggcctctctgcagatcatgt

SEQ ID NO: 573 - DNA, 9654 bp, Hepatitis C Virus
gcccgccccctgatgggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccggaaagactgggtcctttcttggataaacccactctatgtccggtcatttgggcgtgcccccgcaagactgctagccgagtagcgttgggttgcgaaaggccttgtggtactgcctgatagggtgcttgcgagtgccccgggaggcctcgtagaccgtgcaccatgagcacaaatcctaaacctcaaagaaaaaccaaaagaaacacaaaccgccgcccacaggacgtcaagttcccgggtggcggccagatcgttggcggagtttacttgctgccgcgcaggggccccaggttgggtgtgcgcgcgacaaggaagacttccgagcgatcccagccgcgtgggagacgccagcccatcccgaaagatcggcgctccaccggcaagtcctggggaaagccaggatatccttggcctctgtatggaaacgagggttgcggttgggcaggttggctcctgtcccctcgcgggtctcgtcctacttggggccccagcgacccccggcatagatcacgcaatttgggcagggtcatcgacaccatcacgtgtggttttgccgatctcatggggtacatccctgtcgttggcgcccctgtcggaggcgtcgccagagctctggcacacggtgttagggtcctggaagacgggataaattatgcaacgaggaatttacccggttgctctttttctatcttcttacttgctcttctgtcgtgcgttacagtgccagtgtcttcagtggaaatcaggaacatcagcactagctactacgccactaatgattgctcgaacaacagcatcacctggcagctcactaacgcagttctccatcttcctggatgtgtcccatgcgagaatgacaatggtaccttgcgctgctggatacaagtaacacctaatgtggctgtaaaacaccgcggtgcactcactcacaacctgcgagcacacgtcgatgtgatcgtaatggcagctacggtctgctcggctctgtacgtgggagatgtgtgtggggccgtgatgatcgtgtcgcaggctcttatagtatcgccagaacgccacaactttacccaagagtgcaactgttccatctaccaaggtcatatcactggccagcgcatggcatgggacatgatgctgaattggtcaccaactcttaccatgatcctcgcctacgctgctcgtgttcccgagttggtcctggaaattgtcttcggcggccattggggtgtggtatttggcttggcctatttctccatgcagggagcgtgggccaaggtcattgccatcctccttcttgttgcgggagtggatgcgaccacctattccaccggcgcgacagtgggccggaccgttgggagctttgctggcctctttaagcttggtgcccaacagaacgtccaattaatcaataccaacggcagctggcacataaaccggaccgccctcaactgcaatgacagcttgcacacgggtttcatggccgccctgttttatgccaacaaattcaacagctctggctgccccgagcgtttgtcttcctgccgtgggctggatgattttcgtatcgggtggggaaccttggaatacgagaccaacgtcaccaatgttgaagacatgaggccgtactgctggcattaccccccaaagccatgcggtatcgtcccagctcagtcggtttgcgggccggtctactgctttactcctagccctgttgtcgtgggcaccaccgacaggcagggcgtacccacctacaactggggggacaatgagaccgatgtcttcctgctaaatagcacaagacccccgcgaggagcctggttcggctgcacttggatgaacgggactgggttcactaagacatgcggagcaccaccttgccgcattaggaaggatttcaacagcactctcgatctattgtgccctacagactgttttaggaagcacccagatgctacctatgttaagtgtggagcagggccctggttgacccccaggtgcctgatagactacccttacagactgtggcattatccatgcaccgtaaatttcaccatcttcaaggtgcggatgtatgtagggggggtggagcatagattctctgcagcatgcaatttcacacgcggagaccgctgcagattggaagatagggataggggtcagcagagtccactgctgcactccaccactgagtgggcggtgttgccatgctccttctccgacctaccggcactatctactggcctgttgcaccttcaccaaaacatcgtggacgtgcagtacctctatggactttctccagctgttacgaaatacatcgtaaagtgggaatgggtggtcctccttttcctgttgctggcagacgccaggatctgtgcatgcctttggatgctcatcatactgggccaagctgaggcggcgcttgagaagctcatcatcttgcactccgctagcgctgctagtgccaatgggccgctgtggttcttcatcttttttacggcggcctggtacttaaagggcagagtggtccccgcggccacatactctgttctcggcttgtggtcctttctccttctagtcttggccctgccgcagcaggcttacgccttggacgccgctgaacaaggggagctggggctggtcatattaatgatcatatccatctttactcttaccccagcatacaagattctcctgagccgttcagtgtggtggctgtcctacatgctggtcctggccgaggctcaggttcagcaatgggttccccccctggaggcccgaggggggcgtgacgggatcatctgggtggctgtcatcctacacccacaccttgtgtttgaggtcacgaagtggttattagcaatcctggggtctgcctacctccttaaagcgtctctactacgggtgccatactttgtgagggctcacgctctgctacgagtgtgtaccctggtgagacatcttgcgggagctaggtatatccagatgctgttgatcaccatgggcaggtggaccggcacttacatctatgaccacctctcccccttgtcaacttgggcggcccagggtttgcgggacctggcggttgccgtggagcctgtcgtgttcagcccaatggagaagaaggtcatcgtgtggggggctgagacagtggcatgtggagacatcctgcatggcctcccggtttccgcgaggctaggtagggaagttctgctcggccctgccgatggctacacctccaaggggtggaagctcttagcccccatcactgcctacactcagcagactcgtggcctcctgggtgccattgtggtcagcctaactggccgcgacaaaaatgagcaggccgggcaggtccaggttctgtcctccgtcacacaatccttcttggggacatctatttcgggggttctctggacggtatatcacggggctggtaacaagaccttggctagccccagaggaccagtcacccagatgtacaccagcgcagagggggacctcgtgggatggcctagtccccccgggactaagtcattagacccctgtacctgcggggccgtggacctctacctggtcacccgaaacgctgacgtcattccggtccggaggaaagatgatagacggggtgcattgctgtcgccaaggcctctctcaaccctcaaaggatcatccggaggacccgtgctctgccctaggggacacgccgtgggcttgttcagagcggccgtgtgcgccaggggtgtggccaaatctattgacttcatcccggttgaatctctcgacatcgctagacggacgcccagtttttctgacaacagcacgccaccagctgtgccccaaacttaccaggtgggctacctgcacgcaccgacaggtagcgggaagagcaccaaggtccctgccgcatataccagtcaggggtataaagtgctcgtgctaaatccctctgtcgcggccacacttggttttggggcctacatgtccaaagcccacgggatcaaccccaacatcagaactggagtacggactgtgaccaccggggattctatcacctactccacttatggcaagtttctcgcggatggaggctgctcagccggcgcctatgatatcatcatctgcgacgagtgccattcagtggacgctaccaccatccttggcatcggaacagtccttgaccaggctgagaccgcaggtgttaggctggtggttctagccacagccacgccccccggtacggtgacaactccccacgctaacatagaggaggtggcccttggtcatgagggcgagatccctttttatggcaaggctatccctctagcttccatcaaggggggcagacacctaatattctgccattcaaagaagaagtgcgatgagctcgcagcagcccttcggggcatgggcgtcaatgccgtcgcctactacaggggtctcgacgtctccgttataccaactcaaggggacgtagtggtcgtcgccacagatgccctaatgactggatacaccggtgactttgactctgtcatcgactgcaacgttgcagtcactcagattgttgactttagcctagacccgacctttaccatcaccactcagactgtccctcaggacgctgtctcccgtagtcaacgtagagggagaactgggagggggcgattgggcacttacaggtatgtctcatcaggcgaaaggccgtctgggatgttcgacagcgtagtgctctgtgagtgctatgatgccggggcagcttggtacgagcttacgcctgctgagactacggtaagactccgggcttatttcaacacgcccggcttacccgtgtgtcaagaccacctggagttctgggaagcggtcttcacaggtctcacacacatcgatgcccacttcctctcccagacgaagcaaggaggagataactttgcgtatctaacggcctatcaggccacggtatgcgctagggcaaaggcccctcctccttcgtgggacgtgatgtggaaatgtctaactaggctgaaacctacactgactggtcctacccccctcctataccgcttgggtgccgtgaccaacgagattaccctgacccatcccgtgacgaaatatatcgccacgtgcatgcaagccgacctcgaggtcatgacaagcacatgggtcctggctgggggggtgctagccgccgtggcagcttactgcctggcgaccggctgcatctccatcattggccgcatacacctgaatgatcaggtggttgtggcccctgacaaggaaatcttatatgaggcctttgatgagatggaagaatgcgcctccaaagccgccctcattgaggaagggcagcggatggcggagatgcttaaatctaagatactaggcctcctacaacaggccacaaaacaggcccaggacatacagccagccatgcagtcatcatggcccaagatcgaacaattttgggccagacacatgtggaacttcatcagtggcatacagtacctggcgggactctccaccttaccgggaaatcccgcagtggcatcaatgatggctttcagcgccgcattaactagtccactgcccaccagcaccaccatcctcttgaacatcatgggggggtggttggcctcccagattgccccccctgccggagccaccggcttcgttgtcagtggcctagtgggggcagcagtcggaagtataggcctgggtaagatattggtggacgtcctagccgggtacggtgcaggcatttcaggggccctcgtggcttttaagatcatgagcggcgagaagccctcggttgaagacgtcgtgaatctcctacctgctattttgtcccctggcgccttggtagtgggagtcatttgcgcagcaatcttgcgccgccacgtcggccagggagagggggcggtccagtggatgaacagactgatcgcctttgcctctaggggaaaccatgttgcccctactcactacgtggcggagtctgacgcctcgctgcgcgtgacgcaggtgttaagctcactcacaattaccagcttgcttaggagactacacgcctggatcactgaagattgcccagtcccatgttcggggtcttggctccgggacatttgggagtgggtatgttccattctcacagactttaagaactggctgtctgcaaaattgctccccaaaatgcccggcctccccttcatctcttgccaaaagggatacaggggtgtgtgggctggcacgggagtcatgactactcggtgttcatgcggagcaaacatctcgggccacgtccgcttgggcaccatgaaaataacaggcccgaagacctgcctaaacatgtggcagggaaccttccccatcaattgttacacagaagggccttgtgtgccaaaaccccctcctaattataagaccgctatttggagggtggcagcgtcggagtacgttgaggtcacgcagcatggctctttctcgtatgtaacggggttaactagtgacaaccttaaggtcccttgccaggtaccagctccagaattcttctcttgggtggacggggtgcagatacaccgatttgcccccactccaggtcccttctttcgggatgaggtaacgttcaccgtaggcctcaattccctcgtggtcggttctcagctcccttgcgaccctgagccggacaccgaggtattggcctccatgttgacagacccgtcccacattaccgcggagacggcagccaggcgactggccaggggatctcccccctcacaggccagctcctcagcgagccagctgtccgccccgtccttgaaggctacctgtaccacccataaaacggcatatgattgtgacatggtggatgccaaccttttcatgggaggcgatgtgacccgaattgagtccgactccaaggtgatcgttcttgactccctcgattccatgactgaggtagaggatgatcgtgagccttctgtaccatcagagtacttgaccaggaggagaaagttcccaccggcactacctccctgggcccgtccagactacaaccctcctgtgatcgagacatggaagaggccggactatgaaccacccactgtcctaggctgcgccctaccccccacacctcaggcaccagtgcccccacctcggaggcgccgcgccagagtcctgactcaggacaatgtggagggggtccttagggagatggcagacaaagtgctcagccctctccaagacaccaatgactccggtcactccactggggcggataccggaggagacagcgtccagcagccctctggcgagactgccgcttcagatgcgggatcactgtcctccatgcctccccttgagggggagccgggggaccctgacctggagtttgagccagcgagatccgctcccccttccgagggggagtgtgaggtcatcgactcggactctaagtcgtggtctacagtctccgatcaagaggattctgttatctgctgctccatgtcatactcctggacaggagccctcataacaccatgtgggcccgaggaggagaagttgccaatcagccctctgagtaactcgcttatgcggttccataacaaggtgtactccacaacctcgaggagtgcttctctgagggcaaagaaggtgacctttgacagggtgcaggtgctggacgcacactatgactcagtcttgcaggacgttaagcgggctgcctctaaggttagtgcgaggctcctctcagtagaggaagcctgcgcgttgaccccgccccactccgccaaatcacgatacggatttggggcaaaggaggtgcgcagcttatccaggggggccgttaaccacatccggtccgtgtgggaggacctcctggaagaccaacatactccaattgacacaactgccatggccaaaaatgaggtgttctgtattgatcccgccaagggcggaaaaaagccagctcgcctcatcgtataccctgaccttggggtcagggtgtgcgaaaagatggccctttatgacattgcacaaaagcttcccaaggcaataatggggccgtcctatgggttccaatactctcctgcagaacgggtcgattttctcctcaaagcttggggaagtaagaaggacccaatggggttctcatatgacacccgctgcttcgactcaaccgtcacggagagggacataagaacagaagaatccatatatcaggcttgctccctgcctcaagaggctaggactgtcatacactcgatcactgagagactctacgtaggagggcccatgacaaacagcaaagggcaatcctgcggttacaggcgttgccgcgcaagcggtgtcttcactaccagcatggggaacaccatgacatgctacattaaagctcttgcagcatgtaaagctgcagggatcgtagatcctactatgctggtgtgtggagacgacctggttgtcatctcggagagccaaggcaatgaggaggacgagcgaaacctgagagctttcacggaagctatgaccaggtattccgcccctcccggtgaccttcccagaccggaatatgacttggagcttataacatcctgctcctcaaacgtatcggtagcgctggactctcggggtcgccgccggtacttcttaaccagagaccctaccactccaatcacccgagctgcttgggaaacagtaagacactcccctgtcaattcttggctgggcaacatcatccaatacgcccctacaatctgggtccggatggtcataatgacccactttttctccatactactggcccaggacactctgaaccagaatctcaatttcgagatgtacggggcagtatactcggtcaatccactagacctgccggccataattgaaaggctacatgggcttgacgccttctcattgcacacatactctccccacgaactctcacgggtggcagcgactctcaggaaacttggagcgcctccccttagagcgtggaagagtcgggcgcgtgctgtgagggcctcactcatcatccagggagggagggcggccacttgtggacgctacctcttcaactgggcggtgaagacaaagctcaaactcactccattgcccgaggcgagccgcctagatttatccgggtggttcaccgtgggcgccggcgggggcgacatctttcacagcgtgtcgcatgcccgaccccgcctattactcctttgcctactcctacttagcgtaggagtaggcatctttttactccccgctcggtagagcggcaaaccctagctacactccatagctagttttcttttttttttttttttttttttttgttttttttttttttcctctttttccgtattttttttttttcctcttttcttggtggctccatcttagccctagtcacggctagctgtgaaaggtccgtgagccgcatgactgcagagagtgccgtaactggtctctctgcagatcatgt

SEQ ID NO: 574 - DNA, 9488 bp, Hepatitis C Virus
tgcccgcccctaaatggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacacaaaccgccgcccacaggacgtcaagttcccgggcggtggccagatcgttggcggagtatacttgttgccgcgcaggggccccaggttgggtgtgcgcgcgacgaggaagacttccgaacggtcccagccacgcggaagacgccagcccatccccaaagatcggcgttccgctggcaagtcctggggacgtccaggatacccctggcccctgtatgggaatgagggcctcgggtgggcaggatggctcctgtccccccgaggctctcgcccttcttggggccccacagacccccggcatagatcacgcaatctgggcaaggtcatcgatacccttacgtgtggttttgccgatctcatggggtacatacccgtcgtcggcgccccggttggcggcgttgccagagcactcgcgcatggcgtgagggtcctggaggacgggataaactatgcaacagggaatctacccggttgctctttttctatcttcctactagctctcttgtcttgcatgtctgtaccagtatccgctgtggaggtcaagaacaccagtcagatctacatggccaccaatgattgctccaacaacagcattacgtggcaacttgaaggtgcggtactacatgttcctggttgcgttccatgcgagtcgacgggcaacatatcgcggtgctggataccagtcacacctaacgtcgccgtgagggagcgcggggcgcttaccaaaggtctgcggacgcatatcgatttgatcgtggtgtccgccacgttctgctccgctctttacataggggatgtttgtggtgcgattatgatagcggcccaggcaaccatcatttcgccgcaacaccacacttttgttcaggactgcaattgttccatttacccgggccacgtcacaggacaccgtatggcatgggatatgatgatgaactggtctccagcaaccaccatgatcatggcatacttcatgcgcgtccctgaagtcgttctggacatcatcactggagcgcactggggcgtaatgttcggcctagcctacttctccatgcagggggcgtgggccaaggtcgtcgtcatccttctattgactgcaggagtggacgcccagacgcacactatatctggtcatgcggctaggaccacgcacggcctcgtcagcttgttcacccctgggtcccaacaaaacatccaacttgttaacaccaacggcagttggcatattaaccgcacggccttgaattgcaatgattcattgaaaacagggttcattgcggcattgttctactcccataaatttaactcctcgggttgtcctcaacgaatgtcctcctgccgctccatcgaggagtttaggataggatggggcaacctagagtatgaggaaaatgttaccaatgatgacaacatgaggccctattgctggcattatccacccagaccatgtggcattgttcctgctcaaaccgtatgtggcccagtgtattgtttcacccccagtccagtcgtggtaggcaccaccgacagacgcggggtgccaacttacacctggggggagaacgacacggatgtgtttttactgaacagcacgcggcctccgcggggagcttggtttggatgcacatggatgaatagtactgggtttactaagacctgcggcgcaccaccttgccgcataaggccagacttcaattcctccgaggatctgctgtgccccactgactgcttcaggaagcactctgaggctacttacaccagatgtggggccggaccatggttaactcccaaatgcctatttcattacccctacaggctgtggcattacccgtgtaccatcaacttcaccatccacaaaatacggatgttcataggcggggttgaacacaggctcgaagcagcgtgcaattttacccgtggggaccgttgcaatctggaagaccgggataggagccagctcagccccttgctacattccaccactgagtgggccattctaccttgtaccttctccgacatgccggctctatctaccggtctcttacacctccaccaaaacatcgtggacgtgcagtacttgtatggcctatcgccggccattaccaagtatattgtcaaatgggaatgggtggtcctcttgtttctgctcctcgcggacgccagagtctgcgcgtgcttgtggatgcttctcttgctgggacaagctgaggcagcgctggagaagctagtcatcctgcatgcggccagtgccgcaagctctcatggcatgctttgtttcatcatcttcttcatagctgcttggtacatcaagggtcgagtcacccccctggttacttactcgtacctcggcatgtggtccttcagccttctactcctggcacttccccaacaggcctatgcccttgatacaactgagcaggggcaaataggcctggtccttctagtggtcatatcagtctttacacttagcccggcatataagatccttctctgccgcagcttatggtggttgtcctatttgttggtccgagcggaagctttgatccaagattgggtgccaccttggcaggcccgaggcggccgcgatggcatcatatgggccgccaccatattctgtccgggtgtattgtttgacataaccaattggctcctggcaatcttaggacctggttacctccttaggagtgtcctcacaagcacgccatacttcgtcagagcgcaagcgctgttgaggatatgtgctgctgtaagacatctctcgggtggcaagtacgtccagatgatgctactaacccttggtaaatggactggcacatacatctatgatcacctctccccaatgtcaggttgggctgctagtgggctacgcgacctcgcggttgctgtagaacccattgttttcagcccaatggagaaaaaagtcattgtgtggggagcggagacggcagcgtgtggtgacatcttgcacgggctgccggtctccgcccgcttgggtcaggaggtgctgctgggcccagcagacgagtacacttccaaggggtggaaacttcttgcgcccatcaccgcttatgcccagcagacgcgtggtttgctgggtactatagtggtaagtatgacagggcgtgacaagacggaacaagctggagagatccaggtcttgtccacggtcactcaatcattcctcgggacgacaatctcgggaatcctgtggacggtcttccacggcgctgggaacaaaacgctagctggctcacgagggcctgttacgcagatgtattccagcgccgagggggaccttgtggggtggcccagccctcctggtactaggtctttggatccttgcacgtgtggcgctgttgacctctaccttgtcacccggaacgctgatgtcatcccggctcggagacagggagaccgacgaggggcattgctctccccaaggcctctttcaagtttgaaggggtcctcgggggggccagtgctttgccctagaggtcatgctgtggggattttccgagcagccatctgcaccagaggggctgcgaagtctattgacttcatacccatcgagtcgctcgatgttatcatcagatcccccaacttcactgataacagttcaccccctgctgtgcctcagacctaccaggtgggatatttacatgcccctaccggtagtgggaagagcactaaggtgcccgcctcttacgctgctcaggggtacaaggtattggtgctaaacccttctgtggctgccaccttagggtttggggcttacatgtccaaagcacacgggatcaatcccaacatcagaactggggttcgaaccgtgacgaccggagagtccatcacatattctacctatggcaaattcctcgccgacggaggctgctcaggcggagcctatgacgtcataatatgcgatgaatgccattcagttgatgcaaccaccatcctcggcatcgggacagtccttgaccaggctgagacggccggagctaggttgacagtcttagccacggccacgcctcctgggtctgtaacgactccccaccccaacatagaggaagtagctctcggccacgagggtgaaatccctttttatggaaaagcaatccccctatctcagatcaaagggggaagacatctgatcttctgtcactccaagaagaagtgcgatgagctcgcagctgctcttcggggcatgggcttaaacgcagttgcttactacagagggctcgacgtctccgtgataccaacccagggggacgtggtggtggtagctaccgatgcccttatgacggggttcactggggatttcgactcagtggttgactgcaacgttgcggtcacacagaccgtcgacttcagtttggaccccacttttactgtgaccacacaaactgttccccaagacgctgtgtcacgcagccagcgtagagggcgaacgggtaggggtaggttgggcatatataggtatgtctcctctggagagcgagcttccgggatgttcgattccgtagtgctctgtgagtgctacgatgctggagcagcctggtatgagctcacgccagcggagaccactgtcaggctccgggcatacttcaacacgcctggattacccgtgtgtcaggaccatttagagttctgggaggcagtttttaccggcctcacacacatagatgctcacttcctctcccagacgaaacaagcgggggagaacttcccgtacctggtggcatatcaggctacggtgtgtgctagagctaaagccccccccccgtcttgggatgtcatgtggaaatgcctgattcgactcaagcctacgctcaccggcccaacacctctgctctatcgcttaggccctgtcaccaatgagaccactctcacacaccccgtaaccaaatacatcgccacgtgcatgcaagctgaccttgagatcatgacgagcacatgggtgcttgctgggggagtgttagcagccatcgccgcctattgcttggcgactggctgtgtggtctgcatcggtcgtgtgaacatcaatcaaaagaccatagtcgcccctgataaggaagtcctgtacgaggcgtttgatgagatggaggaatgcgcttccagggctctcctacttgaggaggggcaacgaatagcggaaatgctgaagtccaaaatccaaggcttgctacaacaagccacgaagcaggcccaagacattcagcccgctgttcaggctacttggcccaaactggaacaattctgggccaagcacatgtggaatttcattagtggtatccagtatttggcaggactttccacgctacctgggaatcctgccgtggctgcaatgatggcgttcagcgccgcactcactagcccgctgcccaccagtactaccatcctcctaaacatcatggggggttggctagcttcccagatcgctcccgccgcgggggccaccggctttgtcgttagcggcttagtaggggctgccgtgggcagtataggtctgggtaaaatattggtggacgtcttggcaggctatggtgctggcatctcgggggccctcgtcgcttttaagatcatgtccggcgagaagccttccgtggaagatgtcgttaatctgctccccgggattctatcaccgggtgcgttagtagtcggcgtcatctgcgcggccatcttacgccgccacgtgggacaaggggaaggcgcggtccagtggatgaataggctcatagcctttgcttccagaggtaaccacgtcgccccgactcactacgtggcggagtctgatgcgtcgcagcgggtaacgcagctacttggctcgctcaccatcactagcctactcagaaggctccatacctggattaccgaagactgccctgttccatgcgccggctcttggcttcgcgacatatgggactgggcctgtactatcttgactgactttaaaaattggctctccaccaaactgcttccaaaaatgcccggcctccccttcatctcctgtcaaagggggcataaaggggcttggactggcactggcatcatgacaacacggtgcccatgcggagctgtcgtttcgggcaatgtccgtcacggttccatgaggataaccggacctaaaacttgcatgaatacctggcaggggacctttcccatcaactgctatacagaaggtcagtgtgcaccacaacccacacataactacaaaaccgctatatggaaggtggcagcagcggaatatgcggaggtgacacgacatggttcctatgcttatgttacaggtttgacaaatgacaatctcaaagtcccttgccagttgcctgcaccggagttcttctcctgggtggatggggtgcaaatccacaggttcgctcccacaccaaagccgttcattagggatgaggtctcgttcaccgtgggcctcaactcttttgtggtggggtctcagctgccttgtgaacctgagccggacacggaagtgttggcatcaatgctgacggacccatcccacattacggcagaggcagcggctaggcgcttagcgcgaggctcgcctccatccgaggccagctcttctgcgagtcaactctcagcgccgtcgttgcgagctacctgtaccgcccatgctaagaactatgcggttgagatggtggatgcaaacttcttcatggggagtgatgtgacacggatagaatccgagacgaaggtgcttatcctagactctctcgacccttcggttgaagaggaggacgagcgcgaaccttcagtgccatcagagtatctcctccccaagaaaaagttcccacaggctctaccagtctgggcgaggccagactacaatccaccagtcgtagagacctggaagagaccagattatgacccaccaacagtatccgggtgtgctcttcccccccgtgttacagccccaacgcccccacccaggaggcgacgggcgttagtcctgagtcagagcaatgtaggggaagctcttcaagcattggccattaagagctttggccaacttccccctagctgtgattcaggtcgctccacagggatggacactaccgatgctactgaccaaccagccttaaaggaatctactgactcggaagcaggctctgattcctccatgcctcccctcgagggggagccgggggaccctgacctagagtctgggtcggtggagtaccatccctcctcccaggagggggaggcagctcctgatctagactccggctcctggtccacatgttccgaggaggggggttctgaagtttgttgctccatgtcctactcctggaccggggcgctgataactccatgcggcccggaagaggaaaagttaccgatcaacccgttgagcaactcattgctgcggtatcacaacaaggtgtatagtacaacatcacgcagtgcttcacaacgggctaaaaaggtgacctttgacagggtgcaactacttgactctcattatgaccaagtcttaaaggacattaagctggctgcttccaaagtcagtgctaacctactctctatagaggaggcatgtgcgctgacccccccccattccgcaagatcgaagtatgggttcggggcaaaggaggttcgcagcttgtccaggaaggccgtcgaccacatcaagtccgtgtggaaggacctcctggaagaccaacaaacaccaattcctacaaccatcatggccaaaaatgaggtgttctgcatcgacccgacgaaaggcgggaagaaggctgctcgcctcatcgtattccctgatcttggcgtcagggtttgcgagaaaatggccctttatgacatcacacagaagctaccccaggcagtaatgggagcttcatatggattccagtactctcccgcacagcgtgttgatttcctgctgcgagcttggaaagaaaagaaagaccctatgggtttttcgtatgatacccgctgtttcgactcaacagtcacggagagagatatcaggactgaggagtccatatacctggcctgctcattgcccgaggaagctcgggttgccatacactcactaactgagagactttacgtgggcgggcccatgatgaacagcaagggccagtcttgcggttataggcgttgtcgcgcaagcggagtgctcaccactagcatggggaacactatcacgtgctacgtgaaggccttggcggcctgcaaggccgcagggattgtggctcccaccatgttggtgtgcggcgacgacctagtagtcatctcagagagtcagggagctgaggaggatgagcgaaatctgagagtcttcacggaggctatgaccagatattctgctccccccggcgacccccctaaaccagaatatgacttggagctgataacatcatgctcttcaaatgtatctgtggctttagaccagcatggtcggcgcatgtactacctgaccagagaccctagcactccactcgccagggctgcctgggagacagctagacactcccctgtcaattcatggctgggaaacatcattcaatacgcccccaccatatgggtgcgcatggtcctcatgacacactttttctccgtcctaatggcccaggaaaccctggatcaagacctaaactttgaaatgtacggagcagtgtattctgtgaaccctctggacctcccagccataattgagagactacatgggcttgaagctttctcactgcacggttactctcccaccgaactcactcgggtggcagcagctctcagaaaacttggagcgcctcccctcagagcgtggaagagccgggcacgtgcggtgagggcatcactcatctcccagggagggagagcggccacttgtggcttctatctcttcaactgggcggtgaggacaaagcgcaaactcactccattgccggcagcgcgccgcctggatctatccgggtggttcactgtcggcgctggcgggggcgacatttatcacagcgtgtcgcgagcccgaccccgcttcttactcctttgcctactcctactcagcgtaggggtaggcatctttttactccccgctcggtagagcggcacaccttagctacactccatagctaactgtttttttttt

SEQ ID NO: 575 - DNA, 9678 bp, Hepatitis C Virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggcgcttgcgagtgccccgggaggtctcgtagaccgtgcaccatgagcacaaatcctaaacctcaaagaaaaaccaaaagaaacaccaaccgtcgcccagaagacgttaagttcccgggcggcggccagatcgttggcggagtatacttgttgccgcgcaggggccccaggttgggtgtgcgcacgacaaggaaaacttcggagcggtcccagccacgtgggagacgccagcccatccccaaagatcggcgctccactggcaaggcctggggaaaaccaggtcgcccctggcccctatatgggaatgagggactcggctgggcaggatggctcctgtccccccgaggctctcgcccctcctggggccccactgacccccggcataggtcgcgcaacgtgggtaaagtcatcgacaccctaacgtgtggctttgccgacctcatggggtacatccccgtcgtaggcgccccgcttagtggcgccgccagagctgtcgcgcacggcgtgagagtcctggaggacggggttaattatgcaacagggaacctacccggtttccccttttctatcttcttgctggccctgttgtcctgcatcaccgttccggtctctgctgcccaggtgaagaataccagtagcagctacatggtgaccaatgactgctccaatgacagcatcacttggcagctcgaggctgcggttctccacgtccccgggtgcgtcccgtgcgagagagtggggaatacgtcacggtgttgggtgccagtctcgccaaacatggctgtgcggcagcccggtgccctcacgcagggtctgcggacgcacatcgatatggttgtgatgtccgccaccttctgctctgctctctacgtgggggacctctgtggcggggtgatgctcgcggcccaggtgttcatcgtctcgccgcagtaccactggtttgtgcaagaatgcaattgctccatctaccctggcaccatcactggacaccgcatggcatgggacatgatgatgaactggtcgcccacggccaccatgatcctggcgtacgtgatgcgcgtccccgaggtcatcatagacatcgttagcggggctcactggggcgtcatgttcggcttggcctacttctctatgcagggagcgtgggcgaaggtcattgtcatccttctgctggccgctggggtggacgcgggcaccaccaccgttggaggcgctgttgcacgttccaccaacgtgattgccggcgtgttcagccatggccctcagcagaacattcagctcattaacaccaacggcagttggcacatcaaccgtactgccttgaattgcaatgactccttgaacaccggctttctcgcggccttgttctacaccaaccgctttaactcgtcagggtgtccagggcgcctgtccgcctgccgcaacatcgaggctttccggatagggtggggcaccctacagtacgaggataatgtcaccaatccagaggatatgaggccgtactgctggcactaccccccaaagccgtgtggcgtagtccccgcgaggtctgtgtgtggcccagtgtactgtttcacccccagcccggtagtagtgggcacgaccgacagacgtggagtgcccacctacacatggggagagaatgagacagatgtcttcctactgaacagcacccgaccgccgcagggctcatggttcggctgcacgtggatgaactccactggtttcaccaagacttgtggcgcgccaccttgccgcaccagagctgacttcaacgccagcacggacttgttgtgccctacggattgttttaggaagcatcctgatgccacttatattaagtgtggttctgggccctggctcacaccaaagtgcctggtccactacccttacagactctggcattacccctgcacagtcaattttaccatcttcaagataagaatgtatgtagggggggttgagcacaggctcacggccgcatgcaacttcactcgtggggatcgctgcgacttggaggacagggacaggagtcagctgtctcctctgttgcactctaccacggaatgggccatcctgccctgcacctactcagacttacccgctttgtcaactggtcttctccaccttcaccagaacatcgtggacgtacaatacatgtatggcctctcacctgctatcacaaaatacgtcgttcgatgggagtgggtggtactcttattcctgctcttagcggacgccagagtctgcgcctgcttgtggatgctcatcttgttgggccaggccgaagcagcattggagaagttggtcgtcttgcacgctgcgagtgcggctaactgccatggcctcctatattttgccatcttcttcgtggcagcttggcacatcaggggtcgggtggtccccttgaccacctattgcctcactggcctatggcccttctgcctactgctcatggcactgccccggcaggcttatgcctatgacgcacctgtgcacggacagataggcgtgggtttgttgatattgatcaccctcttcacactcaccccggggtataagaccctcctcggccagtgtctgtggtggttgtgctatctcctgaccctgggggaagccatgattcaggagtgggtaccacccatgcaggtgcgcggcggccgcgatggcatcgcgtgggccgtcactatattctgcccgggtgtggtgtttgacattaccaaatggcttttggcgttgcttgggcctgcttacctcttaagggccgctttgacacatgtgccgtacttcgtcagagctcacgctctgataagggtatgcgctttggtgaagcagctcgcggggggtaggtatgttcaggtggcgctattggcccttggcaggtggactggcacctacatctatgaccacctcacacctatgtcggactgggccgctagcggcctgcgcgacttagcggtcgccgtggaacccatcatcttcagtccgatggagaagaaggtcatcgtctggggagcggagacggctgcatgtggggacattctacatggacttcccgtgtccgcccgactcggccaggagatcctcctcggcccagctgatggctacacctccaaggggtggaagctccttgctcccatcactgcttatgcccagcaaacacgaggcctcctgggcgccatagtggtgagtatgacggggcgtgacaggacagaacaggccggggaagtccaaatcctgtccacagtctctcagtccttcctcggaacaaccatctcgggggttttgtggactgtttaccacggagctggcaacaagactctagccggcttacggggtccggtcacgcagatgtactcgagtgctgagggggacttggtaggctggcccagcccccctgggaccaagtctttggagccgtgcaagtgtggagccgtcgacctatatctggtcacgcggaacgctgatgtcatcccggctcggagacgcggggacaagcggggagcattgctctccccgagacccatttcgaccttgaaggggtcctcgggggggccggtgctctgccctaggggccacgtcgttgggctcttccgagcagctgtgtgctctcggggcgtggccaaatccatcgatttcatccccgttgagacactcgacgttgttacaaggtctcccactttcagtgacaacagcacgccaccggctgtgccccagacctatcaggtcgggtacttgcatgctccaactggcagtggaaagagcaccaaggtccctgtcgcgtatgccgcccaggggtacaaagtactagtgcttaacccctcggtagctgccaccctggggtttggggcgtacctatccaaggcacatggcatcaatcccaacattaggactggagtcaggaccgtgatgaccggggaggccatcacgtactccacatatggcaaatttctcgccgatgggggctgcgctagcggcgcctatgacatcatcatatgcgatgaatgccacgctgtggatgctacctccattctcggcatcggaacggtccttgatcaagcagagacagccggggtcagactaactgtgctggctacggccacaccccccgggtcagtgacaaccccccatcccgatatagaagaggtaggcctcgggcgggagggtgagatccccttctatgggagggcgattcccctatcctgcatcaagggagggagacacctgattttctgccactcaaagaaaaagtgtgacgagctcgcggcggcccttcggggcatgggcttgaatgccgtggcatactatagagggttggacgtctccataataccagctcagggagatgtggtggtcgtcgccaccgacgccctcatgacggggtacactggagactttgactccgtgatcgactgcaatgtagcggtcacccaagctgtcgacttcagcctggaccccaccttcactataaccacacagactgtcccacaagacgctgtctcacgcagtcagcgccgcgggcgcacaggtagaggaagacagggcacttataggtatgtttccactggtgaacgagcctcaggaatgtttgacagtgtagtgctttgtgagtgctacgacgcaggggctgcgtggtacgatctcacaccagcggagaccaccgtcaggcttagagcgtatttcaacacgcccggcctacccgtgtgtcaagaccatcttgaattttgggaggcagttttcaccggcctcacacacatagacgcccacttcctctcccaaacaaagcaagcgggggagaacttcgcgtacctagtagcctaccaagctacggtgtgcgccagagccaaggcccctcccccgtcctgggacgccatgtggaagtgcctggcccgactcaagcctacgcttgcgggccccacacctctcctgtaccgtttgggccctattaccaatgaggtcaccctcacacaccctgggacgaagtacatcgccacatgcatgcaagctgaccttgaggtcatgaccagcacgtgggtcctagctggaggagtcctggcagccgtcgccgcatattgcctggcgactggatgcgtttccatcatcggccgcttgcacgtcaaccagcgagtcgtcgttgcgccggataaggaggtcctgtatgaggcttttgatgagatggaggaatgcgcctctagggcggctctcatcgaagaggggcagcggatagccgagatgttgaagtccaagatccaaggcttgctgcagcaggcctctaagcaggcccaggacatacaacccgctatgcaggcttcatggcccaaagtggaacaattttgggccagacacatgtggaacttcattagcggcatccaatacctcgcaggattgtcaacactgccagggaaccccgcggtggcttccatgatggcattcagtgccgccctcaccagtccgttgtcgaccagtaccaccatccttctcaacatcatgggaggctggttagcgtcccagatcgcaccacccgcgggggccaccggctttgtcgtcagtggcctggtgggggctgccgtgggcagcataggcctgggtaaggtgctggtggacatcctggcaggatatggtgcgggcatttcgggggccctcgtcgcattcaagatcatgtctggcgagaagccctctatggaagatgtcatcaatctactgcctgggatcctgtctccgggagccctggtggtgggggtcatctgcgcggccattctgcgccgccacgtgggaccgggggagggcgcggtccaatggatgaacaggcttattgcctttgcttccagaggaaaccacgtcgcccctactcactacgtgacggagtcggatgcgtcgcagcgtgtgacccaactacttggctctcttactataaccagcctactcagaagactccacaattggataactgaggactgccccatcccatgctccggatcctggctccgcgacgtgtgggactgggtttgcaccatcttgacagacttcaaaaattggctgacctctaaattgttccccaagctgcccggcctccccttcatctcttgtcaaaaggggtacaagggtgtgtgggccggcactggcatcatgaccacgcgctgcccttgcggcgccaacatctctggcaatgtccgcctgggctctatgaggatcacagggcctaaaacctgcatgaacacctggcaggggacctttcctatcaattgctacacggagggccagtgcgcgccgaaaccccccacgaactacaagaccgccatctggagggtggcggcctcggagtacgcggaggtgacgcagcatgggtcgtactcctatgtaacaggactgaccactgacaatctgaaaattccttgccaactaccttctccagagtttttctcctgggtggacggtgtgcagatccataggtttgcacccacaccaaagccgtttttccgggatgaggtctcgttctgcgttgggcttaattcctatgctgtcgggtcccagcttccctgtgaacctgagcccgacgcagacgtattgaggtccatgctaacagatccgccccacatcacggcggagactgcggcgcggcgcttggcacggggatcacctccatctgaggcgagctcctcagtgagccagctatcagcaccgtcgctgcgggccacctgcaccacccacagcaacacctatgacgtggacatggtcgatgccaacctgctcatggagggcggtgtggctcagacagagcctgagtccagggtgcccgttctggactttctcgagccaatggccgaggaagagagcgaccttgagccctcaataccatcggagtgcatgctccccaggagcgggtttccacgggccttaccggcttgggcacggcctgactacaacccgccgctcgtggaatcgtggaggaggccagattaccaaccgcccaccgttgctggttgtgctctccccccccccaagaaggccccgacgcctcccccaaggagacgccggacagtgggtctgagcgagagcaccatatcagaagccctccagcaactggccatcaagacctttggccagcccccctcgagcggtgatgcaggctcgtccacgggggcgggcgccgccgaatccggcggtccgacgtcccctggtgagccggccccctcagagacaggttccgcctcctctatgccccccctcgagggggagcctggagatccggacctggagtctgatcaggtagagcttcaacctcccccccagggggggggggtagctcccggttcgggctcggggtcttggtctacttgctccgaggaggacgataccaccgtgtgctgctccatgtcatactcctggaccggggctctaataactccctgtagccccgaagaggaaaagttgccaatcaaccctttgagtaactcgctgttgcgataccataacaaggtgtactgtacaacatcaaagagcgcctcacagagggctaaaaaggtaacttttgacaggacgcaagtgctcgacgcccattatgactcagtcttaaaggacatcaagctagcggcttccaaggtcagcgcaaggctcctcaccttggaggaggcgtgccagttgactccaccccattctgcaagatccaagtatggattcggggccaaggaggtccgcagcttgtccgggagggccgttaaccacatcaagtccgtgtggaaggacctcctggaagacccacaaacaccaattcccacaaccatcatggccaaaaatgaggtgttctgcgtggaccccgccaaggggggtaagaaaccagctcgcctcatcgtttaccctgacctcggcgtccgggtctgcgagaaaatggccctctatgacattacacaaaagcttcctcaggcggtaatgggagcttcctatggcttccagtactcccctgcccaacgggtggagtatctcttgaaagcatgggcggaaaagaaggaccccatgggtttttcgtatgatacccgatgcttcgactcaaccgtcactgagagagacatcaggaccgaggagtccatataccaggcctgctccctgcccgaggaggcccgcactgccatacactcgctgactgagagactttacgtaggagggcccatgttcaacagcaagggtcaaacctgcggttacagacgttgccgcgccagcggggtgctaaccactagcatgggtaacaccatcacatgctatgtgaaagccctagcggcctgcaaggctgcggggatagttgcgcccacaatgctggtatgcggcgatgacctagtagtcatctcagaaagccaggggactgaggaggacgagcggaacctgagagccttcacggaggccatgaccaggtactctgcccctcctggtgatccccccagaccggaatatgacctggagctaataacatcctgttcctcaaatgtgtctgtggcgttgggcccgcggggccgccgcagatactacctgaccagagacccaaccactccactcgcccgggctgcctgggaaacagttagacactcccctatcaattcatggctgggaaacatcatccagtatgctccaaccatatgggttcgcatggtcctaatgacacacttcttctccattctcatggtccaagacaccctggaccagaacctcaactttgagatgtatggatcagtatactccgtgaatcctttggaccttccagccataattgagaggttacacgggcttgacgccttttctatgcacacatactctcaccacgaactgacgcgggtggcttcagccctcagaaaacttggggcgccacccctcagggtgtggaagagtcgggctcgcgcagtcagggcgtccctcatctcccgtggagggaaagcggccgtttgcggccgatatctcttcaattgggcggtgaagaccaagctcaaactcactccattgccggaggcgcgcctactggacttatccagttggttcaccgtcggcgccggcgggggcgacatttttcacagcgtgtcgcgcgcccgaccccgctcattactcttcggcctactcctacttttcgtaggggtaggcctcttcctactccccgctcggtagagcggcacacactaggtacactccatagctaactgttcctttttttttttttttttttttttttttttttttttttttttttcttttttttttttttccctctttcttcccttctcatcttattctactttctttcttggtggctccatcttagccctagtcacggctagctgtgaaaggtccgtgagccgcatgactgcagagagtgccgtaactggtctctctgcagatcatgt

SEQ ID NO: 576 - DNA, 9674 bp, Hepatitis C Virus
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcccaaacctcaaagaaaaaccaaaagaaacactaaccgtcgcccacaagacgttaagtttccgggcggcggccagatcgttggcggagtatacttgttgccgcgcaggggccccaggttgggtgtgcgcgcgacaaggaaggcttcggagcggtcccagccacgtgggaggcgccagcccatccccaaacatcggcgctccactggcaagtcctgggggaagccaggatacccctggcccctgtatgggaatgaggggctcggttgggcaggatggctcctgtcccctcgaggttcccgtccctcatggggccccaatgacccccggcataggtcgcgcaatgtgggtaaggtcatcgataccctaacgtgcggctttgccgacctcttggggtacgtccccgtcgtaggcgccccgcttagtggcgttgccagtgctctcgcgcacggcgtgagagtcctggaggacggggttaattttgcaacagggaacttacctggttgctccttttctatcttcttgctggccctactgtcctgcatcactactccggtctctgctgtccaagtgaagaacaccagcaacgcctatatggcgactaacgactgttccaatgacagcatcacttggcagcttgaggccgcagtcctccatgtccccgggtgcgtcccgtgcgagaaaatggggaacacatcacggtgctggataccagtctcaccaaacgtggctgtgcggcagcctggcgccctcacgcggggcttgcggacgcacatcgacatggtcgtgttgtccgccacgctctgctccgctctctacgtgggggacctctgtggcggggtgatgctcgcgtcccagatgttcattgtctcgccgcagcaccactggttcgtgcaggaatgcaattgctccatctaccctggcgccatcactgggcaccgtatggcatgggacatgatgatgaactggtcgcccacgaccaccatgatcctggcgtacgtgatgcgcgttcccgaggtcatcatagacatcattagcggagctcactggggcgtcatgtttggcctggcctacttctctatgcagggagcgtgggcgaaggtcgttgtcatcctcctgctggcctctggggtggacgcgtacaccaccacgactgggagcgctgctgggcgcactaccagtagcctggccagcgccttctcccctggcgctcggcagaacattcagctcattaataccaatggtagctggcacatcaaccgcaccgccctgaattgcaacgattccttgcacaccggcttcttcacggccctgttctacatccataagttcaactcgtcgggatgtcccgagcgcctgtccgcctgtcgcaacatcgaggacttccggataggatggggcgccctgcaatacgacgacaatgtcaccaatccagaagatatgaggccatattgctggcactacccaccaaaacagtgtggcgtagtccccgcagggaccgtgtgcggcccagtgtactgtttcacccctagcccggtggtagtgggcacgaccgatagacttggagtgcctacttacacgtggggagagaatgagacagatgtcttcctattgaacagcacccgaccaccgtcggggtcatggtttggctgcacgtggatgaactccactggcttcaccaagacctgcggcgcaccaccctgccgcactagagctgacttcaataccagcacagatctgttgtgccccacggactgttttagaaaacatcctgaagccacttacatcaaatgtggttccgggccttggctcacgccaaagtgtctggttgactacccctacaggctctggcattacccttgcacagtcaattactccaccttcaagatcaggatgtatgtggggggagttgagcacaggctcatggccgcgtgcaatttcactcgtggggatcgctgcaacttggaggatagggacagaagtcaacagactcctctgttgcactccaccacggaatgggccattttgccctgctctttctcagacttgcccgctttgtcgactggtcttctccacctccaccaaaatatcgtggacgtacaatatatgtatggcctgtcacctgccctcacacaatatatcgttcgatgggagtgggtagtactcttattcctgctcctagcggacgccagggtctgcgcctgcttgtggatgctcatcttgctgggccaagccgaagcagcactggagaagctggtcgtcttgcacgctgcgagcgcagctagctgcaatggcttcctgtattttgtcatctttctcgtggctgcttggcacatcaagggtagggtggtccccttggctgcttattcccttactggcctgtggccgttctgcctactgctcctagcactgccccagcaggcttacgcctatgatgcatctgtgcacggacaggtgggcgcggctttgctagtactgattaccctctttacactcaccccggggtataagacccttctcagccagtccctgtggtggttgtgctatctcctgaccctggcggaaaccatggtccaggagtgggcaccatccatgcaggcgcgcggcggccgtgatggcatcatatgggccgccaccatattttgcccgggcgtagtgtttgacataaccaagtggctcttagcggtgcttgggcctggttacctcctaagaggtgctttgacgcgcgtgccatatttcgtcagagcccacgctctgctgagaatgtgcactatggtgaggcacctcgcggggggtaggtacgtccagatggcgctattagcccttggcaggtggactggcacttacatctatgaccacctcacccctatgtcggattgggctgctagcggcctgcgggacttggcggtcgctgtggagcctatcatcttcagtccgatggagaagaaagtcatcgtttggggagcggagacggctgcgtgcggggacatcttgcacggacttcccgtgtccgcccgactcggtcgggagatcctccttggcccagctgatggctacacctccaaggggtggaagcttctcgcccccatcaccgcttacgcccagcagacacgaggtctcttgggctctatagtggtgagcatgacggggcgtgacaagacagaacaggccggggaggtccaagtcctgtccacagtcactcagtccttcctcggaacatccatttcgggggtcttatggactgtttaccacggagctggcaacaagacactagccggctcgcggggcccggtcacgcagatgtactcgagcgccgagggggacttggtcgggtggcccagccctcctgggaccaaatctttggagccgtgtacgtgtggagcggtcgacctgtatttggtcacgcggaacgctgatgtcatcccggctcgaagacgcggggacaagcggggagcgctgctctccccgagacccctttcgaccttgaaggggtcctcggggggacctgtgctttgccctaggggccacgctgtcggaatcttccgggcagctgtgtgctctcggggtgtggctaagtccatagatttcatccccgttgagacgctcgacatcgtcacgcggtctcccacctttagtgacaacagcacaccaccagctgtgccccagacctatcaggtggggtacttgcacgcccccactggcagtggaaaaagcaccaaggtccccgtcgcgtacgccgcccaggggtataaagtgctggtgctcaatccctcggtggctgccaccctgggatttggggcgtacttgtccaaggcacatggcatcaaccccaacattaggactggagtcagaactgtgacgaccggggagcccattacatactccacgtatggtaaattcctcgccgatgggggctgcgcaggcggcgcctatgacatcatcatatgcgatgaatgccactctgtggatgctaccactattctcggcatcgggacagtccttgaccaagcagagacagccggggtcaggctaactgtactggccacggccacgccccccgggtcggtgacaaccccccatcccaatatagaggaggtagccctcggacaggagggtgagatccccttctatgggagggcgtttcccctgtcttacatcaagggagggaggcacttgattttctgccactcaaagaaaaagtgtgacgagctcgcaacggcccttcggggcatgggcttgaacgctgtggcatattacagagggttggacgtctccataataccaactcaaggagatgtggtggtcgttgccaccgacgccctcatgacggggtatactggagactttgactccgtgatcgactgcaacgtagcggtcacccaggccgtagacttcagcctggaccccaccttcactataaccacacagactgtcccgcaagacgctgtctcacgtagtcagcgccgagggcgcacgggtagaggaagactgggcatttataggtatgtttccactggtgagcgagcctcaggaatgtttgacagtgtagtactctgtgagtgctacgacgcaggagctgcttggtatgagctctcaccagtggagacgaccgtcaggctcagggcgtatttcaacacgcctggcttgcctgtgtgccaggaccaccttgagttttgggaggcagttttcaccggcctcacacacatagacgctcatttcctttcccagacaaagcagtcgggggaaaatttcgcatacttagtagcctatcaggccacagtgtgcgccagggccaaagcgccccccccgtcctgggacgtcatgtggaagtgcttgactcgactcaagcccacgcttgtgggccctacacctctcctgtaccgtttgggctctgttaccaacgaggtcacccttacacaccccgtgacaaaatacatcgccacatgcatgcaagctgacctcgaggtcatgaccagcacgtgggtcctggctgggggagtcttagcagccgtcgccgcgtattgcttagcgaccgggtgtgtttccatcattggccgtttacacatcaaccagcgagctgtcgtcgctccggacaaggaggtcctctatgaggcttttgatgagatggaggaatgtgcctccagagcggctctccttgaagaggggcagcggatagccgagatgctgaagtccaagatccaaggcttattgcagcaagcctctaaacaggcccaggacatacaacccgctgtgcaagcttcgtggcccaagatggagcaattctgggccaaacatatgtggaacttcataagcggcattcagtacctcgcaggactgtcaacactgccagggaaccctgctgtggcttccatgatggcattcagcgccgccctcaccagtccgttgtcaactagcaccaccatccttcttaacattctggggggctggctggcgtcccaaattgcgccacccgcgggggccactggctttgttgtcagtggcctggtgggagctgctgttggcagcataggcttgggtaaagtgctggtggacatcctggcagggtatggtgcgggcatttcgggggccctcgtcgcgtttaagatcatgtctggcgagaagccctccatggaggatgtcatcaacttgctgcctgggattctgtctccaggtgctctggtggtgggagtcatctgcgcggccattctgcgccgccatgtgggaccgggggaaggcgcggtccaatggatgaacaggcttatcgccttcgcttccagaggaaaccacgtcgcccctactcactacgtgacggagtcggatgcgtcgcagcgtgtcacccaactgcttggctctctcactataactagtctactcaggagacttcacaactggatcactgaggattgccccatcccatgcgccggctcgtggctccgcgatgtgtgggactgggtctgtaccatcctaacagactttaagaactggctgacctccaagctgttcccaaagatgcctggcctcccctttatctcttgccaaaaggggtacaagggcgtgtgggccggcactggcatcatgaccacacgatgcccctgcggcgccaacatctctggcaacgtccgcttgggctctatgagaatcacaggacccaaaacctgcatgaacacctggcaggggacctttcctatcaattgttatacagaaggccagtgcttgccgaaacccgcgttaaacttcaagaccgccatctggagagtggcggcctcagagtacgcggaagtgacgcagcacggatcatatgcctatataacagggctgaccactgacaacttaaaagtcccttgccaactcccctctccagagtttttctcttgggtggacggagtacaaatccataggtccgcccccacaccaaagccgtttttccgggatgaggtctcgttcagcgttgggctcaattcatttgtcgtcgggtctcagcttccctgtgaccctgagcccgacactgaggtagtgatgtccatgctaacagacccatcccatatcacggcggaggctgcagcgcggcgtttagcgcgggggtcacccccatctgaggcaagctcctcagcgagccagctgtcggcgccatcgctgcgagccacctgcaccacccacggtaggacctatgatgtggacatggtggatgccaacctgttcatggggggcggcgtgattcggatagagtctgagtccaaagtggtcgttctggactccctcgactcaatgaccgaggaagagggcgaccttgagccttcagtaccatcggagtatatgctccccaggaagaggttcccaccggccttaccggcttgggcgcggcctgattacaacccaccgcttgtggaatcgtggaagaggccagattaccaaccacccactgttgcgggctgtgctctccccccccccaaaaagaccccgacgcctcctccaaggagacgccggacagtgggtctgagcgagagcaccataggagatgccctccaacagctggccatcaagtcctttggccagccccccccaagcggcgattcaggcctttccacgggggcggacgccgccgactccggcgatcggacaccccctgacgagttggctctttcggagacaggttctacctcctccatgccccccctcgagggggagcctggggacccagacctggagcctgagcaggtagagcttcaacctcctccccaggggggggaggcagctcccggctcggactcggggtcctggtctacttgctccgaggaggatgactccgtcgtgtgctgctccatgtcatattcctggaccggggctctaataactccttgtagccccgaagaggaaaagttgccaattaactccttgagcaactcgctgttgcgataccataacaaggtatactgtactacatcaaagagtgcctcactaagggctaaaaaggtaacttttgataggatgcaagtgctcgacgcctattatgattcagtcttaaaggacatcaagctagcggcctccaaggtcagcgcaaggctcctcaccttagaggaggcgtgccaattgaccccaccccactctgcaagatccaagtatgggtttggggctaaggaggtccgcagcttgtccgggagggccgtcaaccacatcaagtccgtgtggaaggacctcttggaagactcacaaacaccaattcctacaaccatcatggccaaaaatgaggtgttctgcgtggaccccgccaaggggggtaaaaaaccagctcgccttatcgtttaccctgacctcggcgtcagggtctgcgagaagatggccctttatgatgtcacacaaaagcttcctcaggcggtgatgggggcttcttatggcttccagtactcccccgctcagcgggtggagtttctcttgaaggcatgggcggaaaagagagaccctatgggtttttcgtatgatacccgatgctttgactcaaccgtcactgagagagacatcaggactgaggagtccatataccaggcctgctccttacccgaggaggcccgaactgccatacactcgctgactgagagactctatgtgggagggcccatgttcaacagcaagggccagtcctgcgggtacaggcgttgccgcgccagcggggtgcttaccactagtatggggaacaccatcacatgctatgtaaaagccctagcggcttgcaaggctgcggggataattgcgcccacgatgctggtatgcggcgacgacttggtcgtcatctcagaaagccaggggactgaggaggacgagcggaacctgagagccttcacggaggctatgaccaggtattctgcccctcctggtgacccccccagaccggaatatgacctggagctaataacatcttgttcctcaaacgtgtctgtggcacttggcccacagggccgccgcagatactacctgaccagagaccccaccacttcaattgcccgggctgcctgggaaacagttagacactcccctgtcaattcatggctgggaaacatcatccagtacgctccaaccatatgggttcgcatggtcctgatgacacacttcttctccattctcatggcccaggacaccctagaccagaaccttaactttgaaatgtacggatcggtgtactccgtgagtcctctggacctcccagccataattgaaaggttacacgggcttgacgccttctctctgcacacatacactccccacgaactgacgcgggtggcttcagccctcagaaaacttggggcgccacccctcagagcgtggaagagtcgggcgcgtgcagttagggcgtccctcatctcccgtggggggagggcggccgtttgcggtcggtacctcttcaactgggcggtgaagaccaagctcaaactcactcctttgccggaggcacgcctcctggatttgtccagttggtttaccgtcggcgccggcgggggcgacatttatcacagcgtgtcgcgtgcccgaccccgcctattactccttagcctactcctactttctgtaggggtaggcctcttcctactccccgctcgatagagcggcacacattagctacactccatagctaactgttccttttttttttttttttttttttttttttttttttttttctttttttttttttttccctctttcttcccttctcatcttattctactttctttcttggtggctccatcttagccctggtcacggctagctgtgaaaggtccgtgagccgcatgactgcagagagtgccgtaactggtctctctgcagatcatgt

SEQ ID NO: 577 - DNA, 9659 bp, Hepatitis C Virus
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaactcctaaacctcaaagaaaaaccaaaagaaacactaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaagtcctggggaaaaccaggatacccttggcccctgtatgggaatgaggggctcggctgggcaggatggctcctgtccccccgaggttctcgtccctcttggggccccaatgacccccggcacaggtcgcgcaacgtgggtaaagtcatcgacaccctaacgtgcggctttgccgacctcatggggtacatccccgtcgtaggcgccccgcttggcggcgtcgccagagctctcgcgcatggcgtgagagtcctggaggacggggttaattttgcaacagggaacttgcctggttgctctttttctatcttcttgctggctctgctgtcctgcatcaccacaccggtctctggcgcccaagtgaggaacaccagttccagctatatggtggccaatgactgtgctaatgacagcatcacctggcagctcgacgctgcggtcctccacgtccccgggtgcgtcccgtgcgagaaggtgggggacacatctcggtgctggataccggtttcaccaaacgtggccgtgcggcagcccggtgccctcacgcgaggcttgcggacgcacatagacatggtggtaatgtccgccacgctctgctccgctctctacgtgggggacctttgtggtggggtgatgctcgcagcccagatgttcattgtctcgccacagcgccactggtttgtgcaagaatgcaattgctccatctaccccggtcacgtcagtggacaccgcatggcatgggacatgatgatgaactggtcgcccacggctaccatgattctggcgtacgtgatgcgcgtccccgaggtcatcatagacatcattagcggggctcactggggcgtcatgtttggcttggcctacttctctatgcagggagcgtgggcgaaagtcgttgtcatccttctgctggccgctggggtcgacgcgggcacctatgctgttgggggttctaccgcgcacaccaccaaaggcatcgccagcttcttctcccctggcgcccggcagaacatccagctcattaacaccaatggcagttggcacatcaaccgcactgccctgaactgcaatgaatccctgaacaccggctttcttgcggccctgttctacgccaaccgcttcaactcgtcaggatgtcctgaacgcctgtccgcctgccgtaatatcgaggacttccggataggatggggcacattgcaatacgagaataatgtcaccaattcagaggatatgagaccatattgctggtactacccaccaagacagtgtggcatagtccccgcgaggtctgtatgtggcccagtgtactgtttcacccccagcccagtagtagtgggcacgaccgacagactcggagtgcctacctacacgtggggagagaatgagacagatgtcttcctattgaacagcacccgaccaccgtcgggctcgtggttcggctgcacgtggatgaactccactggtttcaccaaaacatgcggtgcaccaccttgccgcattagagctgacttcaacgccagcgcggacctgttgtgccccacggactgttttaggaagcatcctgacgccgcttacttcagatgtggctctgggccctggctcacgccaagatgtttggtcgattacccctacaggctctggcattacccctgcacagttaactataccatcttcaaaataaggatgtatgtggggggagttgagcacaggcttgcggctgcatgcaacttcactcgcggggatcgttgcgacttggaggacagagacaggagtcaactgtctcctttgttgcactccaccacggaatgggccattttaccctgcacttactcagacctgcccgctttgtcgaccggtcttctccacctccaccaaaacatcgtggatgtacaatacatgtatggcctgtcacctgctcttacaaaatacatcgttcgatgggagtgggttgtactcttattcctgctcctagcggacgccagggtttgcgcctgcgtatggatgctcattttgctaggccaggccgaagcagcactagagaagctagtcgtcttgcacgccgcgagcgcggccagctgcaatggcttcctatattttgtcatcttcttcgtggctgcttggtacatcaagggccgggcggtccccttggctacctattccctcaccggtctatggtctttctgcctactgctcctggcattgccccaacaggcttatgcgtatgatacatctgcgcacggacagataggcgcgactctgctaatactgattactctctttacactcaccccggcgtataagacccttgtcagccggtttttatggtggctgtgctatcttctgaccctgggggaagccatggtccaggagtgggcaccacctttgcaggtgcgcggtggccgtgatggcatcatatgggccgccgccatattctgcccgggcgtggtgtttgacataaccaagtggctcctagcgttgcttgggcctgcttatctcctaagagatgctttgacgcgtgtgccgtacttcgtcagagctcacgctctgctgaggatatgcactatggtaaggcatctcgcggggggtaggtacgtccagatggcgctactagcccttggtaggtggactggcacttacatctatgaccacctcagccccatgtcggattgggctgccaatggcctgcgggacttggcggtcgcagtggagcctatcatcttcagtccgatggagaagaaagtcatcgtctggggagcggagacggctgcatgtggggacatactacacggacttcccgtgtctgcccgacttggtcgggaggtcctccttggcccagctgatggctacacctccaaggggtggagtcttctcgcccccatcactgcttacgcccagcagacgcggggtcttttgggcgctatagtggtgagcatgacggggcgcgacaagacagaacaggccggggaaattcaggtcctgtctacagtcactcagtccttcctcggaacatccatcgcgggggtcttatggactgtctatcatggggctggcaacaagaccttagctggctcacggggtccagtcacgcagatgtactccagtgccgagggggacttggtggagtggccctcccctcctgggactaagtctttggagccgtgcacgtgtggagcggtcgacctgtacctggtcacgcggaacgctgacgtcatcccggctcgaagacgtggggacaagcggggagcactactctccccgagaccactttcgaccttaaaagggtcctcgggggggccggtgctttgccccaggggccacgctgtcgggatcttccgggcagctgtgtgctctcggggcgtggctaagtccatagatttcatccccgttgagacactcgacatcgtgacgcggtcccccacctttagtgacaacagcacaccacctgctgtgccccagacctatcaggtcgggtacttacatgccccgactggtagtggaaagagcaccaaagtccctgtcgcttacgccgcccaggggtataaagtgctagtgctcaatccctcggtggccgccaccctgggattcggggcgtacctgtccaaggcacatggcatcaatcccaatatcaggactggagtcaggactgtgacgaccggagcggccatcacgtactccacatacggcaaattcctcgccgatgggggctgctcgggcggcgcttatgatatcatcatatgcgatgagtgccattccgtggatgctaccaccatcctcggcatcggaacagtcctcgaccaagcagagacagccggggtcaggtcaactgtgctggctacggccacgccccctgggtcggtgacaaccccccaccccaatatagaggaggtggccctcgggcaggagggtgagattcccttctacgggagggcgattcccctgtcttacatcaagggagggagacacctgatcttctgccactcaaagaaaaagtgtgacgagctcgcggcggcccttcggggtatgggcttgaacgcagtggcatactacagagggttggacgtatccataataccaactcagggggatgtggtggtcgtcgccaccgacgccctcatgacaggatacactggggactttgactctgtgatcgactgcaacgtagcggtcactcaagttgtagacttcagtttggacccgaccttcactataaccacacagaccgtccctcaagacgccgtctcacgtagccagcgccgggggcgtacgggtaggggaagactgggcatttataggtacgtgtccactggtgagcgagcctcgggaatgtttgacagcgtagtgctcagtgagtgctacgactcaggggccgcatggtacgagctcacaccagcggagaccaccgtcaggctcagagcgtacttcaacacacctggcttgcctgtgtgccaagaccatcttgagttttgggaggcagttttcaccggccttacacacatagatgcccacttcctttcccaaacaaagcaagcgggggacaatttcgcatacctaacagcctaccaggctacagtgtgtgccagggccaaagcccctccgtcgtcctgggacgtcatgtggaagtgcttgactcgactcaagcccacgctcgtgggccctacacctctcctgtaccgtttgggccctgtcaccaacgaggtcactctcacacatcctgtgacgaaatacatcgccacttgcatgcaagccgaccttgaggtcatgaccagcacgtgggtcttggctgggggagtcttggcggccgtcgctgcgtattgcttagcgaccgggtgtgtttccatcatcggccgcttgcacatcaaccagagagctgtcgttgcaccagacaaagaggtcctctatgaggcttttgatgagatggaggagtgtgcctctagagcggccctcattgaagaggggcagcggatagccgagatgctgaagtccaaaatccaaggtctattgcagcaagcctccaaacaagcccaagacatacaacccgccgtgcaggcttcatggcccaaggtggagcagttctgggccaaacacatgtggaacttcactagcggcattcaataccttgcaggactgtcaacactgccagggaaccccgctgtggcctccatgatggcattcagtgccgccctcaccagtccgttgtcaactagcaccactatccttctcaacattttgggaggctggctggcgtcccaaatcgcgccacccgcaggggccactggcttcgtcgtcagtggcctggtgggggctgccgtaggcagcataggcttgggtaaggtgctggtggacatcctggcagggtatggtgcgggcatctcgggagctctcgtcgcattcaagatcatgtctggcgagaagccctccatggaggacgtcgtcaacctgctgcctggaattctgtctccgggtgctttggtggtgggagtcatctgcgcggccattctacgccgccacgtgggaccgggggaaggcgcagtccaatggatgaacaggctcattgccttcgcttccagaggaaaccacgtcgcccccacccactacgtgacggagtcggatgcgtcgcagcgcgtgacccaactactcggctcccttaccataactagtctgcttagaagactccacaattggattaccgagggctgccccatcccgtgcagcggctcgtggctccgcgatgtatgggactgggtctgcaccatcttaacagactttaaaaactggctgacctctaaattgttcccaaagatgcctggcctcccctttgtctcttgccaaaaggggtacaagggcgtatgggccggcactggtatcatgaccacacggtgtccttgcggcgccaatatctctggcaatgtccgcctgggctccatgagaatcacagggcctaagacctgcatgaacacctggcaagggacctttcccatcaattgctacacggggggccagtgtgtgccgaagcccgcgccaaacttcaagaccgccatctggagggtggcggcctcagagtacgcggaggtgacgcaacacgggtcatactcctatataacaggactgaccacagacaacctgaaagttccttgccaactaccttctccagagttcttttcctgggtggacggagtgcagatccacaggttcgcccccacaccgaagccgtttttccgggatgaggtctcgttttgcgtcgggcttaactcatttgtcgtcgggtctcagcttccttgtgaccctgaacccgacacagacgtattaatgtccatgctaacagatccatctcatatcacggcggagaccgcagcgcggcgcttggcgcgggggtcacccccatctgaggcaagctcctcagcgagccagttatcggcgccatcgctgcgagccacctgcaccacccacggcaagacccatgatgtggacatggtggatgccaacctattcatggggggcgatgtcactcggatagagtccgagtccaaagtggtcgttctggactctctcgatccaatggtcgaagaagagggcgacctcgagccttcgataccatcagagtacatgctccccaaaaagaagtttccaccagccttaccgccttgggcgcggccagactacaacccaccgcttgtggaatcacggaagaagccagactatcaaccgcccactgttgcgggctgtgctctccccccccctaagaagaccccgacgccccccccaaggaggcgccggacagtgggtctgagtgagagcaccataggggatgccctacaacagctggctattaaggcttttggccagccccccccaagcggagattcaggcctgtccacgggggcggacgccgccgactccggcagtcggacgccccctgatgagtcggctctttcggagacaggttccatctcctccatgccccccctcgagggggagcctggagatccagacctggagcctgagcaggtagagcgtcaacctcccccccaggggggggaagtagctcccggctcggactcggggtcctggtccacttgctccggcgaggacgactccgtcgtgtgctgctccatgtcatactcctggaccggggctctaataactccttgtagccccgaagaggaaaagttaccgattaaccctttgagcaactcgctgttgcgataccacaacaaggtgtactgtaccacatcaaagagcgcctcactgagggctaaaaaggtaacttttgataggatgcaagtgctcgacgcctattacgactcagtcttaaaggacatcaagctagcggcctccaaggtcactgcaaagctcctcaccttggaggaggcatgccagttaaccccaccccactctgcaagatccaagtacgggtttggggctaaggaggtccgcagcttgtccgggagggccgttaaccacatcaagtccgtgtggaaggacctcctggaggactcacaaacaccaattcccacaaccatcatggccaaaaatgaggtgttctgcgtggaccccaccaaagggggtaagaaagcagctcgccttatcgtttaccctgacctcggcgtcagggtctgcgagaagatggccctttatgatgtcacacaaaaactccctcaggcggtaatgggggcttcttatggattccagtactcccccgcccagcgggtggagtttctcttgaaggcatgggcggaaaagaaagaccctatgggtttttcgtatgatacccgatgctttgacacaaccgtcaccgagagagacatcaggactgaggagtccatataccgggcctgttccctgcccgaggaggcccacactgccatacactcgctaactgagagactttacgtgggagggcctatgtttaacagcaagggccagtcctgcgggtacaggcgttgccgcgccagtggggtgctcaccactagcatggggaacaccatcacgtgctacgcaaaagccctagcggcctgcaaggctgcagggatagttgcgcccacaatgctggtatgcggcgacgacttggttgtcatctcagaaagccaggggaccgaggaggatgagcggaacctgagagccttcacggaggctatgaccaggtattctgcccctcctggcgacccccccagaccggaatatgacttggagctgataacatcttgttcctcaaatgtgtctgtggcgttgggcccacaaggccgccgcagatactacctgaccagagaccctaccactccaatcgcccgggctgcctgggaaacagttagacactcccctgccaattcatggctgggaaacatcatccagtacgccccgaccatatgggctcgcatggtcctgatgacacacttcttctccatcctcatggcccaagacactctggaccagaacctcaattttgagatgtatggagcggtgtactccgtaagtcctttggacctcccagccataattgaaaggttacacgggctcgacgctttctctctgcacacatactctccccacgaactgacgcgggtggcttcagccctcagaaaacttggggcgccacctctcagagcgtggaagagtcgggcgcgtgcagtcagagcgtccctcatctcccgtggagggagagcggccgtttgcggtcggtatctcttcaattgggcggtgaaaaccaagctcaaactcactccattgccggaggcgcgcctcctggatttatccagctggttcaccgtcggcgccggcgggggcgacatttatcacagcgtgtcgcgtgcccgaccccgcttattactccttagcctactcctactttccgtaggggtaggcctcttcctactccccgctcggtagagcggcacacattagctacactccatagctaactgttcctttttttttttctttttttttttttttttttttttttttccttctttctttctttcttaccttactttactttcttttctggtggctccatcttagccctagtcacggctagctgtgaaaggtccgtgagccgcatgactgcagagattgccgtaactggtatctctgcagatcatgt

SEQ ID NO: 578 - DNA, 9678 bp, Hepatitis C Virus
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagaccgctagccgagtagcgttgggttgcgaaaggccttgtggtactgcctgatagggtgcttgcgagtgccccgggaggtctcgtagaccgtgcaccatgagcacaaatcctaaacctcaaagacaaaccaaaagaaacaccagccgtcgcccacaagacgttaggtttccgggcggcggccagatcgttggcggagtatacttgttgccgcgcaggggccccaggttgggtgtgcgcgcgacaaggaagacttcggagcggtcccagccacgtgggaggcgccagcccatccccaaagatcggcgctccactggcaagtcctggggaagaccaggatacccttggcccctatatgggaatgagggactcggctgggcaggatggctcctgtccccccgaggttcccgcccctcttggggccccaatgacccccggcataagtcgcgcaacgtgggtaaggtcatcgataccctaacgtgcggctttgccgacctcatggggtacatccccgtcgtaggcgccccgcttggtggcgttgccagagctctcgcgcacggcgtgagagtcttggaggacggggttaactatgcaacagggaacctacctggttgctctttttctattttcttgctggcactactgtcttgcatcactgtcccggtctctgctgtccaagtgaagaacaccagtgacatctacatggtgactaatgactgttccaatgacagcatcacctggcagctccagaccgcggtcctccacgttcccgggtgcgtcccgtgtgaaagaatgggagatacatcacggtgctggataccggtctcaccaaacgtggctgtgcggcagcgcggcgccctcacgcagggcttgcggacgcacatcgacatggttgtgatgtccgccacactctgctctgccctttacgtgggggacttctgcggagggctgatgctcgcagcccagatgtttgttgtctcgccacagcaccattggtttgtgcaagaatgcaattgctccatctatcctggcaccatcactggacatcgtatggcatgggacatgatgatgaactggtcgcccacgaccaccatgatcctcgcgtacgcgatgcgtgttcccgagaccatcgtggacatcattagcggggctcactggggcgtcatgttcggcctggtctatttctccatgcaaggagcgtgggcgaaggtcgctgtcatccttctgttgaccgctggggttgacgcgcacaccgtcacagttgggggtagcgccgggttcaccacctcaagcctcaccgcccttttcgttcgtggcccccagcagaaaattcagctcattaacaacaatggcagttggcacatcaacagcactgccctgaattgcaatgactccttgcagaccggcttcatcgcgtccctgttctacgccaagaacttcaactcgtcaggatgtcccgaacgcatgtccgcctgccgtaatatcgaggccttccggataggatggggcgccttgcagtatgaagataatgtcaccaacccagaggatatgagaccatactgctggcattatccaccaaaacagtgtggcatagtccccgcgaggtctgtgtccggcccagtgtactgtttcacccccagcccagtggtagtgggcacgaccgacaaacttgaagcgcctacttacacgtggggagagaatgagacagatgtcttcttgttgaacagcacccgaccgccgcaggggtcatggttcggctgtacgtggatgaactccaccggtttcaccaagacttgtggcgcaccaccttgccgcactagagccgacttcaatgccagcacggacctgttgtgccccacggactgttttaggaagcatcctgaggccacttacatcaaatgtggttctgggccatggctcacgccaaggtgcctggttgactacccctacaggctctggcattacccttgcacagtcaactacaccgtcttcaagataaggatgtatgtggggggggttgagcacaggctcacggccgcgtgcaattttactcgtggggaccgttgcaacttggaggacagggacagaagtcaactgtctcctttgctgcactccaccacggaatgggccattttgccctgttcttactcagacttgcccgctttgtcaactggccttcttcacctccaccaaaatatcgtggatgtgcaatacatgtatggtctgtcacctgccctcacaaaatatgtcgttcgttgggagtgggtagtactcctgttcctgctcctagcggacgccagggtctgcgcctgcctgtggatgctcatcttgttgggacaggccgaggcagcattagagaagctggttgtcttgcacgctgcgagcgcagctagctgcaatggcttcctgtattttgtcatctttttcatagctgcttggcacatcaagggtcgggcggtccccttggctgcctattccctcactggcctatggcctttctgcctattgctcctagcactgccccaacaggcttatgcctatgacgcatctgcgcatggacagataggtgaggccttgctggtgttgatcaccctctttacactcaccccggggtataagatccttctcagccggtccctgtggtggttgtgctatctcctgaccctaggggaagccatggtccaggaatgggcaccatccatgcaggcgtgtggtggccgtgatggcatcatatgggtcgccaccatactttgcccgggcgtggtgtttgacataaccaagtggctcttggcggtgcttgggtctagttatctcctaagagacgctctaacacgtgtgccgtatttcgtcagggctcacgctctgctgaggatgtgcacgatggtgaggcgccttgcgggaggtaggtatgtccagatggcgctattagcccttggtaggtggaccggcacttacatctatgaccacctcacccctatgtcggactgggctgctagcggcctgcgggacttggcggtcgctgtggagcccatcatctttagtccgatggagaagaaggtcattgcctggggagcggagacggccgcatgcggggatatcctacacggactccccgtgtccgcccgactcggtagggagatcctccttggcccagctgatggctacacctccaaggggtggaggcttctcgcccccatcactgcttacgcccagcagacacggggtctcttgggcaccatagtggtgagcatgacggggcgcgacaagacagaacatgccggggaaatccaagtcttgtccacagtcactcagtccttcctcggaacatccatctcgggggtcctgtggactgtttatcacggagctggcaacaagaccctagccagctcacggggcccggtcacgcagatgtactcgagtgccgagggggatctggtagggtggcccagccctcctgggaccaaatctttggagccgtgtacgtgtggagcggtcgacctctacctggtcacgcggaacgctgacgtcatcccgtctcgaagacgcggggacaagcggggggcgttactatccccgagacccctttcgagcttgaaggggtcctcggggggaccggtgctctgccccaggggccacgctgtcgggatcttccgggcagctgtgtgctctcggggcgtggctaagtccatagatttcatccccgttgaggcacttgacatcgccacgcggtctcccacctttagtgacaacagcacaccgccagctgtgccccagacctatcaggtcgggtacctgcatgccccgactggcagtggaaagagtaccaaagtccctgtcgcttacgccgcccaggggtataaagtgctagtgcttaatccctcggtggctgccaccttggggttcggggcatacttgtccaaggcacatggtatcaatcccaatataaggactggagtcagaactgtgacgactggggagcccatcacatactccacgtacggcaaattcctcgctgatgggggctgcgcaggcggcgcctatgacatcatcatatgcgacgaatgccatgctgtggatgctaccaccattctcggcatcggaacagttcttgaccaagcagagacagccggggtcaggctaactgtgctggccacggccacgccccccgggtcggtgacaactcctcaccccaatatagaggaggtagccctcggccatgagggtgagatctccttctatgggaaggcaattcccctgtcttacatcaagggagggagacatttgatcttttgccactcaaagaaaaagtgtgacgagctcgcggtggctcttcggaacatgggcttgaacgctgtggcgtattacagagggttggacgtctccataataccagctcaaggagatgtagtggttgtcgccaccgacgccctcatgacggggtatactggagactttgactccgtgatcgactgcaacgtagcggtcactcaagtcgtagacttcagcctagaccccaccttcactataagcacacagactgtccctcaagacgctgtctcacgtagtcagcgccgggggcgcacaggtagagggagactgggtatttataggtatgtttccaccggtgagcgagcctcaggaatgtttgacagtgtagtgctctgtgagtgctacgatgcgggggctgcatggtatgagctcacaccatcggaaactaccgttaggcttagagcgtatttcaacacgcctggcttgcccgtgtgccaagaccatcttgagttttgggagggagttttcaccggcctcacacacatagatgcccacttcctctcccagacgaagcagtcgggggagaacttcgcatacctagtagcctatcaggctacggtgtgcgctagagccaaagcccctcccccgtcctgggacgtcatgtggaagtgcttgactcggctcaagcccacgctcgtgggccctacacctctcctgtaccgactgggccctgttaccaacgaagtcaccctcacacatcctgtgacaaagtacgttgccacatgcatgcaagctgacctcgaggtcatgaccagcacgtgggtcctggccggaggagtcttggcggccgtcgccgcgtattgcttggcgaccgggtgtgtttccatcatcggccgtttgcatatcaaccagcgagctgtcgtcgcaccggacagggaggtcctctatgaggcttttgacgagatggaggaatgtgcctctagagcggctctcattgaggaggggcagcgcatagctgagatgctgaagtccaagatccaaggcttgctgcagcaagcctctaaacaggcccaagacatacaacccgccgtacaggcttcatggcccaagatggaacaattctgggccaaacacatgtggaacttcattagcggcattcaatacctcgcaggactgtcaacactgccagggaaccccgctgtggcttccatgatggcattcagtgccgcactcaccagtccgttatcaaccagcaccactatccttctcaacattttgggaggctggttggcgtcccaaattgcgccgcccgcgggggccactggtttcgtcgtcagtggcctggtaggggctgccgtgggcagcgtaggcctgggtaaggtgctggtggacatcctggcagggtatggtgcgggcatctcaggggccctcgtcgcattcaagatcatgtctggcgaaaagccctcgatggaggatgtcgtcaacttgctgcccgggattctgtctccgggtgccctggtagtgggagtcatctgcgcggccattctgcgccgccacgtgggaccgggagaaggcgcggtccaatggatgaacaggctcatagcctttgcgtccagaggaaaccacgtcgcccctacccactatgtgacggagtcggatgcgtcgcagcgtgtaacccaactgcttggctcccttaccataactagcctgctcagaagactccacaattggattactgaggattgccccatcccgtgcgccggctcatggctgcgcgatgtatgggactgggtttgcaccatcctaacagactttaaaaactggctggcctccaagttgttcccaaggctgcccggcgtcccctttatctcttgccaaaaggggtataggggcgtgtgggccggcaccggcatcatgaccacacgatgtccttgcggcgccaacatctctggcaatgtccgcctgggctccatgagaatcacagggcctaaaacctgcatgaacacctggcaggggacttttcccatcaattgttacacggagggccagtgcatgccgaagcccgcaccaaactttaagaccgccatctggagggtggcggcctcagagtacgcggaggtgacgcggcacggatcatactcctatataacaggactgaccaccgacaatttgaaggtcccttgccaaataccttctccagagttcttctcttgggtggacggagtgcaaatccacaggtttgctcccacaccaaagccgtttttccgggatgaggtctcgttctgcgtcgggctcaactcattcgttgtcgggtctcaacttccttgcgatcctgagcccgacgctgacgtgttgacgtccatgctaacggatccgtcccatataacggcggaggccgcagcgcgtcgcttagcgcgggagtcccccccatctgaggcaagctcctcagcgagccagctatcggcagcatcgctgcgagccacatgcaccacccacggcaaggcctatgatgtggacatggtggatgccaacttgttcatgaggggcgatgtgactcggatagagtctgagtccaaagtggtctttctggactatctcgacccagtggtcgaagaagagcgcgacctggagccctcgataccatcggagtatttgctccctaagaacaagttcccaccagccctaccactttgggcacgacctgattacaatccaccgcttgtggagtcgtggaagaggccagattaccaaccgcccactgttgcgggctgtgctctccccccccccaagaagaccccgacgcctcccccaaggagacgccggacagtgggtttgagcgagagcaccattggagatgccctccaacagctggccgccaagaccttcggccagcccctccccagcggcgattcaggcctttccacgggggcgggcgccgccgactccggcggtcggacgccccgtgatgagttggctctctcggagacaggttctatctcctccatgccccctctcgagggggagcctggggatccagacctggagcctgagcaggtagagcttcaacctcccccccaggggggggaggcagctcccggctcggactcggggtcctggtctacttgctccgaggaggatgactctgtcgtgtgctgctccatgtcatactcctggaccggggctctaataactcccagtagccccgaagaggagaagttgccaattaaccccttgagcaactcactgttgcgataccacaacaaggtgtactgtaccacatcaaagagcgcctcacagagggctaaaaaggtaacttttgataggatgcaagtgcccgacgcccattatgactcagtcttaaaggacatcaagctagcggcctccaaggtcaacgcaaggctcctcacactggaggaggcctgccaattgacccaaccccactctgcaagatccaaatacggatttggggctaaggaggttcgcggcctggccgggagggccgttaaccacatcaagtccgtgtggaaggacctcctggaagactcacagacaccaattcctacgaccatcatggccaaaaacgaggtgttctgcgtggaccccaccaaggggggtaagaaagcagctcgtctcatcgtttaccctgaccttggcgtcagggtttgcgagaagatggccctttatgatgtcacacaaaagcttcctcaggcggtgatgggggcttcttatgggttccaatactcccccgctcaacgggtggagtttctcttgaaggcatgggcggagaagaaagaccccatgggtttttcgtatgatacccgatgctttgactcaaccgtcactgagcgagacatcagaactgaggagtccatataccaggcctgctccctgcaggaggaggcccgcaccgccatacgctcgctgactgagagactttacgtgggagggcccatgttcaacagcaagggccaggcctgcgggtacaggcgctgccgcgccagcggggtgctcaccactagcatggggaataccatcacatgctatgtgaaagccctagcggcttgcaaagctgcggggatagttgcgcccacaatgctggtatgcggcgacgacttggttgtcatctcagaaagccagggaactgaggaggatgaccggaacctgagagccttcacggaggctatgaccagatattctgcccctcccggtgacccccccagaccggaatatgacctggagctgataacatcttgctcctcaaatgtgtctgtagcgcttggcccacaaggccgccgcagatactacctgacaagagaccctaccactccaatcgcccgggctgcctgggaaacagttagacactcccctgtcaattcatggctgggaaacatcatccagtacgctccaaccatatgggttcgcatggtcctgatgacacatttcttttccattctcatggcccaagacaccctggaccagaacctcaactttgaaatgtacggatcggtgtactccgtgagtcctttggacctcccagccataattgaaaggttacacgggcttgacgccttttctctgcacacatactctccccacgagctgacgcgagtggcttcagccctcagaaaacttggggcgccacccctcagagcgtggaagagtcgggcgcgtgcagttagggcgtccctcatctcccggggggggagagcggccgtttgcggtcggtatctcttcaactgggcggtgaaaaccaagctcaaactcactccattgccggaggcacgcctcctggatttatccagctggtttaccgtcggcgccggcgggggcgacatttatcacaacgtgtcgcgcgcccgaccccgcttcttactccttagcctactcctactttctgtaggggtaggcctctttttactccccgctcggtagagcggcatacattagctacactccatagctaacagtttctctttttttttttttccttttttatttttatttttttttttttttttttttttttattttcttttcctttctttctcaccttacattactttctttcttggtggctccatcttagccctagtcacggctagctgtgaaaggtccgtgagccgcatgactgcagagagtgccgtaactggtctctctgcagatcatgt

SEQ ID NO: 579 - DNA, 9641 bp, Hepatitis C Virus
acccgcccctagtaggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttgggtaaacccactctatgcccggccatttgggcgtgcccccgcaagactgctagccgagtagcgttgggttgcgaaaggccttgtggtactgcctgatagggtgcttgcgagtgccccgggaggtctcgtagaccatgcaccatgagcacaaatcctaaacctcaaagaaaaaccaaaagaaacactaaccgtcgcccacaagacgttaagtttccgggcggcggccagatcgttggcggagtatacttgttgccgcgcaggggccccaggttgggtgtgcgtgcgacaaggaagacttcggagcggtcccagccacgtggaaggcgccagcccatccccaaagatcggcgctccactggcaagtcctggggtaaaccaggatacccctggcccctatatgggaatgaggggctcggctgggcaggatggctcctgtccccccggggttctcgtccctcttggggtcccaatgacccccggcataggtcgcgcaacgtgggtaaggtcatcgatatcctaacgtgcggccttgccgacctcatggggtatatccccgtcgtgggcgccccgcttggtggcgtcgccagagccctcgcgcatggcgtgagagtcctggaagacgggtgtaattatgcaacagggaacttacctggttgctccttttctatcttcttgctggctctactgtcctgcatcactgttccggtctctgccgcccaagtgaagaacaccagcagcagctacatggtgactaacgactgccacaatgacagcatcacctggcagctcgaggccgcggtcctccacatccccgggtgcgtcccatgcgagaaagtggggaacacatctcagtgctggataccggtctcgccaaacgtagccgtccggcagcccggcgccctcacgcagggcttgcggacacacatcgatatggttgtgatgtccgctacgctttgctccgctctctatgtgggggacttttgcggcggggtgatgctcgcagcccagatgttcattgtctcaccgcaaacccattggtttgttcaggagtgcaattgctccatctatcctggtgccatctctggacatcgtatggcgtgggacatgatgatgaactggtcacctacggtcaccatgatcctggcgtacgtggtgcgcattcccgaggtcatcatagacatcgttagcggggctcactggggcgtcatgttcggcttagcctacttctctatgcagggagcgtgggcgaaagtcgttgtcatccttatgctagccgcaggggtggacgcgacccaaaccatctttagtagcgccgcgcacaacgcctacagccttgccagagtatttactgctggcgccaagcagaacatccagcttattaacaccaatggcagttggcacgtcaaccgcactgccttgaattgcaatgactccctgcagaccggttttctcgcggccctgttttacgtccaccgcttcaactcgtcaggatgtcccgaacgcctgtccgtatgccgcaatattgagaccttccggataggatggggcaccctgcagtacgaggataacatcaccaacccagaggatatgagaccatattgttggcactacccaccaggacagtgcggcatagtccccgcgaagtctgtgtgtggcccagtgtactgcttcacccccagcccagtggtggtgggcacgaccgatagaagtggggtgcccacctacacgtggggagagaatgagacagatgtcttcctattgaacagcacccgtccaccgcgggggtcatggttcggctgcacgtggatgaattccgctggtttcaccaagacttgcggcgcaccaccttgccgtatcagagctgactttaatgccagcgcggacctgctgtgccccacggactgttttaggaaacatcctgaggccacctatatcaagtgtgggtctgggccctggctcacgccaaggtgcctggtcgattacccctacaggctttggcattacccttgcacagtcaactttaccatcttcaagataaggatgtacgtggggggggttgagcacaggctcacggccgcgtgcaatttcacccgtggggatcgttgcaacttagaggacagagacagaggccaattgtcccccctgctgcactccaccacagaatgggccattttgccctgcactttctcagacctgcccgccctgtcgactggccttctccacctccaccaaaacatcgtggacgtacaatacatgtatggcctgtcgcctgccctcacaaaatacgtcgtccgatgggagtgggtagtgctcttgttcctgctcttagcagacgccaggatttgcgcttgcgtgtggatgctcctcctgctgggccaggccgaagcagcgctagagaagctagtcatcttgcacgctgcgagcgcggctagctgcaatggcttcctatactttgtcatctttttcgtggctgcctggcacatcaaaggtcgggcagtccccttggccgcctactctcttactggcctatggtccttctgcctactgcttctagcattgccccaacaggcttatgcttatgacgcacctatgcatggacagctgggcgcagctttgttggcgttgattaccctctttacactcaccccggcatataagatccttctcagccgatgtttgtggtggttatgctatcttctgaccctgggggaaaccatgatccagaagtgggtaccacccatgcaggcgcgcggtggccgcgatggcatcatatgggccgccaccatattctgcccgggtgtggtgtttgacataaccaagtggcttctggcgctgcttgggcctggttgtctcctgagagaagccttgacgagagtgccatatttcgtcagagcccacgctctgctgagggtgtgcaccatggtgaggcatctcgcggggggtaagtatgtccagatggcgctattggcccttggtagatggactggcacttacatctatgaccacctcacccctatgtcggattgggctgccagtggcctacgggacctggcggttgccgtggagcctattatcttcagtccgatggagaagaaagtcatcgtctggggagcagagacggccgcgtgtggggacgttctacacggacttcccgtgtccgcccgactcggtcaggagatcctccttggcccagctgatggctacacctccaaggggtggaagcttctcgcccctatcaccgcttacgctcaacagacacgaggtctcttgggtactatagtggtgagcatgacggggcgcgataagacagaacaggccggagagatccaggtcctgtccacagtcactcagtccttcctcggaacgtccatctcgggggttttatggactgtctaccacggagctggcaacaagaccctagccggctcacggggtccggtcacgcagatgtactccagtgccgagggggacctggtggggtggcccagcccccctgggacgaagtctttagagccgtgcacgtgtggagcggtcgacctgtacttggtcacgcggaacgctgacgtcattccggctcgaagacgcggggacaagcggggagcgttgctctccccgagacccctttcaaccctgaaggggtcctcggggggaccggtgctttgccctaggggccacgctgtcggaatcttccgggcagccgtgtgctctcgaggcgtggctaagtccatagacttcatccccgttgagacacttgacatcgttacgcggtctcccacctttagtgacaacagcacaccgccggctgtaccccagacctaccaggtggggtacttgcacgccccaactggcagcgggaagagtaccaaagtccctgtcgcatatgccgctcagggatacaaagtgctagtgctcaatccctcggtggctgctaccctagggtttggggcgtacttgtccaaggcacatggcatcaatcctaacatcaggactggagtcaggactgtgacgaccggggaggctatcacgtactccacgtatggcaaattcctcgccgatgggggctgcgcaggcggcgcctatgacatcatcatatgcgatgaatgccattccgtggatgctaccaccattctcggcattggaacagttcttgatcaggcagagacagccggggtcaggctaactgtgctggccacggccacgccccccgggtcggtgactactccccaccctaacatagaggaggtagccctcgggcatgagggtgagatccccttctacgggaaggcgttccccttgagttacatcaagggaggggggcacttgatcttctgccattcaaagaaaaagtgtgacgagctcgctgtggcccttcggggcatgggcttgaacgctgtggcatattacagggggctggacgtctccataataccaactcagggagacgtagtggtcgtcgccaccgacgccctcatgacggggtgtactggagactttgacaccgtgatcgactgcaatgtagcggtcactcaagccgtagacttcagtttagaccccaccttcaccataaccacacagactgtcccccaagacgctgtctcacgtagccagcgccggggccgtacaggcagaggaaggctaggcatttataggtatgtatctactggtgaacgagcctcagggatgtttgacagtgtagtgctctgtgagtgctacgacgcaggggctgcatggcatgagcttacaccagcggagactaccgtcaggcttagggcatatttcaacacgcctggcctgcctgtgtgccaagaccatcttgagttttgggaggcagtcttcaccggcctcacacacatagatgcccacttcctttcccaaacaaagcaaacgggggagaattttgcatacttggtagcctaccaggctacagtgtgtgctagagccaaggcccctcccccgtcctgggacgtcatgtggaagtgtttgactcgactcaagcccacgctcgtgggccctacacctctactgtatcgcttgggctccgtcaccaatgaaatcaccctcacacatcctgtgacaaaatacatagccacttgcatgcaagccgacctcgaggtcatgaccagcacgtgggtcttggctgggggagtcttggcagccgttgccgcgtactgcctggcgaccgggtgtgtctccattatcggccggctgcacgtcaaccagcgagccgtcgttgcaccggacaaggaggtcctttatgaggcttttgatgagatggagggatgtgcctctagagcggctctcattgaggaggggcaacggatagccgagatgctgaagtccaagatccaaggcttattgcagcaagccactaaacagacccaggacatacagcccgccgtgcaggcttcatggcccaaggtggagcagttctgggccaaacatatgtggaatttcattagcggcattcaataccttgcagggctgtcaacactgccaggtaaccctgctgtggcttccatgatggcattcagtgctgccctcaccagtccgttgtcaaccagcaccactatccttctcaacattttgggaggctggctggcgtcccaaatcgcgccacccgcgggggccaccggcttcgctgtcagtggcttagtgggggctgccgtaggcagcataggcctgggtaaggtgctggtggacatcctggcagggtatggtgcgggcatttcgggggctctcgtcgcattcaagatcatgtctggcgagaagccctccatggaggatgtcgtcaacctgttgcccgggatcctgtctccgggtgccttggtggtgggagtcatctgcgccgccattttgcgccgccacgtggggccgggggaaggtgcggtccaatggatgaacaggctcatcgcctttgcttccagaggaaaccacgtcgcccccacccactacgtgacggagtcagacgcgtcgcagcgtgtgacccaactgcttggctcccttaccataactagtctgcttagaagactccacaattggattactgaggactgccccatcccatgcagcggctcgtggcttcgcgatgtgtgggactgggtttgtaccatcctaacagacttcaaaaattggctaaccgccaagttgttcccaaagatgcccggcctcccctttatctcttgccaaaagggatataagggtgtgtgggctggcactggcatcatgactgcacgatgcccttgcggtgccaatatttctggcaatgtccgcctaggctccatgagaattacaggccctaagacttgcatgaatgtttggcaggggacctttcccatcaattgttacacggagggccagtgtatgccgaaacccgcgccaaacttcaagaccgccgtctggagggtggcggcctcagagtacgcagaggtgacacggcacgggtcatactcctatataacaggattgaccaccgacaatttaaaggttccttgccaaataccttctccagagttcttttcctgggtggacggagtgcaaattcacaggtttgctcccacaccaaagccgtttttccgggacgaggtctcgttcagcgttgggctcaattcatttgtcgtcgggtctcagcttccctgtgaccctgaacccgacacagacgtattgacgtccatgctaacagacccatcccatattacggcggaggctgcagcgcggcgtttagcgcgggggtcacccccgtctgaggcaagctcctcagctagccagctatcggcagtgtcgctgcgagccacctgcgccacccatggcgaggcctatgacgtggatatggtggatgccaacctgttcatgaggggcgaggtgacccggatagagtccgagtccaaagtggtcattctggactatctcgacccaatgaccgcggaagagagtgacctcgagccctcgataccatcagagtacatgctccccaggaacaggttcccaccagccttaccggcctgggcacggcctgactacaatccgccgcttgtggagtcgtggaagagaccggattaccaaccgcccactgttgcgggctgtgctctcccccctcccaagaagatcccgacgcctcccccaaggagacgccggacggtgggtctgaatgagagcatcataggagatgtcctccaacagctggccgttaagaccttcggccaggcccccccgagcggcgagtcaggtctttctacgggggcggacgccgccgactctggcggtcggacgccccccgatgagtcggccctttcggagacgggttccacctcctccatgccccccctcgagggggagcctggagatccagatctggagcctgagcgggtagagctccagcccccccctcaagggggggaggtagctcccggctcggactcggggtcttggtccacttgctccgaggaggacgactccgtcgtgtgctgctccatgtcatactcctggaccggggctctaataactccttgtagccctgaagaggaaaagttgccaattaaccccttgagcaactcgctgttgcgatatcacaacaaggtgtactgcactacatcaaagagcgcctcacagagagctaaaaaggtaacttttgataggatgcaagtgctcgacgctcactatgactcagtcttaaaggacatcaagctggcggcctccaaggtcagtgcaaggctcctcactttggaggaggcttgccagttaactccaccccactctgcaagatccaagtatgggtttggagccaaggaggtccgcagcttgtccgggagggccgctaaccacgccaagtccgtgtggaaggacctcctggaagactcacaaacaccaattcctacaaccatcatggccaaaaataaggtgttctgcatagaccccaccaaggggggcaaaaagccagctcgccttatcgtttaccctgacctcggcgtcagggtttgcgagaagatggccctttatgatgtcacacaaaaacttcctcaggcagtgatggggccttcttatggattccagtactcccccgcccagcgggtggagttcctcttaaaggcatgggctgaaaagaaagaccctatgggtttttcgtatgatacccgatgctttgactcaaccgtcactgagagagacactagaactgaggagcccatataccaggcctgctctctgcccgaggaggcccgcactgccatacactcgctaactgagagactttacgtaggagggcccatgtttaacagcaagggccaggcctgcggatacaggcgttgccgcgctagcggggtgctcaccactagcatggggaacactatcacatgctacgtaaaagccctagcggcacgcaaggctgcagggatagttgcgcccacaatgctggtatgcggcgacgacttggttgtcatctcggaaagccagggggctgaggaggatgggcggaacctgagagtcttcacggaggctatgaccaggtattccgcccctccgggtgacccccccagaccggaatatgacctggagctgataacatcttgttcctcaaatgtgtctgtagcgctgggcccacagggccgccgcagatactatctgaccagagaccctaccactccaattgcccgggctgcctgggaaacagttagacactccccagtcaattcatggctgggaaacatcatccagtacgccccaaccatatgggttcgcatggtcctgatgacacacttctattccatccttatggcccaagacaccctggaccagagccttaactttgagatgtacggagcggtgtactcagtgagtcctttggacctcccagccataattgaaaggctacacgggcttgacgccttttctctgcacacatacactccccacgaactgacgcgggtggctgcagctctcagaaaacttggggcaccacccctcagagcgtggaagagtcgggcgcgcgcagttagggcgtccctcatctcccgtggagggagagcggccgtttgtggtcggtatctcttcaactgggcggtgaagaccaagctcaaactcactccattgccggaggcacgccgcctggatttatccagttggttcaccgtcggcgctggcgggggcgacatttatcacagcgtgtcgcgtgcccgaccccgcttattactccttagcctacccctactttgtgtaggggtaggcatctttctactccccgctcggtagagcggcacacattagctacactccatagctaatttccttattgtttttttttttttttttttctttccatttccttccttcttacttcactttaccttctttctggtggctccatcttagccctagtcacggctagctgtgaaaggtccgtgagccgcatgactgcagagagtgccgtaactggtctctctgcagatcatgt

SEQ ID NO: 580 - DNA, 9691 bp, Hepatitis C Virus
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacaccaaccgtcgcccacaagacgttaagtttccgggcggcggccggatcgttggcggagtatacttgttgccgcgcaggggccccaggttgggtgtgcgcgcgacaaggaagacttcggagcggtcccagccacgtgggaggcgtcagcccatccctaaagatcggcgctccactggcaagtcctggggaaaaccaggatacccctggcccctatatgggaatgaggggctcggctgggcaggatggctcctgtccccccgaggttcccgtccctcttggggccctactgacccccggcataggtcgcgcaatgtgggtaaggtcatcgataccataacatgcggctttgccgacctcatggggtacatccccgtcgtaggcgccccgcttggtggcgttgccagagctctcgcgcacggcgtgagagtcctggaggacggggtcaattttgcaacagggaacttacctggttgctccttttctattttcttgctagccctactgtcctgcatcaccattccggtctctgctgtcgaagtgaggaacatcagcgacagctacatggtgactaatgactgttccaataacagcatcacctggcagcttgaggctgcagtcctccacgtccccgggtgcgtcccgtgcgagaaagtgggcaacacatcacggtgctggataccggtctcaccaaacgtggctgtccggcagcccggcgccctcacgcagggcttgcgggcgcacatcgacatggttgtgatgtccgccacgctttgctccgctctccacgtgggggacctctgcggcggggtgatgctcgcagcccagacgttcattgtctcgccgcagcaccactggtttgtgcaggagtgcaattgctccatttaccctggcaccatcactggacatcgtatggcatgggacatgatgatgaactggtcgcccacggccaccatgatcctggcgtacgctatgcgcgttcccgaggtcatcatagacattattagcggggctcactggggtgtcatgttcggcctggcctacttctctatgcagggagcgtgggcaaaggtcgtcgtcatccttctgcttgccgctggggtggacgcgggcacccatacaactggggctgttgccgcgagcaacgctagaggcctcgccagtttgttcacttctggacctaagcagaacattcagctcattaacaccaatggcagttggcacattaaccgcactgccctgaattgcaatgactccctgcaaactggcttcatctcggccctgatctacaggaaccgcttcaactcgtcaggatgtcccgaacgcctgtccgtgtgccgcaatatcgaggccttccggataggatggggcgccttgcaatacgaggataatgtcactaatccagaagatatgagaccatattgctggcactatccaccaaaccagtgtggcattgtcccggcgcagtcagtgtgtggcccagtgtactgtttcacccccagcccagtggtagtgggcacaaccgacagacgcggagcgcctacttacacgtggggagagaatgatacaaatgtcttcctattgaacagcactcgaccaccgctggggtcatggttcggatgcacgtggatgaactccactggtttcaccaaaacttgtggcgcaccaccttgccgcattagagctgacttcaataccagcacggacctgttatgccccacggattgttttaggaagcatcctgatgccacttacatcaaatgtggttctgggccttggctcacgccaaagtgcctggtcgactacccctacaggctctggcattacccctgcacagttaactataccatcttcaaggtaaggatgtacgtggggggggttgagcacaggctcacggctgcgtgcaacttcactcgcggggatcgttgcaacttggaggacagggacagaagtcaacagtctcctttgttgcactccaccacggaatgggccgttttgccctgctctttctcagatctgcccgctctgtcgactggccttcttcacctccaccaaaatatcgtggacgtacaatacatgtatggcctgtcacctgcccttacaaaatatgtcgttcgatgggagtgggtggtactcttattcctgctcctagcggacgccagggtctgcgcctgtgtgtggatgctcatcttgttgggccaagctgaagcagcactagagaagctggtcgtcttgcacgctgcgagcgcagctagttgcaatagcttcctgtattttgtcatctttttcgtggctgcttggtacatcaagggtcgggcagtccccctggctgcctattccctcactggcctatggcccttctgcctactgcttctagcactgccccaacaggcttacgcctatgacgcatctgtgcacggacagataggcgcggctttgttgatactgattaccctctttacacttaccccggggtataaaaccctcctcagccggagtctgtggtggctgtgctatctcctgaccctgggggaggccatggttcaggagtgggcaccacccatgcaggcgcgtggtggccgtgatggcatcatatgggccgccaccatactctgcccgggcgtagtgtttgatataaccaagtggctgttggcggtgcttgggcccgcttacctcctgagagatgctttgacgagcgtgccgtacttcgtcagagctcacgctctgctgagaatgtgcactatggtgaagcacctcgcggggggtaggtacgtccagatggcgctattagcccttggtagatggtccggcacttacatctatgaccacctcacccctatgtcggattgggctgctagcggcctgcgggacttggcggtcgctgtggagcctatcatcttcagtccgatggagaagaaagtcatcgtctggggagcagagacggctgcatgcggggacatcttatacggacttcctgtgtccgcccgactcggtcgggagatcctccttggcccaactgatggctacacctccaaggggtggaggcttctcgcccccatcactgcctacgcccagcagacacgaggtctcttgggcgccatagtagtgagcatgacggggcgagacaagacagagcaggccggggaaatccaagtcttgtccacagtcagtcagtccttcctcggaacatccatttcgggggtcttgtggactgtttaccacggaactggcaataagaccctagccggctcacggggcccggtcacacagatgtattcaagtgccgaaggggacttggtagggtggcccagtcctcccgggaccaaatctttggagccgtgcacgtgtggagcggtcgacctatacctggtcacgcggaacgctgatgtcatcccggctcgaagacgcggggacaagcggggagcgctactctccccgaggcctctttcgaccctgaagggatcatcggggggaccggtgctctgccctaggggccacgctgtcgggatcttccgggcagctgtgtgctctcggggcgtggctaagtccatagatttcatccccgttgaggcgctcgacatcgtcacgcggtctcccacctttagcgacaacagcacaccaccagctgtgccccagacctatcaggtcgggtacttgcatgccccaactggcagtggaaagagcaccaaagtccctgtcgcatatgccgcccaggggtacaaggtattagtgcttaacccctcggtggctgccactctggggtttggggcgtacctgtccaaggcacatggcatcaatcccaacatcaggactggagtcagaactgtgacgaccggggggcccatcacgtactccacgtatggtaaattcctcgctgatgggggctgctcaggcggcgcctatgacatcatcatatgcgatgaatgccacgctgtggacgctaccaccattctcggcatcggaacggttcttgaccaagctgagacagccggggtcaggctcactgtactggccacggccacgccccccgggtcggtgacaactccccatcccaacatagaggagatagccctcgggcaggagggtgagatccccttctatgggagggcgattcccctgtctcacatcaagggagggagacacttaatcttctgccactcaaaaaaaaagtgtgacgagctcgcggcggcccttcggggcatgggcttgaacgctgtggcatactacagagggttggacgtctccataataccaactcaaggagatgtagtggtcgtcgccaccgacgctctcatgacggggttcgctggagactttgactctgtgatcgactgcaacgtagcggtcactcaagtcgtggacttcagcctggaccccaccttcactataactacacagactgtccctcaagacgctgtctcacgtagccagcgccgggggcgtacaggtagaggaagactgggcacttacaggtacgtttccactggagagcgagcctcaggaatgtttgacagtgtagtgctctgtgagtgctacgacgcaggggctgcatggtatgagcttacgccagtggagactaccgtcaggcttggagcgtatttcaatacgcctggcttgcctgtgtgccaagaccaccttgagttttgggaggcagttttcaccggcctcacacacatagatgcccacttcctttcccagacaaaacaatcgggggagaatttcgcgtacttagtagcctatcaggccacagtgtgcgctagagccaaagccccccccccgtcttgggacgtcatgtggaaatgcttgactcgactcaagcccacgctcgtgggccctacacctctcctgtaccgtttgggctctgttaccaatgaggtcacccttacacatcctgtgacaaaatacatcgccacatgcatgcaagctgaccttgaggtcatgaccagcacgtgggtcctggctgggggagtcttggcagccgtcgccgcgtattggttggcgaccgggtgtgtttccatcatcggccggttgcacatcaaccagcgagctgtcgttgctccggacaaggaggtcctctatgaggcttttgatgagatggaagaatgtgcctctagagcggctctcattgaggaggggcagcggatggccgagatgttgaagtctaagatccaaggcttattgcagcaagcctctaaacaggcccaggacatacaacctgctgtgcaggcctcgtggcccaaggtggagcagttctgggccaaacacatgtggaatttcattagcggcattcaatacctcgcaggactgtcaacactgccagggaaccctgctgtggcttccatgatggcattcagtgccgctctcaccagtccgttgtcaactagcaccactatccttctcaacatcttgggaggctggctggcgtcccaaattgcgccgcccgcgggggccaccggcttcgtcgtcagtggcctggtgggggctgccgtaggcagcgtaggcctgggtaaggtgctggtggacatcttggcagggtatggtacgggcatttcgggggccctcgtcgcattcaagatcatgtctggcgaaaagccctccatggaggatgtcgtcaacctgctgcctgggattctgtctccgggtgccctagtagtgggagtcatctgcgcggccattctgcgtcgccacgtgggaccgggggaaggcgcggtccaatggatgaacaggctcattgccttcgcttccataggaaaccacgtcgcccctacccattacgtgacggagtcggatgcgtcgcagcgtgtgacccaactgcttggctcccttactataactagtctactcagaagactccacaattggatcactgaggactgccccatcccatgcgccggctcatggctcagcgatatgtgggactgggtttgcactatcctaacagactttaagaactggctgacctccaaattgttcccaaaaatgcccggcctcccctttatctcttgccaaaaggggtacaagggtgtgtgggccggcactggtatcatgaccacacggtgcccttgcggcgccagcatctctggcaatgttcgcctgggctccatgagaatcacagggcctaaaacctgtatgaacatctggcaggggaccttccccattaattgttacacggagggccagtgcatgccgaaacccgcgccgaacttcaaaaccgccatctggagggtggcggcctccgagtacgcggaggtgacgcagcacgggccatactcctacataacaggactgaccactgacaatttgaaagtcccctgccaactaccttctccagagtttttctcctgggtggacggagtgcaaatccataggttcgctcctacgccgaagccgtttttccgggatgaggtctcgttttgcgttgggctcaactcatttgtcgtcgggtctcagcttccctgcgaccctgagcccgacactgacgtcttgatgtccatgctaacagatccatcccatatcacggcggaggccgcagcacggcgcttagcgcgggggtcacccccatctgaggcaagctcctcagccagccagctatcggcaccatcgctgcgagccacctgcaccacccatggcaagacctatgatatggacatggtggaagctaacctgttcatggggggcgatgtgactcggatagagtctgagtccaaagtggtcgttctggattctctcgactcgatggtcgaagaaaggagcgaccttgagccttcgataccatcggagtatatgctccccaagaccaagttcccgccagccctaccggcctgggcacggcctgattacaacccgccacttgtggaatcatggaagaggcccgattatcaaccgccgacggttgcgggctgtgctctccctcctcccaagaagaccccgacgcccccaccaaggaagcgtcggacagtgggtctgagcgagagcaccataggagacgccctccaacagctggctatcaagaccttcggccagcctcccccaagcggcgattcaggcctttccacgggggcggacgccgccgactccggcggtcggacgcccccagatgaatcggccctttcggagacaggttctatctcctccatgcccccccttgagggggagcctggggacccagacctggaacctgagcaggtagagcttcaacctccctcccaggggagggaggtagctcccggctcggactcagggtcctggtctacttgctccgaggaggatgattccgtcgtgtgctgccccatgtcatactcctggaccggggctctaataactccttgcagccccgaagaggagaagttaccaattaaccccttgagcaactcgctgttgcgataccacaacaaggtgtactgtactacatcaaagagcgcctcactgagggctaaaaaggtaacttttgataggatgcaggtgctcgacgcctattatgactcagtcttaaaggacatcaagctagcggcctcgaaggttagcgcaaggctcctcactttggaggaggcgtgccaattgactccaccccattctgcaagatccaaatatgggtttggggcaaaggaggttcgcagcttgtccgggagggccgtcaaccacatcaagtccgtgtggaaggacctcctggaagactcacaaacaccaattcctacgaccatcatggccaaaaatgaggtgttctgcgtggaccccactaaggggggcaagaaagcagctcgccttatcgtttaccccgacctcggcgtcagggtctgcgagaagatggccctttatgatgtcacacaaaagcttcctcaggcggtgatgggggcttcttatggcttccagtactcccccgctcaacgggtggagtttctcttgaaggcatgggcggataagagagaacccatgggtttctcgtatgatacccgatgctttgactcaactgtcaccgagagagacattagaactgaggagtcgatataccaggcctgctccctgcccgaggaggctcacactgccatacactcgctgactgagagactctacgtgggagggcccatgctcaacagcaagggccaggcctgcgggtacaggcgttgccgcgccagcggggtgcttaccactagcatggggaataccatcacatgctatgtgaaagccctagcggcttgcaaagctgcggggatagttgcacctacaatgctggtatgcggcgatgacttggttgtcatctcagaaagccaggggactgaggaggacgagcggaacctgagagctttcacggaggctatgaccaggtattctgcccctcctggtgatccccccagaccggaatatgacttggagctgataacatcttgttcctcaaatgtgtctgtggcactcggcccacagggccgccgcagatactacctgaccagagatcctaccactccaatcgcccgggctgcctgggaaacagtcagacactcccctgtcaattcatggctgggaaacatcatccagtacgccccaaccatatgggttcggatggtcctgatgacacacttcttctccattcttatggcccaagacaccctggaccagaacctcaactttgaaatgtacggatcggtgtactccgtgagtcctttggacctcccagccataattgaaaggttacacgggcttgacgccttctctctgcacacatactctccccacgaactgacgcgggtggcttcggccctcagaaaacttggggcgccaccactcagagcgtggaagagtcgggcgcgtgcagttagggcgtccctcatctcccgaggggggagagcggccatttgtggccggtatctcttcaactgggcggtgaagactaagctcaaactcactccattgccggaggcacgccttctggatctatccagttggtttaccgtcggcgccggcgggggcgacatttatcacagcgtgtcgcgcgcccgaccccgcttattactccttagcctactcctacttttcgtaggggtaggcctccttctactccccgctcggtagagcggcacacattagctacactccatagctaactgtttttttttttttttttttttttttttttttttttttttttttttttttttttttttttttttttttttttttttttcctttcctttctttcttaccttactttacattcttttctggtggctccatcttagccctagtcacggctagctgtgaaaggtccgtgagccgcatgactgcagagagtgccgtaactggtctctctgcagatcatgt

SEQ ID NO: 581 - DNA, 9683 bp, Hepatitis C Virus
acccgcccctaataggggcgacactccgccatgaatcactcccctgcgaggaactactgtcttcacgcagaaagcgtctaaccatggcgttagtatgagtgtcgtacagcctccaggcccccccctcccgggagagccatagtggtctgcggaaccggtgagtacaccggaattgccgggaagactgggtcctttcttggataaacccactctatgcccggtcatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacactaaccgtcgcccacaagacgttaagtttccgggcggcggccagatcgttggcggagtatacttgttgccgcgcaggggccccagattgggtgtgcgcgcgacaaggaagacttcggagcggtcccagccacgtgggaggcgccagcccatccctaaagatcggcgctccactggcaagtcctggggaaagccaggatacccttggcccctatatgggaacgagggactcggctgggcaggatggctcctgtccccccgaggttcccgtccctcttggggccccactgacccccggcataggtcgcgcaacgtgggtaaggtcatcgataccctaacgtgcggctttgccgacctcatggggtacatccccgtcgtaggcgccccacttggtggcgttgccagagctctcgcgcacggcgtgagagtcctggaggacggggttaattatgcaacagggaacctacctggttgctccttttctatcttcttgctggccttgttgtcctgcatcaccaccccggtctctgctgcccaagtgaagaacactagtgacatctacatggtgactaatgactgttctaatgacagcatcacctggcagcttcaggccgcggccctccacgtccccgggtgtgtcccgtgtgagagggtgggaaacacatcacggtgctggataccggtctcaccgaacgtggctgtgcggcagcctggcgccctcacgcagggcttgcggacgcacatcgacatggtcgtgatgtccgccacgctctgctccgctctctacgtgggggatctctgcggcggggtgatgctcgcagctcagatgttcattatctcgccgcagcaccactggtttgtgcaggaatgcaattgctccatctaccctggtaccatcactgggcaccgtatggcatgggacatgatgatgaattggtcgcccacaaccaccatgatcctggcgtacgtgatgcgcgtgcccgaggtcatcatcgacatcatcggcggggctcactggggcgtcatgttcggcctagcctacttctctatgcagggagcgtgggcgaaggttgttgtcatcctcctgctggccgctggggtggacgcgcacaccagaactgggagttctgtcgggtacgccacctccggcatcgtcggcctcttcacctctggtcctaagcagaacattcagctcattaacaccaatggcagttggcacatcaaccgcactgccttgaactgcaatgactccttgaacaccggctttatcgtgtccctgttctacgcccgcaacttcaactcgacaggatgtcctgaacgcctgtccgcctgccgcggtatcgagggcttccggataggatggggcaccttgcaatacgaggataatgtcaccaatccagaagatatgagaccatattgctggcactacccaccaaaacaatgtggcatagtccctgcggggtctgtgtgcggcccagtgtactgtttcacccccagcccagtagtggtgggcacgaccgatagacttggagtgcctacttacacgtggggagagaatgagacagatgtcttcctattgaacagcacccgaccaccggtggggtcatggtttggctgcacgtggatgaactccactggtttcaccaagacttgtggcgcaccaccttgccgcattagggctgacttcaatgccagcacggacctgttgtgccccacggactgttttaggaagcatcctgaagctacttacatcaaatgtggttctgggccctggctcacgccgaggtgcctggtcgactacccctataggctctggcattacccctgcacagtcaactattccatcttcaagataagaatgtatgtggggggggttgagcacaggctcacagccgcgtgtaacttcactcgtggggatcgttgcaacctggaggacagagatagaagtcaactgactcctttgttgcactccaccacggagtgggccattttgccctgtacctactcagacttgcccgccttgtcgactggtcttctccacctccaccaaaatatcgtggacgtgcaatacatgtatggcctgtcacctgccctcacaaaatatgtcgttcgatgggagtgggtagtactcttattcctgctcctagcggacgccagggtctgcgcctgcgtgtggatgctcatcttgctgggccaagccgaagcagcactagagaagttggtcgtcttgcatgctgcgagcacagctagctgcaatggcttcctgtattttgtcatctttttcgtagctgcttggtacattaagggtcgggcagtccccttggctacctattccctcactggcctatggcccttctgtctactgctcctagcactgccccaacaggcttatgcctatgatgcatccgtgcacggacaggtaggcgtggttttgttgatactgattaccctctttacactcaccccggggtacaagacccttctcagccggtgtctgtggtggttgtgctatatcctgaccctgggggaggccatggtccaggagtgggcgccatccatgcaggcgcgcggcggccgtgatggcatcatatgggccgccaccatattctgcccgggtatagtgtttgacataaccaagtggctcttagcggtgcttgggcctgcttacctcctaagagatgctttgacacgcgtgccatactttgtcagagctcacgctctgctgaggatgtgcaccatggtgaggcacctcgcggggggtaggtacgtccagatggcgctattggcccttggtagatggactggcacttacatctatgaccacctcacccccatgtcggattgggctgctagcggcctgcgggacctggcggtcgccgtagagcctatcatcttcagtccgatggagaagaaagtcatcgtctggggggcggagacggctgcatgcggggacatcctacacggactccccgtgtccgcccggctcggtcgggagatcctccttggcccagctgatggctacacctccaaagggtggaggcttctcgcccccatcaccgcttacgctcagcagacacgaggcctcctgggcaccatagtggtgagcatgacggggcgcgacaagacagaacaggccggggaaatccaagtcctgtccacagtcactcagtccttcctcgggacatccattgcgggggtcttatggactgtttaccacggagccggcaacaagactctagccggctcacggggcccagtcacgcaaatgtattcaagtgccgagggggatttggtgggatggcccagccctcctgggaccaagtctttggagccgtgtacgtgtggatcggtcgacctgtacctggtcacgcgaaacgctgatgtcatcccggttcgaagacgcggggacaagcggggagcgttactctccccgagacccctttcgaccttgaaggggtcttcggggggaccggtgctttgccctaggggccacgctgtcgggatcttccgggcagctgtgtgctctcggggcgtggctaagtccatagatttcatccccgttgagacactcgacatcgtcacacggtctcccacctttagtgacaacagcacaccaccagctgtgccccagacctatcaggtcggatacttgcatgccccaactggcagtgggaagagtaccaaagtccccgtcgcatacgccgcccaggggtataaagtactagtgcttaacccctcggtggctgccaccttggggtttggggcgtacttgtccaaggcacatggcatcaatcccaacattaggactggagtcagaactgtgacgaccggagaggccatcacgtactccacgtatggcaaattcctcgctgatgggggctgctcaggcggcgcctatgacatcatcatatgcgatgaatgccatgctacggattctaccaccatcctcggcatcggaacagttcttgaccaagcagaaacagccggggtcaggctaactgtactggccacggccacgcctcctgggtcggtgacaaccccccatcccaatatagaggaggtagccctcgggcaggagggtgagatccccttctatgggaaggcgatccccctgtcttacatcaagggagggaggcacttgatcttctgccattcaaagaaaaagtgtgaagagctcgcggtggccctccgggccatgggcttgaacgctgtggcatactacagagggttggacgtctctataataccaactcaaggggatgtagtggtcgtcgccacagacgccctcatgaccgggtatactggagactttgactccgtgatcgactgcaacgtagcggtcactcaggtcatagacttcagcctggaccccaccttcactataactacacagactgtccctcaagacgctgtctcacgtagccagcgccgaggccgcacaggtagaggaagactaggcacttataggtatgtttccactggtgagcgagcctcaggaatgtttgacagtgtagtgctctgcgagtgctacgacgcaggggctgcatggtatgagctcacaccagcggagactaccgtcaggcttagagcgtatttcaacacgcctggcttgcctgtgtgccaagaccatcttgagttttgggagggagctttcaccgacctcacacacatagatgcccacttcctttcccaaacaaagcaagcaggggagaatttcgcatacttagtagcctatcaggctacagtgtgcgccagagccaaagcccctcccccgtcctgggacatcatgtggaagtgcttgactcgactcaagcccacgctcgtgggccctacacccctcctgtaccgtttgggctctgttaccaacgaggtcaccctcacgcaccctgtgacaaaatacattgccacatgcatgcaagctgaccttgaggtcatgaccagcacgtggatccttgccgggggagtcctggcagctgtcgccgcgtactgcttggcaaccgggtgtgtttccatcattggccgtttgcacgtcaaccagcgagctgtcgttgcaccggataaggaggtcccctatgaggcttttgatgagatggaggagtgtgcctctagagcggctctcattgaagaggggcagcggatagccgagatgctgaagtccaagatccaaggcttattacagcaagcctccaaacaggcccagaacatacaacccgctgtgcagacttcatggcccaaggtggaacaattttgggccaagcacatgtggaacttcattagcggcattcaatacctcgcaggactgtcaacactgccaggaaatcccgctgtggcctccatgatggcattcagtgccgccctcaccagcccgttgtcaactagcaccactatccttcttaacattttgggaggctggctggcgtcccaaattgcgccacccgcgggggccactggctttgtcgtcagtggtctggtgggggctgccataggcagcataggcctgggtaaggtgctggtggacatcttggcagggtatggtgcgggcatttcgggggccctcgtcgcattcaagatcatgtctggcgagaagccctccatggaggatgtcgtcaacctgttgcctgggattctgtctccgggtgccctggtggtgggagtgatctgcgcggccattctgcgccgccacgtaggaccgggggaaggcgcggtccaatggatgaataggctcattgccttcgcttccaggggaaaccacgtcgcccccacccactacgtgacggagtcggatgcgtcgcagcgtgtgacccaactgcttggctcccttactataactagcctactcagaagactccacaattggattactgaggactgccccatcccatgcgccggctcgtggctccgcgatgtgtgggactgggtttgcagcatcctaacagacttcaaaaactggctgacctccaagttgttcccaaaaatgcccggcctcccctttatctcttgccaaaaggggtacaagggcgtgtgggccggcactggtatcatgaccacacggtgtccttgtggcgccgtcatctctggcaatgtccgcctgggctctatgagaatcacagggcctaaaacctgcatgaacacttggcaggggaccttccctatcaattgttacacggagggccagtgcgtgccaaaacctgcgccaaacttcaagaccgccatctggagggtggcggcctcagagtacgcggaggtgacacagcacgggtcatactcctatataacaggactgaccactgacaatttgaaagttccctgccaactaccttctccagagttcttctcctgggtggatggggtgcaaatccataggtttgctcccacaccaaagccgttcttccgggatgaggtctcgttttgcgttgggctcaactcgtttgtcgtcgggtctcagcttccttgtgaccctgaacccgacaccgacgtactgatgtccatgctcacagatccatcccacatcacggcggaggctgcagcgcggcgcttagcgcgagggtcgcccccatctgaggcaagttcctcagcgagccagctatcagcggcatcgctgcgagccacctgcaccacccacggcaagacctatgatgtggacatggtggatgccagcctgtttatgaggggcgatgtgactcggatagaatctgagtccaaagtggtagttctggactatctcgacccaatggtcgaagaaacgagcgaccgcgagccttcgataccatcggagtatatgcttcccagaaacaggttcccaccagccttaccggcctgggcacggcctgattacaacccaccgcttgtggagtcgtggaagaggccagattaccaaccgcccactgttgcgggctgtgctctccccccccccaagaagaccccaacgccccctccaaggagacgccggacagtgggtctgagcgagagcaccataggagacgccctccagcagctggccgttaagtcctttggccagccccctccaagcggagactcaggcctttccacgggggcggacgccgccgactccggcggtcagacgtcccctgatgagttggctctttcggagacaggttccatctcctccataccccccctcgagggggagcccggagatccagacctggagcctgagcaggtagagctccaacctcccccccaggggggggaggtagctcccggctcggactcggggtcctggtccacctgctctgaggaggatgatgccgtcgtgtgctgctccatgtcatactcctggaccggggctctaataactccttgtagccccgaagaggaaaagttgccaattaaccccttgagcaactcgctgttgcgataccacaacaaggtgtactgtaccacatcaaagagcgcctcattgagggctaaaaaggtaacttttgataggatgcaagtgctcgacacctattatgactcagtcttaaaggacatcaagctagcggcctccaaggtcagcgcaaggctcctcaccttggaggaggcgtgccaattgactccgccccattccgcaagatccaagtatgggtttggggctaaggaggtccgcagcttgaccaggagggccgttaaccacatcaagtccgtgtgggaggacctcctggaagactcacaaacaccaattcctacaaccatcatggccaaaaatgaggtgttctgcgtagaccccaccaaggggggcaagaaagcagctcgccttatcgtttaccctgacctcggcgtcagggtctgcgagaagatggccctttatgatgtcacacagaaacttcctcaggcggtgatgggggcttcttatggtttccagtactccccctctcagcgggtggagtttctcttgaaggcatgggcggaaaagaaaggccctatgggtttttcgtatgatacccgatgctttgactcaaccgtcaccgagagagacatcaaaactgaggagtccatataccaggcctgctccctgcccgaggaggcccgcactgccatacactcgctgactgagagactctacgtgggagggcccatgttcaacagcaagggccagtcctgcgggtacaggcgttgccgcgccagcggggtgctcaccactagcatggggaacaccatcacatgctatgtaaaagccctagcggcttgcaaggctgcagggatagtagcgcccacaatgctggtatgcggcgacgacttggttgtcatctcagaaagccaggggactgaggaggacgagcgaaacctgagagccttcacggaggctatgaccaggtattctgcccctcctggtgacccccccagaccggaatatgacctggagctgataacatcttgttcctcaaatgtgtctgtggcactcggcccgcagggccgccgcagatactacctgaccagagaccctgccactccaattgcccgggctgccagggaaacagttagacactcccctgtcaattcatggctgggaaacatcatccagtacgctccaaccatatgggttcgcatggtcctgatgacacacttcttctccattcttatggctcaagacaccctggaccagaacctcaattttgagatgtacggatcggtgtactccgtgagtcctttggacctcccagccataattgaaaggttacacgggcttggcgccttttctctgcacacatacactccccacgaactgacgcgggtggcttcagccctcagaaaacttggggcgccacccctcagaacgtggaagagtcgggcgcgtgcagtaagggcgtccctcatctcccgcggggggagagcggccgtttgcggtcggtatctcttcaactgggcggtgaggaccaagctcaaactcactccattgccggaggcacgcctcctggatttatccagttggtttaccgtcggcgccggcgggggcgacatttatcacagcgtgtcgcgtgcccgaccccgcttattactccttagcctactcctacttttcgtaggggtaggcctctttttactccccgctcggtagagcggcacacattagctacactccatagctaactgttccttttttttttttttttttttttttttttttttttttttttttttttttttttttttttttttttttttttctttccttcctttctcaccttcttttacttctttcctggtggctccatcttagccctagtcacggctagctgtgaaaggtccgtgagccgcatgactgcagagagtgccgtaactggtctctctgcagatcatgt

SEQ ID NO: 582 - DNA, 9426 bp, Hepatitis C Virus
atagatcactcccctgtgaggaactactgtcttcacgcagaaagcgtctagccatggcgttagtatgagtgtcgtgcagcctccaggtccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacaaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgaccaggaagacttccgagcggtcgcaacctcgtggaaggcgacaacctatccccaaggctcgccaacccgagggcagggcctgggctcagcccgggtacccttggcccctctatggcaatgagggtctggggtgggcaggatggctcctgtcaccccgtggttctcggcctagttggggccccacggacccccggcgtaggtcgcgtaatttgggtaaggtcatcgatacccttacatgcggcttcgccgacctcatggggtacattccgctcgtcggcggccccctagggggcgctgccagggccctggcgcatggcgtccgggttctggaggacggcgtgaactatgcaacagggaatttgcccggttgctctttctctatcttcctcttggccttgctgtcctgtttgaccatcccagcttccgcttatgaagtgcgcaacgtgtccggggtgtaccatgtcacgaacgactgctccaactcaagtattgtgtatgaggcagcggacatgattatgcacacccccgggtgcgtgccctgcgtccgggagaatgattgttcccgctgctgggtagcgctcactcccacgctcgcggccaggaacagcagcatccccactacgacaatacgacgccatgtcgatttgctcgttggggcagctgctttctgttccgctatgtacgtgggggatctctgcggatccattttcctcgtctcccaattgttcaccttctcacctcgccggtattggacggtacaagactgcaattgctcaatctatcccggccacgtatcaggtcaccgtatggcttgggatatgatgatgaactggtcgcccacaacagcactagtggtgtcgcagttgctccggatcccacaatccgtcgtggacatggtagcgggagcccactggggagtcttggcgggccttgcctactattccatggtagggaactgggctaaggttttgattgtgatgctactctttgccggcgttgatggggtaacccacatgacgggggggcaggtatcccacaacacccggagctttatgtccctcttcacatgtgggccgtctcagaaaatccaactcataaacaccaacggcagctggcacatcaacaggactgccctgaattgcaatgactccctccagactgggttccttgccgcgctgttctatgcacacaatctcaactcgtccggatgcccagagcgtatggccagctgtcgctccattgacaaattcgctcaggggtggggtcccattactcatgtagtgcctgacacctgggaccagaggccttattgctggcactacgcacctaaaccgtgtggtattgtacccgcgtcgcaggtgtgtggtccagtgtattgcttcaccccgagccctgttgtggtggggacgaccgatcgtttcggcgtccccacgtatacctggggggagaatgagacggacgtgctattcctcaacaacacgcggccgccgcaaggcaactggttcggctgtacatggatgaacagcaccgggttcaccaagacgtgcgggggccccccgtgtaacatcgggggggttggcaacaacaccttgatctgccctacggattgtttccggaagcaccccgaggccacttacaccaaatgtggctcggggccttggttgacacctaggtgtatggttgattacccatataggctttggcactacccctgcactgtcaactttaccatcttcaaagtcaggatgtatgtggggggcgtggagcacaggctcaacgccgcgtgcaattggactcgaggagagcgttgtgacttggaggacagggatagatcagagcttagcccgctgctactgtccacaacagagtggcaggtactgccctgttccttcacccccctaccggctctgtccactgggttgatccacctccatcagaacatcgtggacgtgcaatacctgtacggtatagggtcagcggtcgtctccgttgtaatcaaatgggagtacgtcctgctgctcttcctcctcctggcggacgcgcgcgtatgctcctgtttatggatgatgttgctgatagcccaggctgaggccgccttagagaacctggtggtcctcaatgcggcgtccgtggccggagcgcatggcactctttccttccttgtgttcttctgtgctgcctggtacatcaagggtaagctggtccctggggcggcatatgctctctatggcgtatggccgctgcttctgctcctgctggcgttaccacaccgagcatacgccatggacccggagatggctgcatcgtgcggaggcgcggttttcgtaggtctggcactcttgaccttgtcaccacattacaaagcattcctcgctaggctcatatggtggttacagtactttatcaccagggccgaggcgcatttgcaagtgtggatcccccctctcaacgttcgggggggccgcgacgccatcatcctcctcgcatgcgcagtccacccagagctaatttttgacatcaccaaaatcctgcttgccatacttggtccgctcatggtgctccaggctggtctaactagagtgccgtacttcgtacgcgctcaagggctcatccgtgtttgcatgttagtgcggaaagttgctgggggccattatttccaaatggctctcatgaagctggccgcactgacgggcacgtacgtttatgaccatcttactccgctgcgggactgggcccacgtgggcctgcgagaccttgcggtggcggttgagcctgttgtcttctctgacatggagaccaagatcattacctggggggcagacaccgcggcgtgtggggacatcatctcgggtctacccgtctccgctcgaagggggagggagatactcctgggaccggccgatagttttagagagcagggatggaggctccttgcgcctataacggcctactcccaacagacgcggggcctacttggctgcatcatcactagcctcacaggccgggacaagaaccaggtcgaaggggaagttcaggtggtttccaccgcaacgcaatctttcctagcgacctgtgttaacggcgtgtgttggactgtctaccatggtgccggctcaaagaccctagccggcccaaagggcccgatcacccaaatgtacaccaatgtggaccaggacctcgtcggctggcaggcgccccctggagcgcgttccctgacaccatgcacctgcggcagctcggacctttacttggtcacgaggcatgctgatgttattccggtgcgccggcggggcgacagcagagggagcctactctcccccaggcctgtctcctacttgaagggctcctcgggtggtccactgctctgcccttcgggacacgctgttggcatcttccgggccgctgtgtgcactcggggggttgcgaaggcggtggactttatacctgttgagtctatggaaaccactatgcggtctccggtctttacggacaactcatctcctccggccgtaccgcagacattccaagtggcccatctacacgctcctaccggcagcggcaagagcactaaggtgccggctgcatacgcggcccaagggtacaaggtgctcgtcctgaacccgtctgttgccgccaccttaagttttggggcgtatatgtccaaagcacatggtgttgaccctaacatcagaactggggtaaggaccatcaccacaggcgctcccatcacgtactccacctatggcaagttccttgccgacggtggttgctctgggggcgcctatgacatcataatatgtgatgagtgccactcaactgactcgacctccatcttgggcattggcacagtcctggaccaagcggagacggctggagcgcggctcgtcttgctcgccaccgctacgcctccgggatcggtcaccgtgccacatcccaatatcgaagaggtggccttgtccaacactggagagattcccttctatggcaaagccatccccatcgagaccatcaagggggggaggcatctcattttctgccactccaagaagaaatgtgatgagctcgccgcaaaattgtcggccctcggagttaatgctgtagcgtactaccggggtcttgatgtgtccgtcataccgacaagcggaaacgtcgttgtcgtggcaacagacgctcttatgacgggctataccggcgactttgactcagtgatcgactgtaacacatgtgtcacccagacagtcgatttcagcttggaccctaccttcaccattgagacgacaactgtgccccaagacgcggtgtcgcgctcacaacggcgaggcaggactggtaggggcagagcgggtatatacaggtttgtgactccaggggaacggccttcgggcatgttcgattcttcggtcctgtgtgaatgctatgacgcgggctgtgcttggtacgagctcacgcccgccgagacctcggtgaggttgcgggcttacctgaatacaccagggttgcccgtctgccaggatcatctggagttctgggagagcgtcttcacaggcctcacccacatagatgcccacttcttgtcccagactaaacaggcaggagacaacttcccctacctggtagcataccaggctacggtgtgcgccagggcccaggctccacctccatcatgggatcaaatgtggaaatgtctcatacggttaaagcctacgctacacgggccaacgcccctgttgtataggctgggagccgtccaaaacgaggtcaccctcacacaccccataaccaaattcatcatggcatgcatgtcggctgacctagaggtcgtcacgagtacctgggtgctagtgggcggggtccttgcagctctggccgcatactgcctgacaacgggcagcgtggtcattgtgggcaggatcatcttgtccgggaagccagctgttattcccgacagggaggttctctaccgggagttcgatgaaatggaagagtgtgcctcacacctcccttacatcgaacagggaatgcagctcgccgagcaattcaagcagaaggcgctcgggttgttgcaaacagccaccaagcaagcggaggccgctgctcccgtggtggagtccaaatggcgagcccttgagaccttctgggcaaagcacatgtggaacttcatcagcgggatacagtatttagcaggcttgtccactctgcctgggaaccccgcgatagcatcattgatggcattcacagcctctatcaccagccctctcaccacccaacataccctcttgtttaacatcttggggggatgggtggccgcccaactcgccccccccagcgctgcctcagcttttgtgggcgccggcatcgctggcgcggctgttggcagcataggccttgggaaggtgcttgtggacatcttggcgggttatggggcaggggtggcaggcgcgctcgtggcctttaaggtcatgagcggcgagatgccctccgccgaggacatggtcaacttactcccagccatcctctctcctggtgccctggtcgtcggggtcgtgtgcgcagcaatactgcgtcggcatgtgggcccaggagagggggctgtgcagtggatgaaccggctgatagcgttcgcttcacggggtaaccacgtctcccccacgcattatgtgcctgagagcgacgccgcagcgcgtgtcacccagatcctctccagccttaccatcactcagctgttgaagaggctccatcagtggattaatgaggactgctccacgccgtgctccggttcgtggctaagggatgtttgggactggatatgcacggtgttgaccgacttcaagacctggctccagtccaagctcctgccgcggttgccgggagtccctttcttctcatgccaacgtgggtataagggagtctggctgggagatggcgtcatgcaaaccacctgcccctgtggagcacaaatctccggacatgtcaaaaacggttccatgaagatcgttggacctaagacctgcagcaacacgtggcatggaacattccccatcaacgcatacaccacgggcccctgcacaccctccccggcgccaaactattctagggcgttgtggcgggtagctgccgaggagtacgtggaggttacgcgggtgggggaattccactacgtgacaggcatgaccactgacaacgtgaaatgcccatgccaggtcccgagccctgaattcttcacggaggtggatggggtgcggttgcacaggtatgctccggcgtgcaaacctctcctacgggatgaggtcacattccaggtcgggctcaaccaatatccggttgggtcacagctcccatgtgagcccgaaccggatgtggcagtgctcacttccatgcttaccgacccctcccatattacagcagagacggctaggcgtaggctggccagggggtctcccccctccttggccagctcttcggctagtcagttgtctgcgccctccttgaaggcgacatgcactacctgccatgattccccagacgctgacctcatcgaggccaacctcctgtggcggcaggagatgggcggaaacatcacccgcgtggagtcagagaataaggtagtaattctagactcttttgacccgcttcgggcggaggaggatgagagggaggtatccgttgcggcggagatcctgcggaaaaccaggaaattccccccagcgatacccatatgggcacgcccggactacaatccaccactgttagagtcttggaaggatccggactacgtccctccggtggtacacgggtgcccattgccacctaccaaagcccctccaataccacctccacggaggaagaggacagttatcctgacagaatccaccgtgtcttctgccctggcggagcttgctactaagaccttcggcagctccggatcgtcagccgtggacagcggcacagcgaccgcccctcctgaccagccctccgacgacggggatacaggatccgacgttgggtcgtactcctccatgcccccccttgagggggagccgggggaccccgatctcagcgacgggtcttggtctactgtgagcgaggaggccggtgaggacgtcgtctgctgctcgatgtcctacacatggacaggcgccttaatcacgccatgcggcgcggaggagactaagctgcccatcaatgcgttgagcaactctttgctgcgtcaccacaacatggtctatgccacaacatcccgcagcgcaagccagcggcagagaaaggtcacctttgacagactgcaagtcctggacgaccactaccgggacgtgctcaaggagatgaaggcgaaggcgtccacagttaaggctaaacttctatccgtagaagaagcctgcaagctgacgcccccacattcggccagatccaagtttggctatggggcaaaggacgtccggaacctatccagcaaggccgttaaccacatccgctccgtgtggaaggacttgctggaagacactgaaacaccaataaacaccaccatcatggcaaaaagtgaggtcttctgtgttcaaccagagaaaggaggccgcaagccagctcgccttatcgtattcccagatttgggggttcgtgtgtgcgagaaaatggccctttacgacgtggtctccactcttccccaagccgtgatgggctcctcatacgggttccagtactctcctgggcagcgggtcgagttcctggtgaatgcctggaaatcaaagaaaagccctatgggcttcgcatatgacacccgctgttttgactcaacggtcactgagagtgacatccgtgttgaggagtcaatttaccaatgttgtgacttggcccccgaggccagacaggtcataaggtcgctcacagagcggctttatatcgggggtcccctgactaattcaaaagggcagaactgcggttatcgccggtgccgcgccagcggtgtgctgacgactagctgtggcaatacccttacatgttacttgaaggcctctgcagcctgtcgagctgcgaagctccaggactgcacgatgctcgtgtgcggagacgaccttgtcgttatctgtgagagcgcggggacccaggaggacgcggcgaacctacgagtcttcacggaggctatgactaggtactctgccccccccggggacccgccccgaccggaatacgacctggagttgataacatcatgttcctccaacgtgtcggtcgcgcacgatgcagctggcaaacgggtgtactacctcacccgcgaccccatcacccccctcgcgcgggctgcgtgggagacagccagacacactccagtcaactcctggctaggcaacatcatcatgtatgcgcccaccttgtgggcaaggatgatcttgatgacccacttcttctccatccttctagctcaggagcaacttgaaaaggccctagattgtcagatctatggggccgtttactccattgaaccacttgacctacctcagatcattcaacgactccatggtcttagcgcattttcactccatagttactctccaggtgagatcaatagggtggcttcatgcctcaggaaacttggggtaccacccttgcgagtctggagacatcgggccaggagtgtccgtgctaagctactgtctcagggggggagggccgccacttgtggcaaatacctcttcaactgggcagtaaggaccaagctcaaactcactccaatcccggctgcgtcccagttggacttgtccggctggttcgttgctggctacagcgggggagacatatatcacagcctgtctcgtgcccgaccccgctggttcatgtggtgcctactcctactttctgtaggggtaggcatctatctgctccccaaccggtgagtggggagctaaacactccaggccaataggccatcctgtttttttttttcccttttttttttttttttttttttttttttttt

SEQ ID NO: 583 - DNA, 9616 bp, Hepatitis C Virus
gccagcccccgattgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcatcatgagcacaaatcctaaacctcaaagaaaaaccaaacgtaacaccaaccgccgcccacaggacgttaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggcaggacctgggctcagcccgggtatccttggcccctctacggcaacgagggcatggggtgggcaggatggctcctgtcaccccgtggttcccggcctagttggggccccacggacccccggcgtaggtcgcgtaatttgggtaaggtcatcgataccctcacatgcggcttcgccgacctcatggggtacattccgctcgtcggcgcccccctagggggcgctgccagggccctggcacatggtgtccgggttctggaagacagcgtgaactatgcaacagggaatttgcccggttgctctttctctatcttcctcttggctttgctgtcctgcttgaccaccccagcttccgcttatgaagtgcataacgtgtccgggatataccatgtcacgaacgactgctccaacgcaagcattgtgtatgaggcagcggacatgatcatgcatgcccccgggtgcgtgccctgcgttcgggaagacaacgcctcccgctgctgggtagcactcactcccacgctcgcggccaggaacgccagcgtccccactacgacaatacgacgccacgtcgacttgctcgttggggcggctgctttctgttccgctatgtacgtgggggatctctgcggatccgttttcctcatctcccagctgttcaccttctctcctcgccggcatgagacagtacaggactgcaactgctcaatctatcctggccacgtaacaggtcatcgcatggcttgggatatgatgatgaactggtcacctacaacagccctagtggtgtcgcagttgctccggatcccacaagccgtcatggacatggtggcaggagcccactggggagtcctggcgggccttgcctactattccatggcggggaactgggctaaggttttgatcgtgatgctactctttgccggcgttgacggaaacacccacgtgtcgggggcggtgcaaggccgcaccgtctcctccctcgcgaacatcttctcacttggggcgtctcagaaaatccagcttataaacaccaatggcagttggcacatcaacaggactgccctgaactgtaatgactccctccagactgggtttcttgccgcgctgttctacgcacacaagttcaacgcgtccggatgcccggagcgcatggccagctgccgctccattgacaagttcgatcagggatggggtcccatcacttatgctcaacctagcaacttggaccaaaggccttactgctggcactacgcacctcaacagtgcggtattgtgcccgcgtcgcaggtgtgtggtccagtgtattgcttcaccccaagccctgttgtggtggggacgaccgattcttccggtgtccccacatatagctggggggagaatgagacagacgtgctgctcctcaataacacgcgcccgccgcaaggcaactggttcggctgtacatggatgaacagcactgggttcaccaagacgtgcggggggcccccgtgtaacatcgggggggtcggcaacaacactttgacctgccccacggactgcttccggaagcaccccgaggccacttacacaaaatgtggttcgggtccttggttgacacctaggtgcttagttgactacccatacaggctctggcactacccctgcactgtcaactttaccatcttcaaggttaggatgtatgtggggggcgtggagcacagactccatgctgcatgcaactggactcggggagagcgttgcgacttggaggacagggatagatcagagctcagcccgctgctgctgtctacgacagagtggcagatactgccctgttccttcaccaccctaccggccttgtccactgggttaatccatctccaccagaacattgtggacgtgcaatacctgtacggtatagggtcagcggttgtctcctttgcaatcaaatgggagtatgtcctgctgcttttccttctcctggcggacgcgcgggtctgtgcctgcttgtggatgatgctgctgatagcccaggctgaggccgccttagaaaatctggtggtccttaacgcggcatccgtggccggggcgcatggctttctctccttccttgtgtttttctgtgccgcctggtacattaagggcaggctggtccctggggtggcatatgctctctatggcgtatggccattgctcctgctcctgctggcgttaccaccacgagcttacgctatggaccgagagatggctgcatcgtgcggaggcgcggtttttgtaggcctggcacttttgaccttgtcaccatactataaggtgttactcgccaggctcatatggtggctacaatatttcattgcaagagccgaagcgcacttgcaagtgtgggtcccccccctcaacgtccggggaggccgcgacgccatcatccttctcacgtgtgcggcccacccagagttaatctttgacatcaccaaactcctgctcgccatactcggtccgctcatggtgttccaggccggcataattagagtgccgtacttcgtacgcgctcaagggctcatccgtgtatgcatgttagtgcggaaagtcgctgggggtcattatgtccaaatggctctcatgaagctggccgcgctgacaggtacgtacgtttatgaccatcttactccactgcgggattgggctcacgcgggcctacgagaccttgcggtggcagtagaacccgtcgtcttctctgacatggagaccaagatcatcacatggggggcggacaccgcggcgtgtggggacatcatctcgggtctacctgtctccgcccgaaggggaaaggagatacttctgggacctgccgacagtcttgagggccgggggtggcgactccttgcgccaatcacggcctactcccaacagacacggggcctacttggttgtatcatcactagcctcacaggccgggacaagaaccaagtcgagggggaggttcaagtggtttccaccgcaacacaatctttcctggcgtcctgtgtcaacggcgtgtgttggaccgtctaccatggcgccggctcaaagaccctagccggcccaaaaggtccaattacccagatgtacactaatgtagaccaggacctcgtcggctggcaggcgccccccggggcgcgttccatgacaccgtgcacctgtggcagctcggacctctacttggtcacgagacatgccgatgtcattccggtgcgccggcggggcgacggtaggggaagtctactctcccccaggcctgtctcctacttgaagggctcttcgggtggtccgctgctctgcccttcggggcacgttgtgggcatcttccgagctgccgtgtgcacccggggggttgcgaaggcggtggactttgtgcccgttgagtctatggaaaccaccatgcggtctccggtcttcacagacaactcgtcccccccggctgtaccgcagacattccaagtggcccatttacacgcccccactggcagcggcaagagcaccaaagtgccggctgcatatgcggcccaagggtacaaggtactcgtcctgaatccgtccgttgccgccaccctgggttttggggcgtatatgtctaaggcacatggtaccgaccctaacatcagaactgggataaggaccatcaccacgggcgcccccatcacgtactccacctatggcaagttccttgccgacggtggttgctccgggggcgcctatgacatcataatatgtgatgagtgccactcaactgactcgaccaccatcttgggcattggcacagtcctggaccaagcggagacggctggagcgcggcttgtcgtgctcgccaccgctacgcctccaggatcggtcaccgtgccacaccccaatatcgaggaggtggccctgtccaacactggggagatccccttctatggcaaagccatccccattgaggccatcaaggggggaaggcatctcatcttctgccattccaagaagaagtgtgacgagctcgccgcaaagctgtcgggcctcggaattaatgctatagcgtattaccgaggccttgatgtgtccgtcataccgaccagcggagacgtcgttgtcgtggcaacggacgctctaatgacgggctttaccggcgactttgactcagtgatcgactgtaacacatgtgtcactcagacagtcgattttagtttggatcccaccttcaccatcgagacgacgaccgtgccccaagatgcggtgtcgcgcacgcagcggcgaggtaggactggcaggggtaggagaggcatctacaggtttgtgactccaggagaacggccttcgggcatgttcgattcttcggtcctgtgtgagtgttatgacgcgggttgtgcttggtacgagctcacgcccgctgagacctcggttaggttgcgggcttacctaaacacaccagggttgcccgtctgccaggaccatctggagttctgggagagtgtcttcacaggcctcacccacatagatgcccacttcttgtcccaaactaagcaggcaggagacaacttcccctacctggtagcataccaagccacggtatgcgccagggctcaggctccacctccatcgtgggaccaaatgtggaagtgtctcatacggcttaagcctactctgcacgggccaacgcccctgctgtataggctaggggccgtccacaatgaggtcaccctcacacaccccgtaaccaaatacatcatggcatgcatgtcggctgacctggaggtcgtcactagcacctgggtgctagtaggcggagttcttgcagctttggccgcgtattgtctgacaacaggcagcgtggtcattgtgggtaggatcatcttgtccgggaggccggccgtcattcccgatagggaagttctctaccgagagttcgatgagatggaagagtgcgcctcacacctcccttacatcgaacagggaatgcagctcgccgagcagttcaaacagaaggcgctcgggttgctgcaaacagccaccacgcaagcggaggctgctgctcccgtggtggagtccaagtggcgagccctcgaggccttttgggcgaagcacatgtggaacttcatcagcgggatacagtacttagcaggcttgtccactctgcctgggaaccccgcgatagcatcactgatggcattcacagcctctatcaccagcccgctcaccacccaaagtaccctcctgtttaacatcttggggggatgggtggcagcccarctcgccccccccagcgctgcttcggcttttgtgggcgccggcattgccggcgcggctgttggcagcataggcctcgggaaggtgcttgtggacattctggcgggctatggggcaggggtggctggcgcactcgtggcctttaaggtcatgagcggcgagatgccctccaccgaggacctggttaacttactccctgccatcctctctcctggcgccctggtcgtcggggtcgtgtgcgcagcaatactgcgtcgacacgtgggcccgggagagggggctgtgcagtggatgaaccggctgatagcgttcgcttcgcggggtaaccatgtctcccccacgcactatgtgcctgaaagcgacgccgcagcgcgtgtcactcagatcctctccagccttaccatcacccagttgctgaagaggcttcaccagtggattaatgaggactgctccacaccctgctccggttcgtggctaagggatgtttgggactggatatgcacagtgttgactgacttcaagacctggctccagtccaagctcctgccgcggttgccgggagtccccttcttctcatgccaacgtgggtacaagggagtctggcggggagacggcatcatgcaaaccacctgcccatgtggagcacagatctccggacatgtcaaaaatggttccatgaggattgttgggcctaaaacctgcagcaacacgtggcatggaacattccccatcaacgcatacaccacgggcccctgcacaccctccccagcgccaaactattccagggcgctgtggcgggtggctgctgaggagtacgtggaggttacgcgggtgggggatttccactacgtgacgggcatgaccactgacaacttaaagtgcccatgccaggttccgacccccgaattcttcacggaggtggatggagtgcggctgcacaggtacgctccggcgtgcaaacccctcctacgggaggaggtcgtattccaggtcgggctcaaccaatatctggttgggtcacagctcccatgtgagcccgaaccggatgtagcagtgctcacttccatgctcaccgacccctcccacatcacagcagagacggccaagcgtaggctggccagggggtctcccccctccttggccagctcttcagctagccagttgtctgcgccttccttgaaggcgacatgtactacccatcatgactccccggacgctgacctcatcgaggccaacctcctgtggtggcaggagatgggcgggaacatctcccgtgtggagtcagaaaataaggtgataattctggactccttcgacccgctccgggcagaggaggatgagagggaagtatccgtcccggcggagatcctgcggaaatccagggagttccccccagcgctgcccatatgggcacgcccggattacaaccctccactgctggagtcctggaaggacccggactacgtccctccggtggtacacgggtgcccattgccacctaccaagggccctccaataccacctccacggagaaagaggacggttgtcctgacggagtccaccgtgtcttctgccttggcggagcttgctactaagacctttggcagctccggatcgtcggccgtcgacagcggtacggcgaccgctcctcctgaccagacctctgacgacggcgacaaaggatccgacgttgagtcgtactcctccatgccccccctcgagggagagccgggggaccccgacctcagcgatgggtcttggtctaccgtgagcgaggaagctggtgaggacgtcgtctgctgctcaatgtcctacacatggacaggcgccctgattacgccatgcgctgcggaggaaagcaagctgcccatcaacgcgctgagcaactctttgctgcgtcatcacaatatgatctatgccacaacatcccgcagcgcaggcctgcggcagaagaaggtcacctttgacagactgcaggtcctggacgatcactaccgggacgtgctcaaggagatgaaggcgaaggcgtccacagtaaaggctaaacttctatctgtagaagaagcctgcaagctgacgcccccacattcggccaaatccaaatttggctatggggcaaaagacgtccggaacctatccagcaaggccgttaaccacatccgctccgtgtggaaggacttgctggaagactctgaaacaccaattgacaccaccatcatggcaaaaaatgagattttctgcgtccagccagagaaaggaggccgcaaacccgctcgccttatcgtattcccagacttgggagttcgtgtatgcgagaagatggccctctacgacgtggtctccactcttcctcaagccgtgatgggctcctcatatggattccagtactctcctgggcagcgggtcgagttcctggtaaatacctggaaatcaaagaaatgccctatgggtttttcatatgacacccgttgctttgactcaacggtcactgagaatgacatccgtattgaggagtcaatctaccaatgttgtgacttggcccccgaagccagacaggccataaggtcgctcacagagcggctctatgtcgggggtcccctgactaattcaaaagggcagaactgcggttatcgccggtgccgcgcgagcggtgtgctgacgactagctgcggtaataccctcacatgctacttgaaggcctctgcggcctgtcgagctgcgaagctccaggactgcacgatgctcgtgaacggagacgaccttgtcgttatctgtgaaagcgcgggaacccaagaggatgcggcgagcctacgagccttcacggaggctatgactaggtactccgccccccccggggacccgccccaaccagaatacgacttggagttgataacatcatgctcctccaatgtgtcggtcgcgcacgatgcatctggcaaaagggtgtactacctcactcgtgaccccaccaccccccttgcacgggctgcgtgggagacagctagacacactccagttaactcctggctaggcaatatcatcatgtatgcgcccaccttgtgggcaaggatgatcctgatgacccatttcttttccatccttctagcccaggagcaacttgaaaaggccctggattgtcaaatctacggggcctgttactccattgagccacttgacctacctcagatcattgagcgactccatggtcttagcgcattttcactccatagttactctccaggtgagatcaatagggtggcttcatgcctcaggaagcttggggtaccacccttgcgagtctggagacatcgggccagaagtgtccgcgctaagctactgtcccagggggggagggcagccacttgtggcaagtacctcttcaactgggcggtaaaaaccaagcttaaactcactccaatcccggctgcgtcccggttggacttgtccggctggttcgttgctggttacagcgggggagacatatatcacagcctgtctcgtgcccgaccccgctggttcatgttatgcctactcctactttcygtaggggtaggcatctacctgctccccaaccggtgaacggggagctaaacactccaggccaataggccattccctttttttttttttttttttttttttttttttttttttttttttttttttttttttttttttttttttttttttttttttttctcttcttttctttattccttctttggtggctccatcttagccctagtcacggctagctgtgaaaggtccgtgagccgcatgactgcagagagtgctgatactggcctctctgcagatcatgt

SEQ ID NO: 584 - DNA, 9571 bp, Hepatitis C Virus
atagatcactcccctgtgaggaactactgtcttcacgcagaaagcgtctagccatggcgttagtatgagtgtcgtgcagcctccaggtccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcatcatgagcacaaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgtcgacccgagggcaggacctgggctcagcccgggtacccttggcccctctatggcaatgagggcctggggtgggcaggatggctcctgtcaccccgcggctcccggcctagttggggccccacggacccccggcgtaggtcgcgtaatctgggtaaggtcatcgatacccttacatgcggcttcgccgacctcatggggtacattccgctcgtcggcgcccccttagggggcgctgccagggccctggcgcatggcgtccgggttctggaggacggcgtgaactatgcaacagggaatctgcccggttgctctttctctatcttcctcttggctttgctgtcctgtttgaccatcccagcatccgcccatgaagtgcgcaacgcgtccggggtgtaccatgtcacgaacgactgctcaaactcaagcattgtgcaggaggcagcggacatgatcatgcacacccccgggtgcgtgccctgcgtccgggagagcaattcctcccgctgctgggtagcgctcactcccacgctcgcggccaggaacagcagcatccccaccacgacgatacggcgccacgtcgatttgctcgttggggcggctgctctctgctccgctatgtacgtgggggatctctgcggatctgtttttctcgtctcccagctgttcaccttctcaccccgccggtatgagacggtacaggactgcaattgctcgatctatcccggccacgtatcaggtcaccgcatggcttgggatatgatgatgaattggtcacctacaacagccttggtggtatcgcagttgctccggatcccacaagccgtcatggatatggtggcgggagcccactggggagtcctggcgggccttgcctactattccatggtggggaactgggctaaggtcttgattgtgatgctactctttgccggcgtcgacgggcaaacccgcgtgtctggggggacggcaggccgcaccacttttggccttacgtccttcttcacacttgggccgaaccagaaaatccaacttataaacaccaatggcagctggcacatcaacaggactgccctgaattgcaatgactccctcaacaccgggttccttgccgcgctgttctacgcacacaggttcaactcgtccggatgcccagagcgtatggccagctgtcgccccatcgacaagttcgctcaggggtggggtcctatcactcatgttgagcctgacatcttggaccagaggccttattgctggcactatgcacctcgaccgtgcggtattgtacccgcgtcggaggtgtgtggtccagtgtattgcttcaccccaagccctgttgtggtgggaacgaccgatcgctctggcgcccccacgtatagctggggggagaatgagacggacgtactactcctcaacaacacgcggccgccgcaaggcaactggttcggctgcacatggatgaacagcaccgggttcaccaagacgtgcgggggccccccctgtaatatcgggggggtcggcaacaacaccttgacctgccctacagattgcttccggaagcaccccgaggccacttacaccaaatgcggctcggggccttggttgacacccaaatgtatggttcattacccatacaggctttggcactacccctgcactgtcaactttaccatcttcaaggtcaggatgtatgtggggggcgtggagcataggctcaacgccgcgtgcaattggactcgaggagaacgctgtgacttggaggacagggatagatcagagctcagtccgctgctgctgtctacaacagagtggcaggtgctgccctgttccttcaccaccctaccggctttgtccactggtttgatccacctccatcagaacatcgtggacgtgcaatacctgtacggcgtagggtcggcggttgtctccgttgtcatcaagtgggaatatgtcctgctgctcttcctcctcctggcggacgcgcgcgtctgcgcctgcttatggatgatgctgctgatagcccaagctgaggctgccttagagaacctggtagtcctcaatgcggcgtccgtggccggagcgcacggcgttctctcctttcttgtgtttttctgtgctgcctggtacatcaagggcaagctggtccctggggcggcatatgccttttatggcgtatggccgctgcttctgctcctgctggcgttaccacaacgagcatacgccatggaccgggagatggctgcatcgtgcggaggcgcggttttcataggtctggtactcctgaccttgtcaccacactacaaagtgttcctcgccaggctcatatggtggttgcaatatttcatcaccaggaccgaggcgcacttgcaagtgtggatcccccctctcaacgttcgggggggccgcgatgccatcatcctcctcacatgtgcggtccactcagagctaatttttgaaatcaccaaaatcttgctcgccatactcggtccgctcatggtgctccaggctggcctaactagagtgccgtacttcgtgcgcgctcaagggctcatccgtgcatgcatgttggtgcggaaggtcgctgggggtcattatgtccaaatggttctcatgaagctggccgcactgacgggcacgtacgtttacaaccatcttactccgctgcgggattgggcccacacgggcctgcaagaccttgtggtggcagttgagcccgtcgtcttctctgatatggagaccaagatcatcacctggggggcagacaccgcggcgtgtggggacatcatcttgggcctgcccgtctccgctcgaagggggagggagatactcctgggaccggctgatagatttggagagcaaggatggcgactccttgcgcctatcacggcctactcccaacagacgcggggcctacttggatgcatcatcactagcctcacaggtcgggacaagaaccaggtcgagggggaagttcaggtggtttccaccgcgacgcaatccttcctggcgacctgtgtcaacggcgtgtgttggactgtctaccatggtgccggctcaaagaccctagccggcccaaagggtccaatcacccaaatgtacaccaatgtagaccaggacctcgtcggctggcaggcgcctcccggggcgcgttccatgacaccatgcacctgcggcagctcggacctttatttggtcacaaggcatgccgatgttattccggtgcgccggcggggcgacaacagaggaagcctactctcccccaggcctatctcctatttgaaggggtcctcgggtggtccactgctctgcccctcggggcacgttgtgggcatcttccgggccgccgtgtgcacccgaggggttgctaaggcggtggaattcatacccgttgagtccatggaaactactatgcggtccccggtcttcacagacaactcatctcccccggccgtaccgcagacattccaagtggcccacctacacgctcccaccggcagcggcaagagtactaaggtgccggctgcatatgcagcccaagggtacaaggtactcgtcttaaacccgtccgttgccgccactttaggttttggggcgtatatgtctaaggcacatggtgttgaccccaacatcagaactggggtaaggaccatcaccacgggcgcccccattacatactccacctatggtaagttccttgccgacggtggttgctctgggggcgcctatgacatcataatatgtgatgagtgccactcaactgactcaacctccatcctgggcattggcacagtcctggaccaagcggagacggctggagcgcgactcgtcgtgctcgccaccgctacacctccgggatcaatcaccgtgccacatcccaatatcgaggaggtagccttgtccaacaccggagagattcccttctatggcaaggctatccccctcgaggtcatcaagggggggagacatctcattttctgtcattccaagaagaaatgtgacgagctcgctgcaaagttgttggccctcggagtgaacgctgtagcgtactaccggggtcttgatgtgtccgtcataccgacaagcggggacgtcgttgtagtggcaacagacgctctgatgacgggctacaccggcgactttgactcagtgatcgactgtaacacatgtgtcacccagacagtcgatttcagcttggacccgaccttcaccattgagacgacgaccgtgccccaagacgcggtgtcgcgctcgcagcggcgaggcaggactggaaggggcagagggggcatatacaggtttgtgactccaggggaacggccctcgggcatgttcgattcttcggtcctgtgtgagtgctatgacgcgggctgtgcttggtacgagctcacgcccgctgagacttcggtcaggttgcgggcttacctaaatacacctgggttgcccgtctgccaggatcatttggagttttgggagggcgttttcacaggcctcacccatatagatgcccacttcttgtcccagactaagcaggcaggagatcacttcccctatctggtagcataccaagccacagtgtgcgccagggcccaggctccacctccatcatgggaccaaatgtggaagtgtctcacacggctaaagcctacgctacatgggccaacgcccctgttgtacaggctaggagccgtccaaaatgaggtcaccctcacacaccccataaccaaattcatcatgacatgcatggcggctgacctagagatcgccacgagcacctgggtgttagtgggcggggtccttgcagctctggccgcgtactgtctgacaacaggcagcgtggtcattgtgggcaggatcatcttgtccgggaggccggccgttgttcccgacagggaggttctctatcaggagttcgatgaaatggaagagtgtgcctcacacctcccctacatcgaacagggaatgcagctcgccgagcaattcaagcagaaggcgctcggattgctgcaaacagccaccaaacaagcagaggctgctgctcccgtggtggagtccaaatggcggggccttgaggccttctgggcgaagcacatgtggaacttcatcagcgggatacagtatttagcaggcttgtccactctgcctgggaaccccgcgatagcatcactgatggcattcacagcctctatcaccagcccactcaccacccaacataccctcttgttcaacatcttggggggatgggtagctgcccaactcgccccccctagcgctgcctcagctttcgtgggcgccggcatcgctggcgcggctgtaggcagcataggccttgggaaggtgcttgtggacattctggctggttatggagcaggggtggcaggcgcactcgtggccttcaaggtcatgagcggcgagatgccctccaccgaggacatggtcaacttactccctgccatcttctctcctggtgccctggtcgtcggggtcgtgtgcgcagcaatactgcgtcggcatgtgggcccaggggagggggctgtgcagtggatgaaccggctgatagcgttcgcttcacggggaaaccacgtctcccccacgcactatgtgcctgagagcgacgccgcagcgcgtgtcacccaagtcctctccagccttactatcactcagctgctgaagaggctccaccagtggatcaatgaggactgttccacgccatgttccggctcatggctcagggacgtttgggactggatatgcacggtattgactgatttcaagacctggctccagtccaagctcctgccacggatgccgggagttcccttcttttcatgccaacgtgggtacaagggagtctggcggggagatggtgttatgcacaccacctgcccctgtggagcagacatcaccggacatgtcaaaaacggttccatgaggatcgttgggcccaaaacctgtagcaacacgtggcacggaacattccccgtcaacgcatacaccacaggcccctgcacgccctccccagcgccaaactattccaaggcgttgtggcgggtggctgctgaggagtatgtggaggtcacgcgggtgggggatttccactacgtgacgggcatgaccactgacaacgtaaaatgcccatgccaggttccggcccctgaattcttcacggagttggatggggtgcggttgcacaggtacgctccggcgtgcaaacctctcctacgggatgaggtcacattccaggtcgggctcaaccagtacccggttgggtcacagctcccatgtgagcccgaaccggatgtaacagtgatcacttccatgctcaccgacccctcccacatcacagcagaagcggccaagcgcaggctggccagggggtgtcccccctccctggccagctcgtcggctagtcagctgtctgcgccctctttgaaggcgacatgcactacctaccatggctccccagacgctgacctcatcgaggccaacctcctgtggcggcaggagatgggcgggaacatcacccgcgtggagtcagagaataaagtagtgattctagactcttttgacccgcttcgagcggaggaggatgagagggaagtatccgttgctgcggagatcctgcggaaaaccaggagattccccccagcgctgcccatatgggcacgcccggattacaacccaccactgatagagtcttggaggaaaccggattacgtccctccggtggtacacgggtgtccattgccatctaccaagggccctccaataccacctccacggagaaagaggacggttatcctgacagaatccactgtgtcttctgccttggcggagcttgctacaaagaccttcggcagttccggatcgtcggccgccgatagtggcacagcgaccgcccctcctgatcagacctccgacgacggcgacgcaggatccgacgttgagtcgtactcctccatgcccccccttgagggggagccgggggaccccgatctcagtgacgggtcttggtctactgtgagtgaggaggttggtgaggacgtcgtctgctgctcgatgtcctacacatggacaggcgctttgatcacgccatgcgccgcggaggagagcaagctgcccatcaatgcgttgagcaactccctgctgcgccaccacaacatggtctacgccacaacatcccgcagcgcaagccaacggcagaagaaggtcaccttcgacagactacaagtcctggacaaccattaccaggacgtactcaaggagatgaaggcgaaggcgtccacagttaaggccaaacttctatccgtagaagaagcctgcaagctgacgcccccacattcggccagatccaagtttggctatggggcaaaggacgtccggaacctatccagcaaggccgtcaaccacatccactccgtgtggaaggacttgctggaagacactgacacaccaattgacaccaccatcatggcaaaaaatgaggtcttctgtgttcaaccagagaagggaggccgtaaggcagctcgccttatcgtattcccagacttgggggttcgtgtgtgcgagaagatggccctttacaacgtggtctccactcttccccaggccgtgatgggctcctcatacgggttccagtactctcctggacagcgggtcgagttcctggtgaatgcctggaagtcaaagaaaacccctatgggctttgcatatgacacccgctgttttgactcaacggtcactgagagtgacatccgtgtcgaggagtcaatttaccaatgttgtgacttggcccccgaggccagacaggtcataaggtcgctcacagagcggctttatatcgggggccccctgactaattcaaaagggcagaactgcggttatcgccggtgccgcgccagcggcgtactgacgactagctgcggtaatacccttacatgctacttgaaggcctctgcagcctgtcgagctgcaaagctccaggactgcacgatgctcgtgtgcggtgacgacctcgtcgtcatctgtgaaagcgcgggaactcaggaggacgcggcgagcctacgagtcttcacggaggctatgactaggtactctgccccccccggggacccgccccgaccggaatacgacttggagctgataacatcatgctcctccaacgtgtcggtcgcgcacgatgcatctggcaaacgggtgtactacctcacccgcgaccccaccaccccccttgcgcgggctgcgtgggagacagccaaacacactccagtcaactcctggctaggcaacatcattatgtatgcgcccaccttatgggcaaggatgatcctgatgacccatttcttctccatccttctagctcaggagcaacttgaaagagccctggattgtcagatctatggggccatttactccattcagccacttgacctacctcagatcattcagcgactccatggtcttagcgcattttcactccatagttactctccgggtgagatcaatagggtggcttcatgcctcaggaaacttggggtaccacccttgcgagtctggagacatcgggccaggagcgtccgcgctaagctactgtcccagggggggagggccgccacttgtggcagatacctcttcaactgggcagtaaggaccaagctcaaactcactccaatcccggctgcgtcccaactggatttgtccggctggttcgttgctggttacagcgggggagacatatatcacagcctgtctcgcgcccgaccccgctggtttatgtggtgcctactcctactttctgtaggggtaggcatctatctgctccccaaccggtgaatggggagctaaccactccaggcctataggccgttcctttttttttttttttttttttttttttttttttttttttttttttttttttttttttttttttttcttttccccttttttatttttctttcttggtggctccatcttagccctagtcacggctagctgtgaaaggtccgtgagccgcatgactgcagagagtgctgatactggcctctctgcagatcatgt

SEQ ID NO: 585 - DNA, 9573 bp, Hepatitis C Virus
atagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcatcatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccagcccgagggcagggcctgggctcagcccgggtacccttggcccctctatggcaatgagggcctggggtgggcaggatggctcctgtcaccccgtggctctcggcctagttggggccccacggacccccggcgtaggtcgcgtaatttgggtaaagtcatcgataccctcacatgcggcttcgccgacctcatggggtacattccgctcgtcggcgcccccctagggggcgctgccagggccctggcgcatggcgtccgggttctggaggacggcgtgaactatgcaacagggaacttgcccggttgccctttctctatcttcctcttggctctgctgtcttgtttgaccatcccagcttccgcttatgaagtgcgcaacgtgtccggggtgtaccatgtcacgaacgactgctccaactcaagtattgtgtatgaggcagcggacatgatcatgcacacccctggatgcgtgccctgcgtccgggaggacaacgtctcccgctgctgggtagcgctcactcccacgctcgcggccaggaacagcagcatccccactacgacaatacggcgccacgtcgacttgctcgttggggcggctgctctctgctccgctatgtacgtgggggatctctgcggatctgtcttcctcgtttcccagctgttcaccttctcacctcgccggtatgagacggtacagacctgcaattgctcaatctatcccggccacgtatcaggccaccgcatggcttgggatatgatgatgaactggtcgcccacaacagccctagtggtatcgcagttgctacggatcccacaagccgtcgtggacatggtggcaggggcccactggggagtcctggcgggccttgcctactattccatggtggggaactgggctaaggtcttgattgtgatgctgcttttcgccggcgttgatgggaacacccacgtgacagggggacaggcaggccagcacgccatcaggtttacatccctgttctcatctggggcgtctcagaaaatccaacttataaacaccaacggcagctggcacatcaacagaaccgctctgaattgcaacgactccctccacactgggttcattgccgcgttgttctacgcacataagttcaatgcgtccggatgcccggagcgcatggccagctgccgccccattgacaagttcgaccaggggtggggccccatcagtcatgttgtgcctaacatctcggaccagaggccttattgctggcactacgcacctcgaccgtgcggtatcgtacccgcgtcgcaggtgtgcggtccagtgtattgcttcaccccaagccctgtcgtagtggggacgaccgatcggttcggcgtccccacgtatacctggggggagaatgagacggacgtgctgctcctcaacaacacgcggccgccgcagggcaactggttcggctgtacatggatgaatggcaccgggttcaccaagacgtgcggaggccccccgtgtaatatcgggggggccggcaacaacaccttgacttgccctacggattgcttccggaagcaccccgaggccacttacaccaagtgtggctcggggccttggttgacacctaggtgcatagttgactatccatacagactttggcactacccctgcactgtcaactttaccatctttaaggtcaggatgtatgtggggggcgtggagcacaggctcaacgccgcgtgcaactggactcgaggagagcgttgtaacttggaggacagggataggtcagagcttagcccgctgctactgtctacaacagagtggcagataatgccctgttccttcaccaccctaccggctctgtccactggtttgatccatctccaccagaacattgtggacgtgcaatacctatatggtgtagggtcagcggttgtctccattgtcatcaaatgggagtacgttgtgctgctcttccttcttctggcggacgcgcgcgtctgcgcctgtttgtggatgatgctgctgatagcccaggccgaggccgccttagagaacctggtggtcctcaatgcggcgtccgtagccggagcgcacggcaccctctccttccttgtgttcttctgtgcagcctggtacatcaagggcaagctggtccccggggcggcatatgctttctatggcgtgtggccgctgctcctgctcctactggcgttaccaccacgggcgtacgccatggaccgggagatggctgcatcgtgcggaggcacggttttcgtaggtctggtactcttgaccctgtcaccacactataaggtattcctcgccaggctcatatggtggttacaatacttcatcaccagggccgaggcatgcttgcaggtgtggatcccccccctcaacgttcgggggggccgtgatgccatcatcctcctcacgtgtgcggtccacccagagctggtctttgaaatcaccaaaatcttgctcgccatacttggtccgctcatggtgctccaggctggcctaactagagtgccgtacttcgtgcgcgctcaagggctcatccgtgcatgcatgttggtgcggaaagtcgctgggggtcattatgtccaaatggctctcatgaagctggccgcactgacgggtacgtacgtatatgaccatctcacgccgctacgggactgggcccacgcgggcctacgagaccttgtagtggcggttgagcccgtcatcttctctgacatggagaccaagattatcacctggggggcagacaccgcagcgtgtggggacatcatcttgggcctacccgtctccgcccgaagggggagggagattcttctgggaccggccgacagttttggagagcaggggtggcgactccttgcgcccatcacggcctattcccagcagacacggggcttacttggctgcatcattaccagtctcacaggtcgggacaagaaccaggtcgagggggaggttcaggtggtttccaccgcaacgcaatctttcttggcgacctgcgtcaacggcgtgtgctggactgtctaccatggtgccggctcaaagaccctagccggcccaaaggggccgatcacccaaatgtacaccaatgtagatcaggacctcgtcggctggccggcgccccccggggcgcgctccttgacaccgtgcacctgcggcagctcggacctttatttggtcacgagacatgctgatgtcatcccggtgcgccggcggggcgacagcagggggagtctactttcccccaggcccatctcctacttgaagggctcctcgggcggtccgctgctctgcccctcggggcacgctgtgggcatcttccgggctgctgtgtgcacccggggggttgcgaaggcggtggactttgtacccgttgagtctatggaaactactatgcggtctccggtcttcacggacaattcgtcccccccggccgtaccgcagacattccaagtggcccatatacacgcccccactggcagcggcaagagcaccaaggtgccggctgcatatgcagcccaagggtacaaggtactcgtcctgaacccgtccgtcgccgccaccttaggtttcggggcgtacatgtccaaggcacatggtgtcgaccctaacatcaggactggagtaaggaccatcaccacgggcgcccccatcacgtattccacctacggcaagttccttgccgacggtggttgctctgggggcgcctatgacatcataatatgtgatgagtgccactcaactgactcgacttccatcttgggcattggcacggtcctggaccaagcggagacggctggagcgcggctcgtcgtgctcgctaccgctacccctccgggatcggtcaccgtgccacatcccaacattgaggaggtggccttgtccaacactggagagatccccttctatggcaaagccatccccctcgaggccatcaagggggggaggcatctcattttctgccattccaagaagaaatgtgatgaactcgccgcaaagctgtcgggcctcggagtcaatgctgtagcgtattaccggggtcttgatgtgtccgtcataccgaccagcggagacgtcgttgtcgtggcaacagacgctctaatgacgggctacaccggtgactttgactcagtgatcgactgtaatacatgtgtcacccagacagtcgatttcagcttggaccctactttcaccattgagacgacgaccgtgccccaagacgcggtgtcgcgctcacagcggcgaggcaggactggtaggggcaggaggggcacctacaggtttgtgactccaggagagcggccttcgggcatgttggattcttcggtcctgtgtgagtgctatgacgcgggctgtgcttggtatgaactcacgcccgccgagacctcggttaggttgcgggcttacctaaatacaccagggttgcccgtctgccaggaccatttggagttctgggagagtgtcttcacaggcctcacccacatagatgcccatttcttgtcccagactaaacaggcaggagacaacttcccctacctggtggcataccaggccacagtgtgcgccagggctcaggctccacctccatcgtgggatcaaatgtggaagtgtctcatacggctaaaacctacgctgcacgggccaacacccctgttgtataggctaggagccgtccaaaacgaggtcaccctcacacaccccataaccaaatacatcatggcatgcatgtcggctgacctggaggtcgtcacgagcacctgggtgctagtgggcggggtcctcgcagctctggccgcgtattgcctgacaacaggcagcgtggtcattgtgggcaggatcatcttgtccgggaagccggccatcattcccgacagggaagttctctaccaggagttcgatgaaatggaagagtgcgcctcacacctcccttacatcgaacagggaatgcagctcgccgagcaattcaagcagaaggcgctcgggttgctgcagacggccaccaagcaggcggaggctgctgctcccgtggtggagtccaagtggcgagcccttgagaccttctgggcgaagcacatgtggaatttcatcagcgggatacagtacttagcaggcttgtccactctgcctgggaaccccgcgatagcatcactgatggcattcacagcctctatcaccagcccgctcaccacccaacataccctcctgttcaacatcttggggggatgggtggccgcccaactcgctccccccagcgctgcttcagctttcgtgggcgccggcatcgccggcgcggctgttggcagcataggccttgggaaggtgcttgtggacatcctggcgggttatggagcaggggtggcaggcgcacttgtggcctttaagatcatgagtggcgagacgccctccactgaggacctggtcaacttactccctgccatcctctcccctggagccctggtcgtcggggtcgtgtgcgcagcaatactgcgtcgacacgtgggcccgggagagggggctgtgcagtggatgaaccggctgatagcgttcgcttcgcggggtaaccacgtatcccccacgcactatgtgcctgagagcgacgccgcagcgcgtgtcactcagatcctctccagccttaccatcacccagctgttgaagaggctccaccagtggatcaatgaggactgctccacgccatgctccggctcgtggctcagggatgtttgggactggatatgcacggtgttggttgatttcaagacctggctccagtccaaggtcctgccgcggttaccgggagtccctttcctctcatgccaacgtgggtacaagggagtctggcgcggagacggcatcatgcaaaccacttgcccatgtggggcacagattgccggacatgtcaaaaacggttccatgagaatcgtcgggcctagaacctgcagcaacacgtggcatggaacattccccatcaacgcatacaccacgggcccctgcacaccctccccggcgccaaactattccagggcgttgtggcgggtggctgctgaggagtacgtggagattacgcgggtgggggatttccactacgtgacgggcatgaccactgacaacataaaatgcccatgccaggtcccggcccccgaattcttcacagaactagacggggtgcggctgcacaggtacgctccggcgtgcaaacctctcctacgggatgaggtcacattccaggtcgggctcaaccaatacgtggttgggtcacagcttccatgtgagcccgaaccggacgtaacagtgcttacttccatgctcaccgacccctcccacattacagcagagacggctaagcgtaggctggccagggggtcccccccctctttggccagctcttcagctagtcagttgtctgcgccttccctgaaggcgacatgcaccacccgtcaagactccccagacgctgacctcatcgaggccaacctcctgtggcggcaggagatgggcgggaacatcacccgtgtggagtcagagaataaggtggtaatcctggactcttttgaaccgcttcgggcggaggaggatgagagggaagtatccgttgcggcggagatcctgcggaaatccaggaagttccccccggcgctgcccgtatgggcacgcccggattacaaccctccactcatagagtcttggaaggacccagactacgtccctccggtggtacacgggtgcccattgccacctactaaggcccctccaataccacctccacggaggaagaggacggttgtcctgacagaatccaccgtgtcttctgccttggcggagcttgctacaaagacctttggcagctccggatcgtcggccgtcgacagcggcacagcgaccgcccctcctgatcagccctccgatgacggagacgcaggatccgacgttgagtcgtactcctccatgcccccccttgagggagagccgggggaccccgatctcagcgacgggtcttggtctactgtgagcgaggaggctagtgaggatgtcgtctgttgctcaatgtcctacacatggacgggcgccctgatcacaccatgcgctgcggaggaaagcaagctgcccatcaacgcgttgagcaactctttgctccgccaccacaacatggtctatgccacaacatcccgcagcgcaagccaacggcagaagaaggtcacctttgacagactgcaagtcctggacgaccactaccgggacgtgctcaaggagatgaaggcgaaggcgtccacagttaaggccaaacttctatctgtagaagaagcctgtaagctgacgcccccacattcggccagatccaaatttggctatggggcaaaggacgtccggaacctatccagcagggccgttaaccacatccgctccgtgtggaaggacctgctggaagacactcagacaccaattgacaccaccgtcatggcaaaaaatgaggttttctgtgtccaaccagagaaaggaggccgcaagccagctcgcctcatcgtgttcccagatttgggggttcgtgtgtgcgagaaaatggccctttatgacgtggtctccacccttcctcaggccgtgatgggcgcctcatacggattccagtactctcctggacagcgggtcgagttcctggtgaatgcctggaaatcaaagagatgccctatgggcttcgcatatgacacccgctgttttgactcaacggtcactgagagtgacatccgtgttgaggagtcaatataccaatgttgtgacttggcccccgaagccagacaggccataaggtcgctcacagagcggctttatgtcgggggtcccctgactaattcaaaagggcagaactgcggttatcgccggtgccgcgcaagcggtgtgctgacgactagctgcggtaataccctcacatgttacttgaaggccactgcggcctgtcgagctgcaaagctccaggactgcacgatgctcgtgtgcggagacgaccttgtcgttatctgtgaaagcgcgggaacccaggaggacgcggcaagcctacgagtcttcacggaggctatgactaggtactctgccccccccggggacccgccccagccagaatacgacttggagctgataacatcatgctcctccaacgtgtcggtcgcgcacgatgcgtctggcaagcgggtgtattacctcacccgcgaccccaccaccccccttgcgcgggctgcgtgggagacagctagacacactccagttaactcctggctaggcaacatcatcatgtatgcgcccaccttatgggcaaggatgattctgatgactcacttcttctccatccttctagctcaggagcaacttgaaaaagccctggattgtcagatctacggggccacttactccattgagccacttgacctacctcaaatcattcagcgactccacggtcttagcgcattttcactccatagttactctccaggtgagatcaatagggtggcttcatgcctcaggaaacttggggtaccacccttgcgagtctggagacatcgggccagaagtgtccgcgctaagctactgtcccagggggggagggccgccacttgtggcaaatacctcttcaactgggcagtaaggaccaagcttaaactcactccaattccggctgcgtcccagttggacttgtccggctggttcattgctggttacagcgggggagacatatatcacagcctgtctcgtgcccgaccccgctggttcatgtggtgcctactcctactttctgtaggggtaggcatttacctgctccccaaccgatgaacggggagctaaacactccaggccaataggccatcctgtttttttgttttttctttttttttttttttttttttttttttttttttttttttttttctttttttcccttttttttattttattttcttttggtggctccatcttagccctagtcacggctagctgtgaaaggtccgtgagccgcatgactgcagagagtgctgatactggcctctctgcagatcatgttt

SEQ ID NO: 586 - DNA, 9547 bp, Hepatitis C Virus
ccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcatcatgagcacaaatcctaaacctcaaagaaaaaccaaacgtaacaccaaccgccgcccacaggacgtcaagttcccgggcggtggtcagatcgttggtggagtttacctgttgccgcccaggggccccaggttgggtgtgcgcgcgactaggaagacttccgagcggtcgcaacctcgtggaaggcgacaacctatccccaaggctcgccagcccgagggcagggcctgggctcagcccgggtatccttggcccctctatggcaatgagggcctggggtgggcaggatggctcctgtcaccccgtggctctcggcctagttggggccccacggacccccggcgtaggtcgcgtaatttgggtaaggtcatcgataccctcacatgcggcttcgccgacctcatggggtacattccgctcgtcggcgcccccctagggggcgctgccaaggccctggcacatggtgtccgggttctggaggacggcgtgaactatgcaacagggaatttgcccggttgctctttctctatcttcctcttggctttgctgtcctgtttgaccatcccagcttccgcttatgaagtgcgcaacgtgtccgggatatatcatgtcacgaacgactgctccaactcaagcattgtgtatgaggcggcggacgtgatcatgcatgcccccgggtgcgtgccctgcgttcgggagaacaactcctcccgctgctgggtagcgctcactcccacgctcgcggccaggaactccagcgtccccaccacgacaatacgacgtcacgtcgacttgctcgttgggacggctgctttctgctccgctatgtacgtgggggatctctgcggatctgttttcctcatctcccagctgttcaccttctcgcctcgccggcatgagacagtacagagctgcaattgctcactctatcccggccacgtaacaggtcatcgcatggcttgggatatgatgatgaactggtcgcccacagcagccctcgtggtgtcgcagttactccggatcccacaagctgtcatggacatggtggcgggggcccactggggagtcctggcgggccttgcctactactccatggtggggaactgggctaaggttttgattgtgatgctactcttcgccggcgttgacggaggcacccacgtgacggggggcgcgcaaggccgcagcgccttccggctcacgtccttctttacatctggggcgtctcagaaaatccagcttataaacaccaatggcagttggcacatcaacaggactgccctgaactgcaatgactccctccacactgggttccttgccgcgctgttctacacacacaggttcaacgcgtccggatgcccggagcgcctggccagctgccgctccattgacacgttcgatcagggatggggtcccatcacttatgctcaacctagcagctcggaccagaggccttactgctggcactacgcacctcgaccgtgcggtatcgtacccgcgtcgcaggtgtgtggtccagtgtattgtttcaccccaagcccggttgtggtggggacgaccgatcgtttcggtgtccctacgtatagctggggggagaatgagacagacgtgctgctcctcaacaacacgcggccaccgcaaggcaactggttcggctgtacatggatgaatagcactgggttcaccaagacgtgtgggggccccccgtgtaacatcgggggggccggcaacaacaccttaacatgccccacggactgcttccgaaagcaccccgaggccacttacacaaaatgtggttcgggcccttggttgacacctaggtgcatggttgactacccatacaggctctggcattacccctgcactgtcaactttaccatcttcaaggttaggatgtatgtggggggcgtggagcacaggctcaatgccgcatgcaactggactcgaggagagcgttgcaacttggaggacagggatagatcagagctcagtccgctgctgctgtctacgacagagtggcagatactgccctgttccttcaccaccctaccggctctgtccactggtttaatccatctccaccagaatgtcgtggacgtgcaatacctgtacggtgtagggtcagcggttgtctcccttgtaatcaaatgggagtatgtcctgctgcttttcctcctcctggcggacgcgcgcgtctgtgcctgtttgtggatgatgctactgatagcccaggctgaggccgccttagagaacctggtggtcctcaatgcagcgtccgtggccggagcgcatggcattctctccttcctggtgttcttctgtgctgcctggtacatcaaaggcaagctggtccctggggcggcatatgctttctatggcgtatggccgttactgctgctcctgctggcgttaccaccacgagcttacgccatggaccgagagatggctgcatcatgcggaggcggggtttttgtaggtctggtacttttgaccttgtcaccatactacaaagtgttcctcgccaagctcatatggtggttacaatattttatcaccagggctgaggcgcacttgcaagtgtgggtcccccccctcaacgttcggggaggccgtgatgccatcatcctcctcacgtgtgcggcccacccagagctaatttttgacatcaccaaactcctgctcgccatattcggtccgctcatggtgctccaggctggcataactagagtgccgtacttcgtacgcgctcaagggctcatccgtgcatgcatgttagtgcggaaagttgctgggggccattatgttcaaatggccttcatgaagctggccgcgctgacgggtacgtacgtttatgaccatcttactccactgcgggactgggcccacacgggcctacgggaccttgcagtggcagtagagcccgtcgtcttttctgacatggagaccaagatcatcacgtggggggcggacaccgcggcgtgtggggacatcatctcgggtctgcccgtctccgcccgaaggggaagggagatacttctgggacctgctgacagtcttgaagggcaggggtggcgactcctcgcgcccatcacggcctactctcaacagacgcgaggcctacttggttgtatcatcactagcctcacaggccgggacaagaaccaagtcgagggggaggttcaagtggtttccaccgcaacacaatctttcctggcgacctgcgtcaacggcgtgtgttggactgtctatcatggcgccggctcaaagaccctagctggcccaaaaggcccaatcacccaaatgtacaccaatgtagaccaggacctcgtcggctggcaggcgccccccggggcgcgttccttgacaccatgcacctgcggtagctcggacctttacttggtcacgagacacgctgacgtcattccggtgcgccggcggggcgacagcagggggagtctgctctcccccaggcccgtctcctacctgaagggctcttcgggtggtccactgctctgcccttcggggcacgttgtgggcatcttccgggctgccgtgtgcacccggggggttgcgaaggcggtggacttcgtgcccgtcgaggctatggagaccactatgcggtcgccggtcttcacagacaactcatcccccccggccgtgccgcagacattccaagtagcccatctacacgcccccactggcagcggcaagagcactaaggtgccggctgcatatgcagcccaagggtacaaggtacttgtcctgaacccgtccgttgccgccactttaggctttggggcgtatatgtctaaggcacatggtaccgaccctaacatcagaactgggataaggactatcaccacgggcgcccccatcacgtactccacctatggcaagttccttgccgacggcggttgctccgggggcgcctatgacatcataatatgtgatgagtgccactcaactgactcgaccaccatcttgggcatcggcacagtcctggaccaagcggagacggctggagcgcggcttgtcgtgctcgccaccgctacgcctccagggtcagtcaccgtgccacaccccaatatcgaggaggtagccctgtccaacactggagagatccccttctatggcaaagccatccccatcgaggctatcaaggggggaaggcatctcatcttctgccattcaaaaaagaagtgtgacgagctcgccgcaaagctgtcatccctcggaatcaacgccgtggcgtactaccgaggtcttgatgtgtccgtcataccgaccagcggaaacgttgttgtcgtggcgacagacgctcttatgacgggctacaccggcgactttgactcagtgatcgactgtaacacatgtgtcactcagacagtcgatttcagtctggatcccaccttcaccatcgagacgacgaccgtcccccaagacgcagtgtcacgcacgcagcgacggggtaggactggcaggggtaggagaggcatctacaggtttgtgactccaggagagcggccctcgggcatgttcgattcctcggtcctgtgtgagtgttatgacgcgggctgcgcttggtatgagctcacgcccgctgagacctcggttaggttgcgggcttacctaaatacaccagggttgcccgtctgccaggaccatctggagttctgggagagcgtcttcacaggcctcacccatatagatgcccacttcttgtcccagactaaacaggcaggagataacttcccctacctggtagcataccaagccacagtgtgcgccagggcrcaggctccacctccatcgtgggaccaaatgtggaagtgtctcatacggctaaagcctacgttgcacgggccaacgcccctgctgtataggctaggagccgtccaaaatgaggtcaccctcacacaccctgtaaccaaatacatcatggcatgcatgtcggctgacctggaggtcgtcactagtacctgggtgctagtaggcggggtccttgcagctctggccgcgtattgcctgacaacaggcagcgtggtcatagtgggtaggatcatcttgtccgggaggccggctgtcattcccgatagggaagtcctctaccgagagttcgatgaaatggaagagtgcgcctcacacctcccttacatcgaacagggaatgcagctcgccgagcaattcaagcagaaggcgctcgggttgttgcaaacagctaccaagcaagcggaggctgctgctcccgtggtggagtccaaatggcgagccctcgaggccttctgggcgaagcacatgtggaacttcatcagcgggatacagtacttagcaggcttgtccactctgcctgggaaccccgcgatagcatcactgatggcattcacagcctctgtcaccagcccgctcaccacccaaagtaccctcctgtttaacatcttggggggatgggtggctgcccagctcgctcctcccagcgctgcttcagctttcgtgggcgccggcattgccggcgcggccgttggcagcataggccttgggaaggtgcttgtggacatcttggcgggttatggggcaggggtggccggcgcactcgtggcctttaaggtcatgagcggcgagatgccttccactgaggacctggtcaatctgctccctgccatcctctctcctggcgccctggtcgtcggggtcgtgtgcgcagcaatactgcggcggcacgtgggcccaggagagggggctgtgcagtggatgaaccggctgatagcgttcgcctcgcggggtaaccacgtctcccccacgcactatgtgcctgagagcgacgccgcagcgcgtgtcacccagatcctctccagccttaccatcactcagctgctgaagaggctccaccagtggattaatgaggactgctccacaccctgctccggctcgtggctaagggatgtttgggactggatatgcacggtgttgattgacttcaagacctggctccagtccaagctcctgccgcggctaccgggagtccccttcttctcatgccaacgtgggtacaagggagtctggcggggggacggcatcatgcataccacctgcccatgtggagcgcagattgccggacatgtcaaaaacggttccatgaggatcgttgggcctaagacctgcagcaacacgtggcatggaacattccccatcaacgcatacaccacgggcccctgcacaccctccccggcgccaaactattctagggcgctatggcgagtggctgctgaggagtacgtggaggtcacgcgggtgggggattaccattacatcacgggcatgaccactgacaacataaagtgcccatgccaggttccggcccctgaattcttcacggaggtggatggagtgcggctgcacaggtacgctccggcgtgcaaacccctcctacgggaggaggccgtattccaggtcgggctcaaccaatacctggttggatcacagctcccatgtgagcccgaaccagatgtagcagtgctcacttccatgctaaccgacccctcccacattacagcagaaacggccaagcgtaggctggccagggggtctcccccctccatggccagctcttcagctagccagttgtctgcgccttccttgaaggcggcatgcactacccatcatcactccccggaccttgacctcatcgaggccaacctcctgtggcggcaggagatgggcgggaacatcacccgtgtggagtcagaaaataaggtagtaattctggactctttcgatccgctccgggcggaggaggatgagagggaagtgtccgttccggcggagatcctgcgaaaatccaggaattttcccccagcgatgcccatatgggcacgcccggattacaaccctccactgctagagtcctggaaagacccggactacgtccctccagtggtacacgggtgcccattaccacctaccaaggcccccccaataccacctccacggagaaagaggacggttgtcctgacagagtccactgtgtcttctgccttggcggagcttgctactaagacctttggcagctccgaatcgtcagccgccgacagcggcacggcgaccgcccctcctgaccaggcctctgacgacggcgacaaagaatccgacgttgagtcgtactcctccatgcccccccttgagggagagccgggggaccccgatctcagcgacgggtcttggtctaccgtgagtgaggaggccactgaggacgtcgtctgctgctcaatgtcctacacatggacaggcgccctgatcacgccatgcgctgcggaggaaagcaagctgcccatcaacgcgctgagcaactctctgctgcgtcaccacaacatggtgtatgccacaacatcccgcagcgcaagcctgcggcagaagaaagtcacctttgacagactgcaagtcctggacgatcactaccgggacgtgctcaaggagatgaaggcgaaggcgtccacagttaaggctaaacttctatctgtagaagaagcctgcaagctgacgcccccacattcggccaaatccaaatttggctatggggcaaaggacgtccggaacctatccagcaaggccattaaccacatccgctccgtgtggaaggacttgctggaagacactgaaacaccaattgacaccaccatcatggcaaaaaatgaggttttctgcgtccagccagaaaaaggaggccgcaaaccagctcgccttatcgtattcccagacctgggagttcgtgtatgcgagaagatggccctttatgacgtagtttccactcttcctcaggccgtgatgggctcctcatacggattccagtactctcctggacagcgggtcgagttcctggtgaagacctggaaatcaaagaagtgccctatgggcttctcatatgacacccgttgttttgactcaacggtcactgagaatgacatccgtgttgaggagtcaatttaccaatgttgtgacttggcccccgaagccagacaggccataaggtcgctcacagagcggctttatatcgggggccccatgaccaattccaaagggcagaactgcggttatcgccggtgccgcgcgagcggcgtgctgacgactagctgcggtaataccctcacatgttacttgaaggccactgcagcctgtcgagctgcgaagctccaggactgcacgatgctcgtgaacggagacgaccttgtcgttatctgtgagagcgcggggacccaagaggatgcggcgaacctacgagtcttcacggaggctatgactaggtactctgccccccccggggacccgccccaaccagaatacgacttggagctgataacatcatgttcctccaatgtgtcggtcgcgcacgatgcatctggcaaaagggtgtactacctcacccgcgaccccaccacccccctttcgcgggctgcgtgggagacagctagacacactccagtcaactcctggctaggcaacatcatcatgtatgcgcccaccttatgggcaaggatgattctgatgacccacttcttctccatccttctagcccaggagcaacttgaaaaagccctggattgtcaaatctacggggcctgttactccattgagccacttgacctacctcagatcattgaacgactccatggtcttagcgcattttcactccacagttactctccaggtgaaatcaatagggtggcttcatgcctcaggaagcttggggtaccacccttgcgagtctggagacatcgggccagaagtgtccgcgctaagctactgtcccagggggggagggctgccacttgtggtaagtacctcttcaactgggcggtaaggaccaagctcaaactcactccaatcccggccgcgtcccagctggacttgtccggctggttcgttgctggttacagcgggggagacatatatcacagcctgtctcgtgcccgaccccgctggttcatgttgtgcctactcctactttccgtaggggtaggcatctacctgctccccaaccgatgaacggggagctaaacactccaggccaataggccatcccccttttttttttttttttttttttttttttttttttttttttttttttttttttttttttttttttttttttttttttttttttttttttttttttcctctttttttccttttcttctttggtggctccatcttagccctagtcacggctagctgtgaaaggtccgtgagccgcatgactgcagagagtgctgatactggcctctctgcaggtcatgt

SEQ ID NO: 587 - DNA, 9344 bp, Hepatitis C Virus
atagatcactcccctgtgaggaactactgtcttcacgcagaaagcgtctagccatggcgttagtatgagtgtcgtgcagcctccaggtccccccctcccgggagagccatagtggtctgcggaaccggtgagtacaccggaattgccaggacgaccgggtcctttcttggattaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacaaatcctaaacctcaaagaaaaaccaaacgtaacaccaaccgccgcccacaggacgtcaagttcccgggcggtggccagatcgttggtggagtttacctgttgccgcgcaggggccccaggttgggtgtgcgcgcgactaggaagacttccgagcggtcacaacctcgtggcaggcgacaacctatccccaaggctcgccagcccgagggcagggcctgggctcagcccgggtacccttggcccctctatggcaacgagggcctggggtgggcaggatggctcctgtcaccccgtggctctcggcctagttggggccccacagacccccggcgtaggtcgcgtaatttgggtaaggtcatcgatacccttacatgcggcttcgccgacctcatggggtacatcccgctcgtcggcgcccctctaggaggcgctgccagggccctggcgcatggcgtacgggttctggaggacggcgtgaactatgcaacagggaatctgcccggttgctctttctctatcttccttttggctttgttgtcttgtttgaccatcccagtttccgcttatgaagtgcgcaacgtgtccgacgtgtaccatgtcacgaacgactgctccaactcaagcattgtgtatgaggcagctgacgtgattatgcacacccccgggtgcgtgccctgcgtccgggagaacaattcctcccgctgctgggtagcgctcactcccacgctcgcggccaggaacagcagcatccccactacgacaatacgacgtcatgtcgatttgctcgttggggcagctgctttctgttccgccatgtacgtgggggatctctgcggatctgttttcctcgtctcccagctgttcaccttctcgcctcgccggtatgagacggtacaagactgcaattgctcaatctatcccggccacgtatcaggtcaccgcatggcttgggatatgatgatgaactggtcacctacaacagccctagtagtatcgcagctgctccggatcccacaagccgtcatggatatggtgacgggggcccactggggagtcctagcgggccttgcctactattccatggtggggaactgggctaaggttttgattgtgatgctactgtttgccggcgttgacggggaaacttatgcgtcgggggcggcgtcaggccgcagcaccatgagctttgcgtccctcttctcgtctgggtcatctcagaacatccaacttataaataccaacggcagctggcacatcaacaggactgccctgaactgcaatgaatccctcaacaccgggttccttgccgcgctgttctacacacacaagttcaacgcgtccggatgcccagagcgtatggccagctgtcgccccatcgacgagttcgctcaggggtggggccccatcactcatgccacgccccgcgtctcggaccagaggccctattgctggcactacgcacctcaaccgtgtggtatcgtacccgcgttgcaggtgtgtggtccagtgtattgcttcaccccaagccccgtcgtggtggggacgaccgatcgttctggcgcccccacgtataactggggggagaacgagacggacgtgctaatcctcaacaacactcggcctccgcaaggcaactggttcggctgtacatggatgaacagcactgggttcaccaagacgtgcgggggtcccccgtgtaacatcgggggggtcggcaacaacaccctgacctgccccacggattgtttccggaagcaccccgaggctacttatgccaaatgcggctcggggccttggttgacacccagatgcatggttgactacccatacaggctttggcactacccctgcactgtcaactttaccatcttcaaggtgaggatgtacgtggggggtgtggagcacaggctcaacgccgcgtgcaattggactcgaggagatcgttgtaacctggaagacagggacagatcagagctcagcccgctgctattgtccacaacagaatggcaggtactgccctgtaccttcaccaccctaccggctctgtccactggtttgattcacctccaccagaacatcgtggacgtgcaatacctgtacggtgtagggtcagcggttgtctccgttgtcatcagatgggagtatgtcctgctgcttttcctcctcctggcagacgcacgcgtctgcgcctgcttatggatgatgctgctgatagcccaggctgagcccgccttagagaacctggtggtcctcaatgcagcgtccctggccggagcgcatggcattctctccttccttgtgttcttctgtgctgcctggtacatcaagggcaagctggcccccggggcggcgtacgccttctatagcgtatggccgctgctcttgctcctgctggcgttaccaccacgggcatacgccatggaccgagagatggctgcatcatgcgggggcgcggttttcgtaggcctggcactcttgaccttgtcaccccactacaaagtgttcctcgccaagctcatatggtggttacaataccttatcaccagggccgaggcgcacttgcaagtgtggatcccccctctcaacgttcgggggggccgcgatgccatcatcctcctcacgtgtgcagtccacccagagctaatttttgagatcaccaaaatcttgctcgccatatttggtccgctcatggtgctccaagccggcctaatcagagtgccgtacttcgtgcgcgcgcaagggctcgtgcgtgcatgcatgttggtgcggaaagtttctgggggccaatatgtccaaatggtcctcatgaagctggccgcattaacgggcacatatgtttataaccatcttactccgctgcgggactgggcccatgcgggcctgcgagaccttgcggtggcagttgagcccgtcctcttctctgacatggaaaccaaaatcatcacctggggggcagacaccgcggcgtgtggggacatcctcgcgggattgcccgtctccgctcgaagggggagggaaatactcctaggaccggccgacgggtttgaagggcaaggatggcgactcctcgcgcctatcacggcctactcccaacagacgcggggcctacttggctgtatcatcactagccttacaggccgggacaagaaccaggtcgagggggaagttcaggtggtttccaccgcgacgcagtctttcctggcgacctgcgtcaacggtgtgtgttggactgtctatcacggtgccggcacgaagactctagctggcccaaaaggtccaatcacccagatgtacaccaatgtagaccaagacctcgtcggctggcaggcgccccccggggcgcgttccatgacaccatgcacctgcggcagctcggacctttatttggttacgaggcacgctgacgttattccggtgcgccggcggggcgacagcagagggagcctactctcccccaggcctatctcctacctgaagggctcctcgggtggtccactgctctgccccttggggcacgtcgtgggcatcttccgagccgctgtgtgcacccggggggttgcgaaggcggtggactttgtacccgttgagtctatggagaccactatgcggtctccggtcttcacggacaactcatctcccccggctgtaccgcagacattccaggtggcccacctacacgctcccaccggcagcggcaagagcaccaaagtaccggctgcatacgcagcccaagggtacaaggtacttgtcctgaacccatccgttgctgccaccttaggttttggggcgtatatgtccaaggcacatggtgttgaccctaacatcagaactggggtaaggaccatcaccacgggcgctcccatcacgtactccacctatggcaagttccttgccgacggtggttgctccgggggcgcctacgacatcataatgtgtgatgagtgccactcaactgactcaacctccatcttgggcattggcacagtcctggaccaagcggagacggctggagcgcggctcgtcgtgctcgccaccgctacgcctccgggatcggtcaccgtgccacatcccaacatcgaggaggtggccttgtccaacactggagagatccccttttatggtaaagccatccccattgaggtcatcaagggggggaggcatctcattttctgccattccaagaagaaatgtgacgagctcgccacaaaactgtcggccctcggaattaatgctgtagcgtactaccggggccttgatgtgtccgtcatcccgacaagcggaaacgtcgttgtcgtggcaacagacgctctaatgacgggctacactggtgactttgactcagtgatcgactgcaacacatgtgtcacccagacagtcgacttcagcttggaccccactttcaccattgagacgacgaccatgccgcaagacgcggtgtcgcgctcgcagcggcgaggcaggactggtaggggcagaacgggcatatacagatttgtgactccaggagagcggccctcgggcatgttcgattcttcggtcctgtgtgagtgctatgacgcgggctgtgcttggtatgagctcacgcccgccgagacctcggtcaggttacgggcttacctaaatacaccagggttgcccgtctgccaggatcacctggagttctgggagagcgtcttcacgggcctcacccacatagatgctcatttcctgtcccagactaaacaggcaggggagaacctcccctacctggtagcataccaggccacagtttgcgccagggcccaagccccccctccatcgtgggatcaaatgtggaagtgtctcgtacggctaaagcctacgctgcaggggccaacgcccctgttgtacaggctgggagccgtccaaaacgaggtcaccctcacacaccccataaccaaatacatcatgacatgcatggcggctgacctagaggtcgtcacgagcacctgggtgctagtgggcggggttcttgcagctctggccgcgtactgcctgacaacgggcagcgtggtcattgtgggcaggatcgtcctgtccgggaggccagctgtagttcccgacagggaggttctctaccaggagttcgatgaaatggaagagtgcgcatcacacctcccttacatcgagcagggaatgcagctcgccgagcaatttaagcagaaggcactcgggttgctgcaaacagccaccaagcaagcggaggctgctgctcccgtagtggagtccaaatggcgcgcccttgaaggcttctgggcgaagcacatgtggaacttcattagcgggatacagtacttagcaggcttgtccactctgcctgggaaccccgcgatagcatcactgatggcatttacggcctctatcaccagcccgctcaccacccaaaataccctcatgtttaacatcttggggggatgggtggccgcccaactcgccccccccagcgctgcctcagccttcgtgggcgccggcattgccggcgcggctgttggcagcataggccttgggaaggtgcttgtagacatcctggcgggctatggagcaggggtggcaggcgcactcgtggccttcaaggtcatgagcggcgagatgccctccactgaggacatggtcaacttgctccctgccatcctctctcctggtgccctggtcgtcggagtcgtgtgcgcagcaatactgcgtcggcacgtgggcccaggggagggagctgtgcagtggatgaaccggctgatagcgttcgcctcgcggggtaaccacgtctcccccacgcactatgtgccagagagcgacgccgcagcacgtgtcacccagatcctctccagccttaccatcacccagctgttgaagaggctccatcagtggattaatgaggactgctccacgccatgctccggctcgtggctcagggatgtttgggactggatatgtgcggtgctgaccgatttcaagacctggctccagtccaagctcctgccgcggttgccgggagttcctttcttctcatgccaacgtgggtacaagggagtctggcgaggagatggtgtcatgcataccacctgcccctgtggcgcacaaatctccggacatgtcaaaaacggttccatgaggatcgttggacctaaaacctgcagtaacacgtggtgtggaacatttcccatcaacgcgtataccacaggcccctgcacaccctccccggcgccaaactattccaaggcgttgtggcgggtagctgctgaggagtacgtggaggtcacgcgggtgggggatttccactacgtgacgggcttgaccactgacaacgtaagatgcccatgccaggttccggctcccgaattcttcacggaattggacggggtgcggttgcacaggtacgctccggcgtgtaaacctctcctacgggatgaggtcacattccaggtcgggctcaaccaatacccggttgggtcacagctcccatgtgagcccgagccggatgtgacagtgctcacttccatgcttaccgaccccccccacattacagcggaagcggctaggcgcaggctggccagggggtctcccccctccttggccagctcttcggctactcagctgtccgcgccttccctgaaagcaacatgcaccacctgccataacgccccagacgccgacctcatcgaggccaacctcctgtggcggcaggagatgggcgggaacatcacccgcgtagagtcagagaataaggtggtgatcctggactcttttgaaccgctacgagcggaggaggatgggagggaagtatccgttccggcggagatcctgcggagaaccaggaaattccccctagcgctgcccatatgggcgcgcccggactacaacccaccactgctagagtcttggaaggacccagactacgtccctccggtggtacacgggtgtccactgccacctaccaaggcccctccaataccacccccacggagaaagaggacggttgtcctgacagaatccaccgtgtcttctgccttggcggagcttgctacgaaagccttcggcagctccggatcatcggccgtcgacagcggcacagcgaccgcccctcctgaccagcccctcgacgacggtggtacagggtccgacgttgagtcgtactcctccatgcccccccttgagggggagccgggggatcccgatctcagtgacgggtcttggtccactgtgagcgaggagggtggtgaggacgtcgtctgctgctcgatgtcctacacatggacaggcgctttaatcacgccatgcgccgcggaggagagcaagctgcccatcaatgcgttgagcaactctttgctgcgtcatcacaacctggtctatgccacaacatcccgcagcgcaagccagcggcagaagaaagtcacctttgacagactgcaggtcctggacgatcactaccgggacgtgctcaaggagatgaaggcgaaggcgtccacagttaaggctagacttctatccgtagaggaagcctgcaagctgacgcccccacactcagccagatccaagtttggctatggggcaaaggacgtccggagcctatccagcaaggccgtcaaccacatccactccgtgtggaaggacttgttggaagacactgaaacaccaattcaaaccaccatcatggcaaaaaatgaggtcttttgtgtccaaccagagaagggaggccgcaagccggctcgccttatcgtattcccagatttgggggtccgtgtgtgcgagaaaatggccctttacgacgtggtctccactcttccccaggccgtgatgggctcctcatacggatttcagtactcccctgggcagcgggtcgagttcctggtgaatgcttggaaatcaaagaagaaccctatgggcttcgcatatgacacccgctgttttgaatcaacggtcactgagaatgacatccgtgttgaggagtcaatttaccaatgttgtgacttggcccccgaggccagactagccataaggtcgctcacagagcgactttatgtcgggggccccatgaccaattcaaaagggcagaactgcggctatcgccggtgccgcgccagcggcgtgctgacgaccagctgcggcaataccctcacatgttatttaaaggcctctgcagcctgtcgagctgcgaagctccgggactgcaccatgctcgtgtgcggagacgaccttgtcgttatctgtgagagcgcaggaacccaggaggatgcggcgagcctacgagtcttcacggaggctatgactaggtactctgccccccccggcgacccgccccaaccagaatacgacctggagctgataacatcatgctcctccaacgtgtcggtcgcgcacgatgcaaacaacaaacgggtgtactacctcactcgggatcccaccatccccctttcgcgggccgcgtgggaaacggctagacacactccagtcaactcctggctaggcaacatcatcatgtatgcgcccaccttgtgggcaaggatgattctgatgactcacttcttctccatccttctagcccaggagcaacttgaaaaagccctagattgtcagatctatggggccatttactccattgaaccacttgacctacctcagatcattcagcgactccatggtcttagcgcattttcactccatacttactctccaggtgaaatcaatcgggtggcttcatgcctcaggaaacttggggtaccacccttgcgagtctggagacatcgggccagaagtgtccgcgctaagctactgtcccagggggggagggccgctatttgcggaaaatacctcttcaactgggcagtaaggaccaagctcaaactcactccaatcccggctgcgtcccggttggacttgtccagctggttcgttgctggttacagcgggggagacatatatcacagcgtgtctcgcgcccgaccccgctggttcttgtggtgcctactcctactttctgtaggggtaggcatctatctgctccccaaccgttaaa

SEQ ID NO: 588 - DNA, 9435 bp, Hepatitis C Virus
atagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccattccgagggtaggacctgggctcagcccgggtacccttggcccctctacggcaatgagggcttggggtgggcaggatggctcctgtcaccccgtggctcccggcctagttggggccccacagacccccggcgtaggtcgcgtaatttgggtaaggtcatcgataccctcacatgcggcttcgccgacctcatggggtacatcccgctcgtcggcgcccccctagggggcgcagccagggccctggcacatggtgtccgggttctggaggacggcgtgaactatgcaacagggaacttgcccggttgccctttctctatcttcctcttggctctgctgtcctgtttgaccatcccagcttccgcttatgaagtgcgcaacgtgtccggaatgtaccatgtcacgaacgactgctccaactcaagcattgtgtatgaggcagcggacatgatcatgcatacccccgggtgcgtgccctgcgtacgggaggacaactcctcccgttgctgggtagcgctcactcccacgctcgcggccaggaacaccagcgtccccactacgacaatacgacgccatgtcgacttgctcgttggggcggctgttttctgctccgctatgtacgtgggggatctctgcggatctgtcttccttgtctcccagctgttcaccttctcgcctcgccggtatgagacagtacaggactgcaattgctcactctatcccggccacctaacaggtcaccgcatggcttgggatatgatgatgaactggtcgcccacgacagctctagtggtgtcacagttcctccggatccctcaagccgtcatggatatggtggtaggggcccattggggagtcctggcgggccttgcctactattccatggtggggaactgggctaaggttttgattgtgatgctactctttgccggcgttgacggggaaacccacgtgacaggggcgacgcagggccacaccctcagcaagttcacgtccttcttcacccctggggcgcaacagaaaatccagcttgtgaacactaacggcagctggcacatcaacaggactgccctgaactgcaatgactccctcaacactgggtttcttgccgcgctgttctacacacacaggttcaattcgtccgggtgcccacaacgcatggccagctgccgttccattgacaagttcgctcaggggtggggtcccatcacttatgctgaggttgacagcccggaccagaggctttattgctggcattacgcacctcgaccgtgtggtatcgtacccgcgtcgcaggtgtgcggtccagtgtattgcttcaccccaagccctgttgtggtggggacgaccgatcgtttcggtgttcctacgtatacctggggggagaatgagacagacgtgctgcttctcaacaacacgcggccgccacaaggcaactggtttggctgtacatggatgaatggcactgggttcaccaagacgtgcggggtccccccgtgtaacatcgggggggtcggcaacaacaccttgacttgccccacggactgcttccggaagcaccccgaggccacttatacaaaatgtggttcggggccttggttgacacctaggtgcatagttgactacccatacaggctctggcactacccctgcactgtcaacttttccatcttcaaggttaggatgtatgtggggggcgtggagcacaggctcaatgccgcatgcaattggactcgaagagagcgttgtgacttggaggacagggatagatcagagctcagcccgctgctgctgtccacaacagagtggcagatactaccctgctccttcaccaccctaccggctttgtccactggtttgatccatctccatcagaacattgtggatatacaatacctgtacggtatagggtcagcggctgtctccttcgcaatcaagtgggagtatgtcctgctgtttttccttcttctggcggacgcacgcgtctgtgcctgcttgtggatgatgctgctgatagcccaggctgaggccgccctagagaacctggtggtcctcaacgcggcgtccgtggccggagcgcatggcattctccccttccttgtgttcttctgcgccgcctggtacatcaaaggcaggctggtccctgcggcggcgtatgccttctacggcgtatggccgctgctcctgctcctgctggcgttaccaccacgagcttacgccttggaccgggagatggctgcatcgtgtggaggcgcggtttttgtaggactggcactcttgaccttgtcaccatactataaagtgttcctcgctaggctcatatggtggttacaatatcttctcaccagagccgaagcgcacttgcaagtgtgggtcccccctctcaacgtccggggaggccgcgatgccatcatcctcctcatgtgcgcggtgcacccagagctaatctttgacatcaccaaacttctgcttgccacactcggtccgctcatggtgctccgggcgggcataacaaaagtgccgtactttgtacgtgctcaagggctcattcgtgcgtgcatgttagtgcggaaggtcgccgggggccattatgtccaaatggccttcatgaagctggctgcactgacaggtacgtacgtttatgaccatctcactcctctgcaggactgggcccacgcgagcctacgagaccttgcagtggcagtagagcccgttgtcttctctgacatggagaccaagatcatcacctggggggcagacaccgcagcgtgtggggacatcatcttgggcctacccgtctctgcccgaagagggaaggagatacttctgggaccggccgacagtcttgaagggcaggggtggcgactcctcgcgcccatcacggcctactcccaacagacgcggggcctacttggttgcatcatcactagcctcacaggccgggacaagaaccaggtcgagggggaggttcaagtggtttccaccgcaacacaatctttcttggcgacctgcatcaacggcgtgtgttggactgtctaccatggcgccggctcaaagaccctagccggcccaaaaggtccaatcacccaaatgtacaccaatgtggaccaggacctcgtcggctggcaggcgccccctggggcgcgttccttgacaccatgcacctgcggcagctcggacctttacttggtcacgagacatgctgatgttatcccggtgcgccggcggggcgatggtagggggagcctactctcccccaggcctgtctcctatctgaagggctcttcgggtggcccactgctctgcccttcggggcacgctgtgggcatcttccgggctgccgtgtgcacccggggggttgcgaaggcggtggacttcgttcccgttgagtctatggaaacaactatgcggtctccggtctttacagacaactcatcccccccggccgtaccgcagacctaccaagtggcccacctacatgctcccactggcagcggcaagagcactaaagtgccggctgcatatgcagcccaagggtacaaggtactagtcctgaacccgtccgttgccgccaccttgggttttggggcatatatgtccaaggcacatggtatcgaccccaacatcagaactggggtaaggaccatcaccacgggcggctccatcacgtactccacctatggcaagttccttgccgacggtggttgctctgggggcgcctatgacatcataatatgtgatgaatgccactcaactgactcgactaccatcttgggcatcggcacagtcctggaccaagcggagacggctggagcgcggctcgtcgtgctcgccaccgctacgcctccgggatcggtcaccgtgccacaccccaacatcgaggaggtggccctatccaatactggagagatccccttctatggtaaagccatccccctcgaggtcatcaaggggggaaggcatctcattttctgccattccaagaagaagtgtgacgagctcgccgcaaagctgtcaggcctcggactgaacgctgtagcgtattaccggggtcttgatgtgtccgtcataccggctagcggagacgtcgttgtcgtggcaacagacgctctaatgacgggcttcaccggcgactttgactcggtgatcgactgcaacacatgtgtcacccagacagtcgatttcagcttggatcccaccttcaccattgagacgacgaccgtgccccaagacgcggtgtcgcgctcgcagcggcgaggtaggactggcaggggtaggggaggcatctacaggtttgtgactccaggagaacggccctcgggcatgttcgattcttcggtcctgtgtgagtgctatgacgcgggctgtgcttggtacgagctcacgcccgctgagacctcggttaggttgcgggcttacctgaatacaccagggttgcccgtctgccaggaccacctggagttctgggagagcgtctttacaggcctcacccacatagatgcccacttcttgtcccagactaaacaggcaggagacaacttcccctacctggtagcataccaagctacggtgtgcgccagggctcaagctttacctccatcgtgggatcaaatgtggaagtgtctcatacggctraagcctacgctgcacgggccaacacccctgctgtataggctaggagccgtccaaaatgaggtcaccctcacacaccccgtaaccaaatacatcatggcatgtatgtcggctgacctggaggttgtcactagcacctgggtgctagtaggcggagtcctcgcggctctggccgcatattgcctgacaacaggcagtgtggtcatcgtgggcaggatcatcttgtccgggaagccggctgtcattcccgacagggaagtcctctaccaggagttcgatgaaatggaggagtgcgcatcacacctcccttacatcgaacagggaatgcagctcgccgagcaattcaagcagaaggcgctcgggttgctrcaaacagccaccaagcaagcggaggctgctgctcccgtggtggagtccaagtggcgagccctagagactttctgggcgaagcacatgtggaatttcatcagcgggatacagtacttagcaggcttatccaccctgcctgggaaccccgcgatagcatcactgatggcatttacagcctctatcaccagcccgctcaccacccaaagtaccctcctgtttaacatcttgggggggtgggtggctgcccaactcgctccccccagcgctgcttcggctttcgtaggcgccggcatcgccggcgcggctgttggcagcataggccttgggaaggtgctcgtggacatcctggcgggctatggggcgggggtggctggcgcactcgtggcctttaaggtcatgagtggcgaggcgccctccgccgaggacctggtcaatttactccctgccatcctctctcctggcgccctggtcgtcggggtcgtgtgcgcagcagtactgcgtcgacacgtgggcccgggagagggggctgtgcagtggatgaaccggctgatagcgttcgcttcgcgaggcaaccacgtctcccccacgcactatgtgcctgagagcgacgccgcagcgcgtgtcacccagatcctctccagccttaccatcactcagctgctgaagaggctccaccaatggattaatgaggactgctccacgccatgctccggctcgtggctaagggatgtttgggactggatatgcacggtgttgtctgacttcaagacctggctccagtccaagctcctgccrcggttaccgggagtccccttcttctcatgccaacgtgggtacaagggagtctggcggggggacggcatcatgcacaccacctgcccatgtggagcacagatcaccggacatgtcaaaaacggttccatgaggatcgttgggcctaaaacctgcagcaacacgtggcatggaacattccccatcaacgcatacaccacgggctcctgcacaccttccccggcgccaaactattccaaggcgctgtggcgggtggctgctgaggagtacgtggaggtcacgcgggtgggggatttccactacgtgacgggcatgaccactgacaacgtaaagtgcccatgccaggttccggcccccgaattcttcacggaagtggatggagtgcggttgcacaggtacgctccagcatgcaaacctctcctacgggaggaagtcacattccaggtcgggctcaaccaatacttggttgggtcacaacttccatgcgagcccgaaccggatgtagcagtgctcacttccatgcttaccgacccctcccacattacagcagagacggctaagcgtaggttggccagggggtctcccccctccttggccagctcctcggctagccagttgtctgcgccttccttgaaggcgacatgcactacccatcacgactccccggacgctgacctcattgaggccaacctcctgtggcggcaggagatgggcgggaacatcacccgcgtggagtcagagaataaggtggtgattttggactccttcgacccgcttcgagcggaggaggatgagagggaagtatccgttccggcggagatcctgcgtagatccaggaagttccccccggcgatgcccatatgggcacgcccggattacaatcctccactgctggagtcctggaaggacccggactacgtccctccggtggtacatgggtgcccattgccacctaccaaagcccctccagtgccacctccacggaggaagaggacggttgtcttgacggagtccactgtgtcttctgccttggcggagctcgctaccaagaccttcggcagctccggatcgtcggccgccgacagcggcacagcgacagcccctcctgaccaggccttcgacgacggcgacaaagaatccgacgttgagtcgtactcctccatgcccccccttgagggggagccgggggaccccgatctcagcgacgggtcttggtctaccgtgagcgaggaggctagtgaggacgtcgtctgctgctcaatgtcctacacatggacaggcgccctgatcacgccatgcgctgcggaggaaaacaagttgcccatcaacgcgttgagcaactctttgctgcgccaccataatatggtgtatgccacaacatcccgcagcgcaagcttgcggcagaagaaggtcacctttgacagactgcaagtcctggacgaccattaccgggacgtgctcaaggagatgaaggcgaaggcgtccacagttaaggctaaacttctatccgtagaagargcctgcaagctgacgcccccacattcggccaaatccaagtttggctatggggcaaaggacgtccggaacctatccagcaaggccgttaaccacatccgctccgtgtggaaggacttgctggaagacactgacacaccaattgacaccaccatcatggcaaaaaatgaggttttctgcgtccaaccagagaagggaggccgcaagccagctcgccttatcgtgttcccagacctgggagttcgtgtatgcgagaaaatggctctctacgacgtggtctccacccttcctcaggccgtgatgggctcctcatacggattccagtactctcccaaacagcgggtcgagttcctggtgaatacctggaaatcaaagaaaagccctatgggtttctcatatgacacccgctgctttgactcaacggtcactgagagtgatatccgtactgaggagtcaatctaccaatgttgtgacttggcccccgaggccagacaggccataaggtcgctcacagagcggctctacatcgggggtcccctgactaattcaaaggggcagaactgcggctatcgccggtgccgcgcgagcggcgtgctgacgaccagctgcggtaataccctcacatgttacttgaaggcctctgcagcctgtcgagctgcgaagctccaggactgcacgatgctcgtgaacggagacgaccttgtcgttatctgtgaaagcgcgggagcccaagaggatgcggcgagcctacgagtcttcacggaggctatgactaggtactctgcccctcccggggacctgccccaaccagaatacgacttggagctgataacatcatgttcctccaatgtgtcggttgcgcacgatgcatctaataagagggtgtactacctcacccgtgaccccaccaccccccttgcacgggctgcgtgggagacagctagacacactccagtcaactcctggctaggcaatatcatcatgtacgcgcccaccttatgggcaaggatgattctgatgactcatttcttctccatccttctagcccaggagcaacttgaaaaggccctggactgtcagatctacggggcttgttactccattgaaccacttgatctacctcagatcatcgaacgactccacggtcttagcgcgttttcactccacagttactctccaggtgagatcaatagggtggcttcatgcctcaggaaacttggggtaccacccttgcgagtctggagacatcgggccagaagtgtccgcgctaagctactgtcccaaggggggagggccgccacttgtggcaagtacctcttcaactgggcagtaaagaccaagctcaaactcactccaattccggctgcgtcccagttggacttgtccggctggttcgttgctggttacagcgggggagacatatatcacagcctgtctcgtgcccgaccccgctggttcatgttgtgcctactcctactttctgtaggggtaggcatctacctgctccccaatcgatgaacggggagctaaacactccaggccaataggccatcccctttttttttttttttttttttttttttttttttttttttttttttttttttttt

SEQ ID NO: 589 - DNA, 9480 bp, Hepatitis C Virus
tgccagcccccgattgggggcgacactccaccatagatcactcccctgtgaggaactactgtcttcacgcagaaagcgtctagccatggcgttagtatgagtgtcgtgcagcctccaggtccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcatcatgagcacaaatcctaaacctcaaagaaaaaccaaacgtaacaccaaccgccgcccacaggacgttaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggcaggacctgggctcagcccgggtacccttggcccctctatggcaacgagggtctggggtgggcaggatggctcctgtcaccccgaggctcccggcctagttggggccccacggacccccggcgtaggtcgcgtaatctgggtaaggtcatcgataccctaacatgcggcttcgccgacctcatggggtacattccgctcgtcggcgctcccctagggggcgttgccagggccctggcgcatggcgtccgggttgtggaggacggcgtgaactacgcaacagggaatctacccggttgctccttttctatcttcctcttagctctgctatcttgtctgaccatcccagcttccgcttacgaagtgcgcaacgtgtccggggtgtaccatgtcacgaacgactgctccaactcaagtattgtgtatgaggcagcggacgtgattatgcacactcccgggtgcgtgccctgcgtctgggagggtaattcctcccgttgctgggtagcgctcactcccacgctcgcggccagaaacagcagcatccccaccacgacaatacgacgccacgtcgatttgctcgttggggcggctgctttctgctccgctatgtacgtgggggatctctgcgggtctgttttcctcgtctcccagctgttcactttctcaccgcgccggtatcagacggtacaagactgcaattgctcactctatcccggccacgtatcaggtcaccgcatggcttgggatatgatgatgaactggtcgcctacaacggccctagtggtatcgcagttactccggatcccacaagccgtcgtggacatggtggcgggggcccactggggagtcctagcgggccttgcctactattccatggtggggaactgggctaaggtcttgattgtgatgctgctctttgccggcgttgacgggagaggcacccacgtgtcaggggggcaggcaggatacaacgccaggggccttgtgtccctcttctcaccaggggcgtctcagaaaatccaactagtaaataccaacggcagctggcatatcaataggactgccttgaattgcaatgacaccctccagaccgggttccttgcctcgctgttctacgtacacaagtttaacgcgtctggatgtccagagcgcatggccagctgccgccccattgacaagttcgatcaggggtggggccccatcacccacgtcgagcctaacatctctgaccagaggccatattgctggcactacgcacctcgaccatgcggtatcgtacccgcgtcacaggtgtgtggcccagtgtattgcttcaccccaagccctgttgtggtggggacgactgatagttccggcgtccccacgtataactggggggaaaatgagacggacgtgctgctcctcaacaacacgcggccacctctcggcaactggttcggctgtacatggatgaacagcaccgggttcaccaagacgtgcgggggccccccgtgtaacatcgggggggttggcaacaacaccttgacctgccccacggattgcttccggaaacaccccgaagccacttacaccaaatgcggttcgggtccctggttgacacctaggtgtctagtcgactatccatacagactttggcactacccctgcactgtcaactttaccatctttaaggtcaggatgtacgtggggggcgtggagcacaggctcagcgccgcgtgcaattggactcggggggagcgctgtgacctggtggacagggatagggcagagctcagcccgctgctactgtctacaacagagtggcaggtactgccctgttccttcaccaccctacccgctctgtccactggtttgatccacctccaccagaacgtcgtagacgtgcaatacctgtacggtgtggggtcagcggttgtctccattgtggtcaaatgggagtacgttgtgctgctctttcttctcctggcagacgcgcgcgtttgcgcctgcttatggatgatgctgctggtagcccaggctgaggccgccttaaagaacttggtggtcctcaatgcagcgtccgtggccggaacgcatagcactctctcctttcttgtgttcttctgtgctgcctggtacatcaaaggcaagctggtccctggggcggcgtatgccttttatggcgtatggccgctgctcctgctcctgctggcgttaccaccacgagcgtacgccatggaccgggaaatggccgcgtcatgcggaggcggggttttcataggtctggcactcttgaccttgtcaccacactataaagtatttctcgccaggcttatatggtggttacaatatttcatcaccagggccgaagcgctcttgcaagtgtggatcccccccctcaacgttcgagggggccgcgacgccatcatcctcctcacgtgtgcggtccacccagagctaatctttgaaatcaccaaaatcttgctcgccatattcggaccgatcatggtgctccaggctggcctaattagagtgccgtactttgtgcgcgctcaggggctcatccgtgcatgcatgttggtgcggaaagccgccgggggtcattatgtccaaatggctctcatgaagctggccgcactgacgggcacgtacgtttatgaccaccttaccccactgcgggactgggcccacgcgggcctgcgagaccttgcagtggcagttgagcccgttgtcttctctaacatggagaccaaggtcatcacctggggggcagacaccgcggcgtgcggggacatcatctcgggtctacctgtctctgcccgaaggggaagggagatacttctaggaccggccgatagttttaaagagcaggggtggcggctccttgcgcctatcacggcctactcccagcagacgcgaggcctacttggctgcatcatcactagcctcacaggccgggacaagaaccaggtcgagggggaggtccaggtggtctccaccgcaacacaatcttttttggcgacctgcgtcaatggcgtgtgctggaccgtctatcacggcgccggctcgaaaaccctagccggcccgaagggtccagtcacccaaatgtacaccaatgtggaccaggacctcgtcggctggcaggcgccccccggggcgcgctccttaacaccatgcacctgcggtagctcggacctttacttggtcacgaggcacgctgatgtcattccggtgcgccggcggggcgacagcagggggagcctgctttctcccagacccgtctcctatttgaagggctcctcaggtggtccactgctctgccccttggggcacgctgtgggcatcttccgggctgctgtgtgcacccggggggtcgcaaaggcggtggacttcatacccgttgagtctatggaaactactatgcggtctccggtcttcacggataattcatctcccccggccgtaccgcagacattccaagtggcccacttacatgctcccactggcagcggcaagagcaccaaagtgccggctgcatacgcagcccaggggtataaggtgctcgtcctgaacccgtccgttgccgccaccttagggtttggagcgtacatgtctaaggcatatggtatcgaccctaacgttagaactggggtaaggaccatcaccacgggcgctcccattacgtactccacctatggcaagttccttgcggacggtggttgttctgggggcgcctatgacatcatcatatgcgatgagtgccactcaactgactcgacttctatcctgggcattggcacggtcctggatcaagcggagacggctggagcgcggcttgtcgtgctcgccaccgctacgcctccgggatcggtcactgtgccacaccccaatatcgaggaggtggccttgtccaacactggagagatccccttctatggcaaagccatccccctcgaggccatcaaggggggaaggcatctcattttctgtcactctaagaagaaatgtgacgagctcgccacaaagttgtcaggcctcggagtcaatgctgtagcgtactaccggggtcttgacgtgtccgtcataccaacaagtggagacgtcgttgttgtcgcaacagacgccctaatgacgggctataccggcgactttgactcagtaatcgactgtaatacatgtgtcacccagacagtcgatttcagtttggaccctaccttcaccattgagacgacaaccgtgccccaagacgcagtgtcgcgctcgcagcgccgaggcaggactggtaggggcaggggaggcatatacaggtttgtgactccaggggaacggccctcgggcatgttcgattcgtcggtcctgtgtgagtgctacgacgcgggctgtgcttggtatgagctcacgcccgccgaaacctcggtcaggttgcgggcttacctaaacacaccagggttgcctgtctgccaggatcatctggagttctgggagagcgtcttcacaggcctcacccacatagatgcccacttcttgtcccagactaaacaggcaggagataacttcccctacctggtagcataccaggccacagtgtgcgccagggcccaagctccacctccatcgtgggatcaaatgtggaagtgtctcatacggctaaagcctacgctgcacgggccaacacccctgttgtacaggctaggagccgtgcaaaacgagatcaccctcacacaccctataaccaaatttatcatggcatgcatgtcggctgacctagaggtcgtcaccagcacctgggtgctggtaggtggggtccttgcagctctggccgcttactgcctgacaacgggcagcgtggtcattgtgggcaggatcatcttgtcagggaggccggctatcattcccgatagggaagtcctctaccaagagttcgatgaaatggaggagtgtgcctcgcacctcccttacatcgaacagggaatgcagctcgccgagcaattcaagcagaaagcgctcgggttgctgcaaatagccaccaagcaagcggaggctgctgctcctgtggtggagtccaaatggcggaccctcgaggctttctgggcgaagcacatgtggaacttcatcagcgggatacagtacttagcaggcttgtccaccttgcctgggaaccccgcaatagcatcactgatggcatttacagcctctatcaccagcccgctcaccacccaacataccctcttgtttaatatcttgggaggatgggtggccgcccaactcgccccccccagcgctgcttctgctttcgtgggcgccggaattgctggcgcggccgttggcagcataggccttgggaaggtgcttgtggacatcctggcgggttatggagcgggggtggcgggcgctctcgtggcctttaaggtcatgagtggcgacatgccctccaccgaggatctggtcaatttactccctgccatcctctctcctggtgccctggtcgtcggggtcgtgtgcgcagcaatactgcgtcggcatgtggggccaggggagggggccgtgcagtggatgaaccggctgattgcgttcgcttcgcggggtaaccatgtctcccccacgcactacgtgcctgagagcgacgccgcagcgcgtgtcacccagatcctttccagccttaccatcactcagctgttgaagaggctccaccagtggatcaatgaggactgctccacgccatgctccggctcgtggcttagggacgtgtgggactggatatgcacggtgttgactgacttcaagacctggctccagtccaagctcctgccgcggttaccgggagtccctttcttctcatgccaacgtgggtacaggggagtctggcggggagatggcgtcatgcaaaccacctgcccatgtggagcacaaattgctggacatgtcaaaaacggttccatgaagatcgttgggcctaaaacctgtagcaacacgtggcacggaacattccccatcaacgcttacaccacaggcccctgcacaccctccccggcgccaaactattccagggcgttgtggcgggtggctgctgaggagtatgtggaggtcacacgggtgggggagttccactacgtgacgggcatgacgactgacaacgtgaaatgtccatgccaggttccggcccccgaattctttacggagctggacggggtgcggctgcacaggtacgctccggcatgtaaacctctcctgcgggatgaggtcacattccaggtcgggctcaaccaatacccggttgggtcacagctcccatgtgagcccgagccggacgtaacagtggtcacttccatgctcaccgacccctcccacattactgcagaaacggctaggcgtaaactggccagggggtctcccccttccttggccagctcttcggctagtcagttgtctgcgccttccttgaaggcgacatgcactacccatcatgactccccagacgctgacctcatcgaggccaacctcttgtggcggcaggagatgggcgggaacatcactcgcgtggagtcagagaacaaggtagtgatcctagactcttttgacccgcttcgagcggaggaggatgagagggaagtatccgttgcggcggagatcctgcggaaaaccaggaaatttcccccagcgatacccatatgggcacgcccggactacaacccaccactggtagagtcttggagggacccagactacgtccctccggtggtacacgggtgcccattgccacccgccaaggcccctccaataccacctccacggaaaaagaagacggttgtcctgtcagaatccaccgtatcttctgtcctggcggagcttgctacgaagaccttcagcagctccgtatcatcggccgtcgacagcggcacagcgaccgcccctcctgatcaggcctccgacaacggagatacaggatccgatgttgggtcgtactcctccatgcctccccttgagggagagccgggggaccccgacctcagcgacgggtcttggtctactgtgagtgaggaggctggtgaggacgtcgtctgctgctcgatgtcctatacgtggacaggcgccttgatcacgccatgcgccgcggaggagagcaagctgcccatcaatgcgttgagcaactctctgctgcgccaccataacatggtctatgtcacaacatcccgcagcgcaagccagcggcagagaaaggtcacctttgacagattgcaagtcctggacgaccactaccgggacgtactcaaggagatgaaggcgaaagcgtccacagttaaggctaaacttctatccgtagaagaagcctgcaagctgacgcccccacattcagccaaatcaaaatttggctatggggcgaaggacgtccggaacctatccagcagggccgttaaccacatccgctccgtgtggaaggacctgctggaagacactgagacaccaattgataccaccatcatggcaaagaacgaggtcttctgtgttcaaccggaaaaaggaggccgcaagccagctcgccttatcgtatacccagacttaggggttcgtgtgtgcgagaaaatggccctttacgatgtagtctccacccttcctcaggccgtgatgggctcctcatacggattccagtactctcccgggcagcgggtcgagttcctggtgaatgcctggaaatcaaagaaaacccctatgggcttcgcatatgacacccgctgctttgactcgacggtcactgagaatgacatccgtgttgaggagtcaatttaccaaagttgtgacttggtccccgaggccagacaggccataaagtcgctcacagagcggctctacattgggggccccctgactaattcaaaggggcagaactgcggttatcgccggtgccgcgccagcggtgtgctgacgactagctgcggtaatacccttacatgttacttgaaggcctctgcagcctgtcgagctgcaaagctccaggactgcacaatgcttgtgtgcggagacgaccttgtcgttatctgtgagagcgcgggaacccaggaggacgcagcgagcctacgagtcttcacggaggctatgactaggtactcagccccccccggggacccacctcgtccggaatacgacttggagttgataacatcatgctcctccaacgtgtcggtcgcgcacgatgcatctggcaaacgggtgtactatctcacccgtgatcccaccaccccccttgcgcgggctgcgtgggagacagctagacacactccagtcaactcctggctaggcaacatcatcatgtatgcgcccaccttatgggcaaggatgattctgatgactcacttcttctccatccttctagctcaggagcagcttgaaaaagccctagattgtcagatctacggggccatttactccattgagccacttgacctacctcagatcattcagcgactccatggtcttagcgcattttcactccatagttactctccaggtgagatcaatagggtggcttcatgcctcaggaaacttggggtaccacccttgcgggtctggagacatcgggccagaagtgtccgcgctaagctactgtcccggggggggagggccgccacttgtggcaaatacctcttcaactgggcagtaaagaccaagctcaaactcactccaattccggctgcgtcccagttggacttgtccggctggttcgttgccggttacggcgggggagacatatatcacagcctgtctcgtgcccgaccccgctggttcatgtggtgcctactcctgctttctgtaggggtaggcatctatttactccccaaccggtaaacggggagctaaacactccaggccaataggccgtctcttttttttttttttttttttttttttttttttttttttttttttttttttttttttttttttttt

SEQ ID NO: 590 - DNA, 9585 bp, Hepatitis C Virus
atagatcactcccctgtgaggaactactgtcttcacgcagaaagcgtctagccatggcgttagtatgagtgtcgtgcagcctccaggtccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcatcatgagcacaaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacagcctatccccaaggctcgccggcccgagggtagggcctgggctcagcccgggtacccttggcccctctatggcaatgagggtctggggtgggcaggatggctcctgtcaccccgtggctcccggcctagttggggccccaccgacccccggcgtaggtcgcgtaatttgggtaaggtcatcgataccctcacatgcggcttcgccgacctcatggggtacattccgctcgtcggcgcccccctaggaggcgccgccagggccctggcgcatggcgtccgggttctggaggacggcgtgaactatgcaacagggaatttgcccggttgctctttctctatcttcctcttagctttgctgtcctgtttgaccatcccagcttccgcccatgaagtgcgcaacgtgtccggggtgtaccatgtcacgaacgactgctccaacgcaagcattgtgtatgaggcagcggacatgatcatgcacacccccgggtgcgtgccctgcgtccgggagaacaattcctcccgctgctgggtagcgctcactcccacgctcgcggccaggaacagcagcatccccactgcgacaatacgacgtcacgtcgacttgctcgttggggcagctgctttctgttccgctatgtacgtgggggatctttgcggctctgttttcctcgtctcccagctgttcaccttttcacctcgccggtatgagacggtacaggactgcaattgctcaatctatcccggccacgtatcaggtcaccgcatggcttgggatatgatgatgaactggtcacctacaacagccctagtggtatcgcagttactccggatcccacaagccgtcgtggacatggtgacgggggcccactggggagtcctggcgggccttgcctactactccatggtggggaactgggctaaggtcttgattgtgatgctactctttgccggcgttgacgggcacacccacgtgacagggggggtgtcagctcgcaatactctgggccttacgaccctctttacatcagggcctgctcagaaaatccaacttgtaaataccaatggcagctggcacatcaacaggactgccctgaattgcaatgactccctcaacaccgggttccttgccgcgctgttttacacgcacaagttcaactcgtccggatgcccagagcgcatggccagctgtcgccccatcgacaagttcgcccaggggtggggtcccatcactcatggcgtgtcttccgtaccggaccagaggccttattgctggcactacgcacctgaaccgtgtggtattgtacccgcgtcgcaggtgtgcggtccagtgtattgcttcaccccgagccctgttgtggtggggacgaccgatcgttccggcgcccccacgtacacctggggggagaatgagacggacgtgctacttctcaacaacacgcggccgccgcaaggcaactggttcggctgcacatggatgaatagcaccgggttcaccaagacgtgcgggggccccccgtgcaacatcgggggggtcggcaacaacaccttgacctgccccacggactgcttccggaagcaccccgaggccacttatacaaaatgtggttcggggccttggttgacacctaggtgcatagttgactacccatacaggctctggcactacccctgcactgtcaacttttccatcttcaaggttaggatgtatgtggggggcgtggagcacaggctcaacgccgcatgcaattggactcgaggagagcgttgtgacttggaggacagggatagatcagagctcagcccgctgctgctgtccacaacagagtggcagatactaccctgctccttcaccaccctaccggctttgtccactggtttgatccatctccatcagaacattgtggatatacaatacctgtacggtatagggtcagcggctgtctcctttgcaatcaagtgggagtatgttctgctgtttttccttcttctggcggacgcacgcgtctgtgcctgcttgtggatgatgctgctgatagcccaggctgaggccgccctagagaacctagtggtcctcaacgcggcgtccgtggccggagcgcatggcattcttcccttccttgtgttcttctgcgccgcctggtacatcaaaggcaggctggtccctgcggcggcgtatgctttctacggcgtatggccgctgctcctgctcctgctggcgttaccaccacgagcatacgccatggaccgggagatggctgcatcgtgcggaggcgcggttttcataggtctgatactcttgaccttgtcaccacactataaagtgttcctcgctaggctcatatggtggttacaatattttatcaccagggccgaagcgcacttgcaagtgtggatccccccccttaacgttcgggggggccgcgatgccatcatccttctcacgtgtatggtccattcagagctaatttttgaaatcaccaaaatcttgctcgccatacttggtccgctcatggtgctccagactggcctaactagagtgccgtacttcgtgcgcgctcaagggctcatccgtgtgtgcatgttggtgcggaaagtcgctgggggccattatgttcaaatggctctcatgaagctggccgcattgacgggtacgtacgtttatgaccatctcaccccgctgcgggactgggcccacgcgggcttgcgcgacctcgcagtggcagttgagcctgtcattttctctgacatggagactaagatcatcacctggggggcagacaccgcagcgtgtggggacatcatcttgggtctacccgtctccgcccggagggggagggagatacttctgggaccggccgatagttttggagaacaggggtggcgactccttgcgcctatcacggcttactcccagcagacgcggggtcttcttggctgcatcatcactagcctcacaggtcgagacaagaaccaggtcgagggagaggttcaggtggtttccaccgcaacgcaatccttcctggcgacctgcgtcaacggcgtgtgttggaccgtctaccatggcgccggctcaaagaccttagccggcccgaagggtccaatcacccaaatgtacaccaatgtagaccaggacctcgtcggctggccggcgccctccggggcgcgttccctaacgccgtgcacctgcggcagctcggacctttacctggtcacgaggcatgctgatgtcattccggtgcgccggcggggcgacagcagggggagtctgctttctcctaggcccatctcctatttgaagggctcctcgggtggtccactgctttgcccctcggggcacgccgtgggcatcttccgggctgctgtgtgcacccggggggttgcaaaggcggtggactttatacctgttgagtccatggaaaccactatgcggtctccggtcttcacggacaattcatctcccccggccgtaccgcagacattccaagtggcccatctacacgcccccactggcagcggcaaaagcactaaggtgccggctgcatatgcagcccaagggtacaaggtactcgtcctaaacccatccgttgccgccaccctaggttttggggcgtacatgtctaaggcacatggtgttgaccctaacatcagaactggggtaaggaccatcaccacgggcgctcccatcacgtattccacctatggcaagttccttgccgacggtggttgctccgggggcgcctatgacatcataatatgtgatgagtgccactcaactgactctacttccatcttgggtattggcacagtcctggaccaagcggagacggctggagcgcggctcgtcgtgctcgccaccgctacgcctccgggatcggtcaccgtgccacatcccaatatcgaggaggtggccctgtccaacaccggagagatccccttctacggcaaagccatccccatcgagaccatcaaaggggggaggcatctcattttctgtcattccaagaagaaatgtgacgagctcgctacgaagctggtggccctcggagtcaacgctgtagcgtattaccggggtcttgatgtgtccgtcataccgacaagcggagacgtcgttgtcgtggcaacagacgctctaatgacgggctataccggtgactttgattcagtgatcgactgtaatacatgtgtcacccagacagtcgacttcagcttggaccctactttcaccattgagacaacgaccgtgccccaagacgcggtgtcgcgctcgcagcggcgaggcaggactggtaggggcagagggggtatatataggtttgtgactccaggggaacggccctcgggcatgttcgattcttcggtcctgtgtgagtgctatgacgcgggctgtgcttggtacgagctcacgcccgccgagacctcggttaggttgcgggcctacctaaatacaccagggttgcccgtctgccaggaccatctggagttctgggagagcgtcttcacaggcctcacccacatagatgcccacttcttgtcccagaccaagcaggcaggagacaacttcccctacctggtagcgtaccaggctacggtgtgcgccagggcccaggctccacctccatcgtgggatcagatgtggaagtgtctcatacggctaaagcctacattgcacgggccgacacccctgctgtacaggctgggagccgtccaaaatgatgtcaccctcacacaccccgtaaccaagttcatcatggcatgcatgtcggctgacctagaggtcgtcacgagcacctgggtgctggtaggcggggttcttgcggctctggccgcgtactgcctgacaacgggcagcgtggtcattgtgggcaggatcatcttgtccggaaggccggccatcattcccgacagagaagtcctctaccaggagttcgatgaaatggaagagtgcgcctcacacctcccttacatcgaacagggaatgcagcttgccgagcaattcaagcagaaagcgctcgggttgctgcagacggccaccaagcaagcggaggtcgccgctcccgtggtggagtccaagtggcgagcccttgaggccttctgggcgaagcatatgtggaatttcatcagcgggatacagtatctagcaggcttgtccactctgcctgggaaccccgcgatagcatcactgatggcattcacagcctctatcaccagcccgctcaccacccaacataccctcctgtttaacatcttggggggatgggtggctgcccagctcgccccccccagcgctgcttcggctttcgtgggcgccggcatcgctggcgcggctgttggcagcataggccttgggaaggtgcttgtggacatcctggcgggttatggagcaggggtggcaggcgcactcgtggcctttaaggtcatgagcggcgacatgccctccaccgaggacctggtcaacttactccctgccatcctctctcccggtgccctcgtcgtcggggtcgtgtgcgcagcaatactgcgtcggcatgtgggcccaggagagggggctgtgcagtggatgaaccggctgatagcgttcgcttcgcggggtaaccacgtctcccccacgcactacgtgcctgagagcgacgccgcagcgcgtgtcacccagatcctctccagcctcaccatcactcagctactgaagaggctccatcagtggattaatgaggactgctccacaccatgctccggctcgtggctcagggatgtttgggactggatatgcacggtgttgactgacttcaagacctggctccagtccaagctcctgccacggttaccgggagtccctttcctctcatgccaacgtgggtacaagggagtctggcggggggatggcgtcatgcaaaccacctgcccatgtggagcacaaatcgccggacatgtcaaaaacggttccatgaggatcgttgggcctaaaacctgtagcaacacgtggcatggaacattccccatcaacgcgtacaccacaggcccctgcacaccctccccggcgccaaactactccaaggcgttgtggcgggtggctgctgaggagtatgtggaggtcacgcgggtgggggatttccattacgtgacgggcatgaccactgacaacataagatgcccatgccaggttccggcccctgaattcttcacggagttggatggggtgcggctgcacaggtacgctccggtgtgcaaacctctcctacgggatgaggtcacattccaggtcgggctcaaccaattcccggttgggtcacagctcccatgtgagcccgaaccggatgtaacagtgctcacttccatgctcaccgacccctcccacattacggcagagacggccaagcgtaggctggccagagggtcccccccctccttggccagctcttcagctagtcagttgtctgcgccctccttgaaggcgacatgcactacccgtcatgactccccagacgccgaccttatcgaggccaacctcttgtggcggcaggagatgggagggaacatcacccgcgtggagtcagaaaacaaggtagtaattctagactcttttgatccgctccgagcggaggaagatgagagggaggtgtctgttgcggcggagatcctgcggaaaaccaggaaattccccccagcgatacccatatgggcacgcccagactacaacccaccactgctagagtcttggagggacccgaactacgtccctccagtggtacacgggtgcccattgccacctgccaaggcccctccaataccacctccacggaagaaaaggacagttgtcctgacagaatccaccgtgtcttctgccctggcggagcttgctaccaagaccttcggcagctccggatcgtcggccgtcgacagcggcacagcgaccgcccctcctgaccaaccctccgacgaaggagatacaggatccgacgttgggtcatactcctccatgcccccccttgagggggagccgggggaccccgatctcagcgacgggtcttggtctaccgtgagcgaggaggctagtgaggacgtcgtctgctgctcgatgtcctacacatggacaggcgccttaatcacgccatgcgccgcggaggagagtaagctgcccattaatgcgctgagcaactctttgctgcgccaccacaacatggtctatgccacaacatcccgcagcgcaagccagcggcagaaaaaggtcacctttgacagactgcaagtcctggacgaccactaccgggacgtgctcaaggagatgaaggcgaaggcgtccacagttaaggctaaacttctatctgtagaagaagcctgcaagctgacgcccccacattcagccagatccaaatttggctatggggcaaaggacgtccggaacctatccagtaaggccgttaaccacatccactccgtgtggaaggacttgctggaagaccctgaaacaccaattgacaccaccatcatggcaaaaaatgaggtcttctgtgttcaaccagagaaaggaggccgcaagccagctcgcctcatcgtattcccagacttgggggttcgtgtgtgcgagaaaatggccctttacgacgtggtctccactctacctcaggccgtgatgggctcctcatacggattccagtactctcctggacagcgggtcgagttcctggtgaatgcctggaaatcaaagaaaagccccatgggcttcgcatatgacacccgctgttttgactcaacggtcactgagaacgacatccgtgttgaggagtcaatttaccaatgttgtgacctggcccccgaggccagacaggtgataaggtcgctcacagagcggctttacatcgggggccccctgactaactcaaaagggcagaactgcggttatcgccggtgccgcgccagcggcgtgctgacgaccagctgcggtaataccctcacatgttacttgaaggcctctgcagcctgtcgagctgcgaagctccaggactgcacaatgctcgtgtgcggagacgaccttgtcgttatctgtgaaagcgcgggaacccaggaggacgcggcgagcctacgagtcttcacggaggctatgactaggtactctgccccccccggggacccgccccgaccggaatacgacttggagttgataacatcatgctcctccaacgtgtcggtcgcgcacgatgcatctggcaaacgggtgtattacctcacccgtgaccccaccaccccccttgcgcgggctgcgtgggagacagctagacacactccagttaactcctggctaggcaacatcatcatgtatgcgcccaccctctgggcaaggatgattttgatgactcacttcttctccatccttctagcccaggagcagcttgaaaaagccctagattgtcagatctacggggccacttactccattcaaccacttgatctacctcaaatcattcagcgactccatagtcttagcgcattttcactccatagttactctccaggtgagatcaatagggtggcatcatgcctcaggaaacttggggtaccacccttgcgagtctggagacatcgggccagaagtgtccgcgctaagctactgtcccaaggagggagggccgccacttgtggcaagtacctcttcaactgggcagtaaggaccaagcttaaactcactccaatcccggccgcgtcacagttggacttgtccggctggttcatcgctggctacagcgggggagacatatatcacagcctgtctcgtgcccgaccccgctggtttatgtggtgcctactcctactttctgtaggggtaggcatctacttgctccccaaccgataaacggggagctaaacactccaggccaataggccgttctgtttttttttttttttttttttttttttttttttttttttttttttttttttttttttttttttttttttttttttttttttttttccttttttttattcctcttctggtggctccatcttagccctagtcacggctagctgtgaaaggtccgtgagccgcatgactgcagagagtgctgatactggcctctctgcagatcatgt

SEQ ID NO: 591 - DNA, 9344 bp, Hepatitis C Virus
atagatcactcccctgtgaggaactactgtcttcacgcagaaagcgtctagccatggcgttagtatgagtgtcgtgcagcctccaggtccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacaaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggcagggcctgggctcagcccgggtacccctggcccctctatggcaatgagggtctggggtgggcaggatggctcctgtcaccccgtggctctcggcctagttggggccccacggacccccggcgtaggtcgcgtaatttgggtaaggtcatcgataccctcacatgcggcttcgccgacctcatggggtacattccgctcgtcggcgcccccctaggaggcgctgccagggccctggcgcatggcgtccgggttctggaggacggcgtgaactatgcaacagggaatctgcccggttgctctttctctatcttcctcttggccctgctgtcctgtttgaccgtcccagcttccgcttatgaagtgcgcaacgtgtccggggtgtaccatgtcacgaacgactgctccaactcaagtatcgtgtatgaggcagcggacataatcatgcacacccccgggtgcgtgccctgcgttcgggagaacaattcttcccgctgctgggtggcgctcactcccacgctagcggctaggaacagcagcatccccaccacgacaatacgacgccatgtcgatttgctcgttggggcggctgctttctgctccgctatgtacgtgggagatctctgcggatctgtcctcctcgtctcccagctgttcaccttctcacctcgccggtatgagacggtacaggactgcaattgctcaatttatcccggccacgtatcaggtcaccgcatggcttgggatatgatgatgaactggtcacccacaacagccctagtggtatcgcagttactccggatcccacaagccgtcatggatgtggtggcgggggcccactggggggtcttggcgggccttgcctactattccatggtggggaactgggccaaggtcttgattgtgatgctactctttgccggcgttgacggaagtaccaatgtgatagggggggagcaggctcacaccaccagtggctttgcgtccctctttacgcgagggcctactcagaaaatccaacttataaataccaacggcagctggcacatcaacaggactgctctgaattgcaatgactccctccagactgggttcattgccgcgctgttctataagtacaagttcaactcgaccggatgcccagagcgcttggccaactgccgccccattgaccagttcgctcaggggtggggtcccatcacttatgctaattctcacatccgggaccagaggccttattgctggcactacgcacctccaccgtgtggtatcgtacccgcgtcggaggtgtgtggtccagtgtattgcttcaccccaagccctgtcgtggtggggacgaccgaccgttccggcgtccccacgtataggtggggggagaatgagacggacgtgctactcctcaacaacacacgaccaccgcaaggcaactggttcggctgcacatggatgaatagcaccgggttcaccaaggcgtgcggggcccccccgtgtaacatcgggggggtcggcaacaacaccttgacctgccctacggattgcttccggaagcaccccgaggccacttacaccaaatgcggctcggggccctggttgacacccaggtgtatggttgactatccatacagactatggcactacccctgcactgttaactttaccatcttcaaggtcaggatgtatgtggggggcgtggagcacaggctcgacgctgcgtgcaattggactcgaggagagcgttgtgacctggaggacagggataggtcagagctcagcccgctgctactgtctacaacggagtggcaggtgctgccctgctccttcaccaccctaccggctctgtccactggtttgatccatctccaccaaaacatcgtggacgtgcaatacctgtacggtatagggtcagcggtcgcctccgctgtaatcaaatgggagtatgtcatgctgctcttccttctcctggcggacgcacgcgtctgcgcctgcttatggatgatgttgttaataggccaggctgaggccgccctggagaacctggtggtcctcaatgcggcgtccgtggccggagtgcatggcattctctcctttcttgtgttcttctgcgctgcctggtacatcaaaggtaggctggtccctggggcggcatatgctctctacggcgtatggccgctgctcctgctcctgctggcgttaccaccacgagcatacgccatggaccgggagatggccgcatcgtgcggaggcgcggtcctcgtaggtctggtgctcttgaccttgtcaccacactataaagtgttcctcgccaggctcatatggtggttacaatacttaatcaccagggccgaggcgcacttgcaagtgtggatcccccccctcaacgtccgggggggccgcgatgccatcatcctcctcacgtgtgcggtccactcagagctaatttttgacatcaccaaaatcttgctcgccatactcggtccgctcatggtgctccaagctggcctaactagggtgccgtacttcgtgcgcgctcaagggctcattcgtgcatgcatgttggtgcggaaagtcgctgggggccattatatccaaatggctctcatgaagctggccgcactgacgggcacgtacgtttataaccatcttactccactgcgggactgggcccacgcgggcctgcgggacctcgtggtggcagttgagcccgtcattttctctgacatggagactaagatcatcacctggggggcagacaccgcggcgtgtggagacatcatctcgggcctacccgtctccgcccgaagggggaaggagatactcctgggaccggccgatagctttggagaacaagggtggcgactccttgcgcctatcacggcctattcccaacagacgcggggtctactgggctgcatcatcactagcctcacaggtcgggacaagaaccaggtcgagggggaggttcaggtggtttccaccgctacacaatctttcctggcgacctgtgtcaacggcgtgtgttggactgtctaccatggcgccggctcaaagaccctagccggtccaaaaggtccgatcacccaaatgtacaccaatgtagaccaagacctcgtcggctggcaggcgccccccggggcgcgctccatgacgccatgcacctgcggtagctcggacctttatttggtcacgaggcacgctgatgtcattccggtgcgccggcggggcgacggcagggggagcctactctcccccaggcccatctcctacttgaagggctcctcaggtggaccactgctctgccccttggggcacgttgtgggcatcttccgggctgctgtgtgcactcggggggttgcgaaggcggtggaatttgtacccgttgagtctatggaaactactatgcggtctccggtcttcacggataactcatctcccccggccgtaccgcaggcattccaagtggcacatctacacgcccccactggcagcggcaagagcaccaaggtgccagctgcatacgcggcccaagggtacaaggtactcgtcctgaacccgtccgttgctgccaccttaggttttggggcgtatatgtctaaggcatatggtgtcgaccctaacgtcagaactggggtgaggaccatcaccacgggcgctcccatcacgtactccacctatggcaagtttcttgccgacggaggttgctctgggggcgcctacgacatcataatatgtgatgagtgccactcaaccgactcgacttccatcttgggcattggcacagtcctggaccaagcggagacggctggagcgcggctcgtcgtgctcgccaccgctactcctccgggatcggtcaccgtaccacacccaaacatcgaggaggtggccttgtccaacactggagagattcccttctatggcaaagccatccccatcgagaccatcaagggggggaggcatctcattttctgccattccaagaagaagtgcgacgagctcgccacaaagttgtcggccctcggagttaatgctgtagcgtactaccggggtcttgatgtgtccgtcataccaacaaacggagacgtcgttgtcgtggcaacagacgccctaatgacgggctataccggcgactttgactcagtgatcgactgtaacacatgtgtcacccagacagtcgatttcagcttggaccctactttcaccattgagacgacgaccgtgccccaagacgcggtgtcgcgctcgcagcggcgaggcaggaccggtaggggcagagcgggcatatacaggtttgtgactccaggagaacggccctcgggcatgttcgactcctcggtcttgtgtgaatgctatgacgcgggctgcgcttggtacgagctcacgcccgccgagaccacagttaggctgcgggcttacctaaatacaccaggattgcccgtctgccaggaccatctggagttctgggagggcgtcttcacaggcctcacccacatagatgcccacttcttgtcccagaccaagcaggcaggagacagcttcccctacctggtagcgtaccaggctacggtgtgcgccagggcccaggccccacctccatcgtgggatcaaatgtggaaatgtctcatacggctaaagcctacgctacacgggccaacacccctgttgtacaggctaggagccgttcaaaacgagatcaccctcacacaccccataaccaaattcatcatggcatgcatgtcggctgacctagaggtcgtcacgagcacctgggtgctggtaggcggggtccttgcagctctggccgcgtattgcttgacaacgggcagcgtggtcattgtgggcaggatcatcctgtctgggaggccggctattattcctgacagggaagttctctaccaggagttcgatgaaatggaagagtgcgccacacatcttccttacatcgaacaaggaatgcagctcgccgagcaattcaaacagaaagcgctcgggttgctgcaaacagccaccaaacaagcggaggctgctgctcccgtggtggagtccaagtggcggacccttgaggccttctgggcgaagcacatgtggaacttcatcagcggggtgcagtacttagcaggcttgtccactctgcctgggaaccccgcgatagcatcactgatggcattcacagcctctatcaccagcccgctcaccacccaacataccctcttgtttaacatcttggggggatgggtggccgcccaactcgccccccccagcgctgcttcagcttttgtgggcgccggcatcgccggcgcagctgttggcagcataggccttgggaaggtgcttgtggaaatcttggcgggttatggagcgggggtagcaggcgcactcgtggcttttaaggtcatgagtggcgagatgccctctaccgaggacctggtcaacttactccctgccatcctctctcctggtgccctggtcgtcggggtcgtgtgcgcagcaatactgcgtcggcatgtgggcccaggggagggggctgtacagtggatgaaccggctgatagcgttcgcttcgcggggtaaccacgtctcccccacgcactacgtgcctgagagcgacgctgcagcgcgtgttacccagatcctctccagccttaccatcactcagctgttgaaaaggctccaccagtggatcaatgaggactgctccacgccgtgctccggctcgtggctcagggacgtttgggactggatatgcacggtgttgactgacttcaaaacctggctccagtccaagctcctgccgcgattaccgggagttcctttcttttcatgtcaacgtgggtacaagggagtctggcggggagatggcgtcatgcagaccacctgcccatgtggagcacaaatcagcggccatgtcaaaaacggttccatgaggatcgctgggcctaagacctgtagcaacacgtggcaaggaacattccccatcaacgcatacaccacaggcccctgcacaccctccccggcgccaaactattccagggcgctgtggcgggtggctgctgaggactacgtggaggttacgcgggtgggggatttccactacgtgacgggcatgactactgacaacgtaaagtgcccatgccaggttccggcccccgaattcttcacggaattggacggggtgcggctgcacaggtacgctccggcgtgcaaacctctcctacgggatgaggtcacattccaggtcgggctcaaccaattcccggttgggtcacagctcccatgtgagcccgaaccggatgtaacagtgatcacttccatgctcaccgacccctcccacattacagcagagacggctaagcgtaggctggccagagggtctcccccctctttggccagctcttcagctagtcaattgtctgcgccttccttgaaggcgacatgcactacccatcatgactccccagacgccgacctcatcgaggccaacctcctgtggcggcaggagatgggcgggaacatcactcgcgtggagtcagagaataaggtagtaatcctagactcttttgaccagctccgggcggaagaggatgagagggaaatatccgttgaggcggagatcctccggaaaaccaggaagttccccctagcgatgcccatatgggcacgcccggactacaacccaccgctggtagagccttggaaggacccggactacgtccctccagtggtacacgggtgcccattaccacccaccaaggcccctccaataccacctccgcggaggaagaggacggtcatcctgacagaatccaccgtgtcctctgccttggcggagcttgctacaaagaccttcggcagctccgggtcgtcggccgtcgacagcggtacggcgaccgcccctcctgaccagtcctctgatgacggagatacaggatccgacgctgggtcgtactcctccatgcccccccttgagggggagccgggggaccccgatctcagcgacgggtcctggtctactgtgagtgaggaggctagtgaggacgtcgtctgctgctcgatgtcctacacatggacgggcgccctgatcacgccatgcgccgcggaggagagcaagctgcccattaacgcgctgagcaactctttgctgcgtcaccacaacatggtctatgccacaacatcgcgcagcgcaagccagcggcagaaaaaggtcacctttgacagactgcaagtcctggacgaccactaccgggacgtgctcaaggagatgaaggcgaaggcgtccacagtcagggctaaacttctatccgtagaagaagcctgcaagctgacgcccccacattcggccaaatctaaatttggctatggggcgaaggacgtccggaacctatccagcagggccgttaaccacatccgctccgtgtggaaggacttgctggaagacactgtgacaccaattgacaccaccgtcatggcaaagaatgaggtcttctgtgttcaaccagagaaaggaggccgcaagccggctcgccttatcgtattcccagacttgggggttcgtgtgtgcgagaaaatggccctctatgacgtggtctccaatcttcctcaggccgtgatgggctcctcatacggattccagtactctcctgggcagcgggtcgagttcctggtgaatgcctggaaatcgaagaaaaaccccatgggcttcgcatatgacacccgctgttttgactcaacggtcactgagagtgacatccgtgttgaggagtcaatttaccaatgttgtgacctggcccccgaggccagacaggccataaggtcgctcacagagcggctttatatcgggggccccctgactaattcaaaagggcagaactgcggttatcgccggtgccgcgccagcggcgtgctgacgactagctgcggtaatacccttacatgttacttgaaggcctctgcagcctgtcgagctgcgaagctccaggactgcacgatgctcgtgtgcggggacgaccttgtcgttatctgtgaaagcgcggggacccaggaggacgcggcgagcctacgagtcttcacggaggctatgactaggtactctgccccccccggggacccgccccaaccggaatacgacttggagctgataacatcatgctcctccaacgtgtcggttgcgcacgatgcacttggcaaacgggtgtactacctcacccgtgaccccgccatcccccttgcgcgggctgcgtgggagacagctagacacactccagtcaactcctggctaggcaacatcatcatgtatgcgcccactttgtgggcgaggatgattctgatgacccacttcttctccatcctcctagctcaggagcagcttggaaaagccctagattgtcagatctacggggctacttactccattgagccacttgacctacctcagatcattcagcgactccatggtcttagcgcattttcactccatagttactctccaggtgagatcaatagggtggcttcatgcctcagaaaacttggggtaccacccttgcgagcctggagacatcgggccagaagtgtccgcgctaagctactgtcccaaggggggagggctgccacctgtggcaaatacctcttcaattgggctgtaaggaccaagctcaagctcactccaatcccggctgcgtcccagctggacttgtccggctggttcgttgctggttacggcgggggagacatatatcacagcctgtctcgtgcccgacctcgctggtttatgtggtgcctactcctactttctgtaggggtaggcatctatctgctccccaaccggtgaa

SEQ ID NO: 592 - DNA, 9460 bp, Hepatitis C Virus
  misc_feature 3303: n = A,T,C or G
atagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacttaacaccaaccgccgcccacaggacgttaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggcaggacctgggctcagcccgggtacccttggcccctctatggcaacgagggcttggggtgggcaggatggctcctgtccccccgcggctcccggcctagttggggtcccacggacccccggcgtaggtcgcgtaatttgggtaaggtcatcgataccctcacatgcggcttcgccgacctcatggggtacattccgctcgtcggcgcccctctaggaggcgttgccagggccctggcacatggtgtccgggttctggaggacggcgtgaactatgcaacagggaatttgcccggttgctctttctctatcttcctcttggctctgctgtcctgtttgaccaccccgacatccgcttatgaagtgcgcaacgtgtccggggtatatcatgtcacgaacgactgctccaactcaagcattgtgtatgaggcagcggacatgatcatgcattcccctgggtgcgtgccctgcgttcgggagaacaactcctcccggtgctgggtagcgctcacccccacgctcgcagccaggaacatcagcgtccccactacgacaataagacgccacgtggacttgctcgttggggcggccgctttctgctccgctatgtatgtgggggatctctgcggatctgtcttcctcgtctcccagctgttcaccttctcacctcgccggtatgagacagtacaggattgcaattgctcaatctatcctggccacgtatcaggtcaccgcatggcttgggatatgatgatgaactggtcgcctacagcagccctagtggtgtcgcagttgctccggatcccacaagctgtcatggacatggtgacagggggccactggggagtcctggcgggccttgcctactattccatggtagggaactgggctaaggtcttgattgtgatgctgctttttgccggcgttgacgggaccacccacgtgtcaggggggacgcaggcctctgctgcccgcggtcttgtgagcctcttttcatctgggtctgctcagaaaattcagcttgtgaataccaatggcagctggcacatcaacaggactgccctgaactgcaatgactccctccagactgggttccttgccgcgctgttctacacgcacaagttcaacgcgtccgggtgcccagagcgcatggccagctgccgtcccatcgacgagttcgctcagggatggggtcccatcacttatgtcaagcctaacaactcagaccagaggccctattgctggcattacgcaccccgaccgtgtggtgtcgtacccgcgtcgaaggtgtgtggtccagtgtattgcttcaccccaagcccggttgtggtggggacaaccgatcgtttcggcgtccctacgtatacctggggggagaatgagacagacgtgctgctcctcaacaacacacggcctccgcttggcaattggttcggctgtacatggatgaatagcactgggtacaccaagacgtgcggtggtcccccgtgtaacatcgggggggtcggtaacaccaccttgacctgtcccacggattgcttccggaagcaccccgaggccacttacacaaaatgtggctcggggccttggttgacacctaggtgcataattcattacccatacaggctctggcattacccctgcactgtcaactttaccatcttcaaggttagaatgtatgtggggggtgtggagcacaggctcaatgctgcatgcaattggactcgaggggagcgttgtaacttggaggacagggatagatcagaactcagcccgctgctgctgtctacaacagagtggcagatactgccctgctcctttaccaccctaccggccctgtccactgggttaatccatctccaccggaatatcgtggacgtgcaatacctgtacggtatagggtcagcagttgtttccattgcaatcaaatgggagtatgtcctgttgcttttccttctcctggcggacgcgcgcgtctgtgcctgcttgtggatgatgctgctgatagcccaagctgaggccgccttagagaacttggtggtcctcaatgcagcggctgtggccggaacacatggcattctttccttccttgtgttcttctgtgccgcctggtatattaagggcaggctggtccctggggtggcatatgctttttacggcgcatggccgctgttcctgctcctgttggctctaccaccacgagcctacgccttggaccgggagatggctgcatcgtgtggaggcgcggtttttataggtctggtactcctgaccttgtcaccatactataaagtgttcctcgctaagctcatatggtggttacaatatttcatcaccagagccgaggcgcacctgcaagtgtggatcccccccctcaacgttcggggaggccgcgatgccatcatcctcctcatgtgtgcggtccatccagagctaatctttgacatcaccaaaatcctgctcgccattttcggtccgctaatggtgttccaggccagcataaccagagtgccgtacttcgtacgcgctcaagggctcattcgtgcatgcatgttagtgcgaaaggccgccgggggtcattatgtccaaatggccttcgtgaagctggccgcactgacaggtacgtacgtttatgaccatcttaccccgctgcgggattgggcccacgcaggcctgcgggaccttgcggtggcagtagagcccgttgttttctctgacatggaaaccaagatcatcacctggggggcagacaccgcggcgtgtggggacatcatctngggtctgcccgtctccgcccgaagaggaagggaggtgctcctggggccagccgatagtcttgaagggcaggggtggcgactcctcgcgcccatcacggcttactcccaacagacgcggggcctacttggttgcatcatcaccagcctcacaggccgggataagaaccaggtcgagggggaggttcaagtagtttccaccgcaacacaatctttcctggcgacctgcatcaacggtgcgtgttggactgtctttcacggcgccggctcaaagactctagccggcccaaagggcccaattacccaaatgtacaccaatgtagacctggacctcgtcggctggcaggcaccccccggggcacgttccatgacaccatgcacctgcggcagctcggacctttacctggtcacgagacatgctgacgtcattccggtgcgccggcggggcgacagcagggggagccttctctcccccaggcccatctcctacttgaagggctcttcgggtggcccactgctctgccccttggggcacgtcgtgggtatcttccgggccgctgtgtgcacccggggggttgcgaaggcggtggacttcatacccgtcgagtctatggaaactactatgcggtctccggtcttcacagacaactcatcccccccggccgtaccgcagacatttcaagtggcccatctacacgcccccactggcagcggcaagagcactaaagtgccggctgcgtatgcagcccaagggtataaggtactcgtcctgaacccgtctgttgccgccaccctaggttttggggcgtatatgtccaaggcatatggtaccgaccccaacattagaactggggtaaggaccatcaccacgggcgcccccatcacgtactccacctatggcaagttccttgccgacggtggttgctccgggggcgcctatgacatcataatatgtgatgagtgccactcaactgactcgactaccatcttgggcattggcacagtcctggatcaagcggagacggctggagcgcggctcgtcgtgctcgccaccgctacgcctccgggatcggtcaccgtgccacaccccaatatcgaagaggtgggcctgtccagcactggagaaatccccttctatggcaaagccattcccatcgaggtcatcaaggggggaagacatctcattttctgtcattccaagaagaagtgcgatgagctcgccgcaaagctgtcagccctcggactcaatgccgtagcgtattaccggggtcttgatgtgtccgtcataccgactagcggagatgtcgttgtcgtggcaacagacgctctgatgacgggctacaccggcgactttgactcagtgatcgactgtaacacatgtgtcacccagacagttgatttcagcttggatcctaccttcaccattgagacgacgaccgtgccccaagacgcggtgtcgcgctcgcagcggcggggtaggactggcaggggtaggagaggcatctacaggtttgtgactccaggagaacggccttcgggtatgttcgattcctcggtcttgtgtgagtgctatgacgcgggctgtgcttggtacgagctcacgcccgctgagaccacggttaggttgcgggcgtacctaaatacaccagggttgcccgtctgccaggaccatctggagttctgggagggcgtcttcacaggccttacccacatagacgcccacttcttgtcccagactaagcaggcaggagacaacttcccttacctggtggcataccaggccacagtgtgcgccagagctcaagccccacctccatcgtgggatcaaatgtggaagtgtctcatacggctgaaacctacactgcacgggccaacacccctgctgtataggttaggagccgtccaaaatgaggtcaccctcactcaccccataaccaaatacatcatggcatgcatgtcggctgacctggaggtcgtcactagcacctgggtgctagtaggcggggtccttgcagctctggccgcgtattgcctgacaacaggcagcgtggtcattgtgggcaggattatcttgtccgggaagccagctgtcatccccgacagggaagtcctttaccgagagttcgatgaaatggaagagtgtgcctcacacctcccgtacatcgaacagggaatgcagctcgccgaacaattcaaacagaaagcgctcgggttgctgcaaacagccaccaaacaagcggaggctgctgctcccatagtggagtccaagtggcgaacccttgagaccttctgggcgaagcacatgtggaatttcatcagcgggatacaatacttagcaggcttatccactctgcctgggaaccccgcgatagcatcactgatggcattcacagcctctatcaccagcccgctcaccacccaaaataccctcctgttcaacatcttgggggggtgggtggctgctcaactcgccccccccagcgctgcttcggccttcgtgggcgccggcatcgccggtgcggctattggcagcataggccttgggaaggtgcttgtggacatcctggcgggttatggggcaggggtggctggcgcacttgtagcttttaagatcatgagcggtgaggcgccctccaccgaggacctggttaacttactccctgccatcctctctcccggcgccctggttgtcggggtcgtgtgcgcagcaatactgcgtcgacatgtgggcccgggagagggggctgtgcagtggatgaaccggctgatagcgttcgcttcgcggggtaaccacgtctcccccacgcactatgtgcctgagagcgacgccgcagtgcgtgtcacccagatcctctccagccttaccatcactcagctgttgaagaggcttcatcagtggattaatgaagactgctccacgccatgctccggctcgtggctaagggatgtctgggactggatatgcacggtgttggctgacttcaagacctggctcaagtccaagctcatgccgcagttaccaggaatccctttcttctcatgccaacgcgggtacaagggagtctggaggggggacggtattatgcagaccacctgcccatgtggagcacagatcaccggacatgtcaaaaatggttccatgaagatcgttgggcctaaaacctgcagcaacatgtggcatggaacattccccatcaacgcatacaccacgggtccctgcacaccctccccggcgccaaactattccagggcgctgtggcgagtggctgctgaggagtacgtggaggttacgcgggtgggggatttccactacgtgacaggcatgacctctgacaacgtgaagtgtccatgccaggttccggcccccgaattcttcacggaagtggatggagtgcggttgcacaggtatgctccgacgtgcaagcctctcctacgggaggaggtcgtattccaggtcgggctcaatcaatacctggttggatcacaacttccatgcgagcccgagccggatgtagcagtgctcacttccatgctcaccgacccctcccacattacagcagaaacggctaagcgtaggctggccagggggtctcccccctccttggccagctcgtcagctagccagttgtctgcgccttccttgagggcgacatgcactacccactcctcctggggtaatgaccccccggacattgacctcatcgaggccaacctcttgtggcggcaagagatgggtgggaacatcacccgcgtggagtcagagaacaaggtagtaattctggactctttcgacccgcttcgaacggaggaggacgagggggaaatatccgttgcggcggagatcctgcggaaatccaggaagttccccccggcattgcctgtatgggcacggccggattataatcctccactgctagagtcctggaaggacccggactacgtccctccggtggtacacgggtgcccgttgccgcctactaaggcccctccaataccgcctccacggagaaagaggacagttgtcctgacagagtccactgtgtcttctgctttggcggagctcgctgttaagaccttcggcagctccggaccgtcggccgtcgacagcggcgcggcgactgcccctcctgaccaggcttccgacgacggtgacaaaggatccgacgttgagtcgtactcctccatgcccccccttgagggagagccgggggaccccgatctcagcgacgggtcttggtctaccgtgagtgaggaggctggtgatgacgtcgtctgctgctcaatgtcctacacatggacaggcgccctgatcacgccatgcgctgcggaggaaagcaagttgcccatcaacccgttgagcaactccttgctgcgtcaccacaatatgatctatgccacaacatcccgtagcgcaggcctgcggcagaagaaggtcacctttgacaggctacaagtcctggacgaccactaccgggacgtgctcaaggagatgaaggcgaaggcgtccacagttaaggctaaactcctatctatagaagaagcctgcaagctgacgcccccacattcggccaaatccaaatatggctatggggcaaaggacgtccggagcctatccagcaaggccgttaaccacatccactccgtgtggaaggacttgctggaggacactgagacaccaattaacaccaccatcatggcgaaaagtgaggttttctgcgtccaaccagagaaaggaggccgcaagccagctcgccttatcgtattcccagacctgggagttcgtgtgtgcgagaagatggccctctacgacgtggtctccacccttcctcaggccgtgatgggctcctcatacggattccagtactctcccaagcagcgggtcgagttcctggtgaatacctggaaatcaaagaaatgccccatgggcttctcgtatgacacccgctgttttgactcaacggttactgagaatgacatccgtgttgaggagtcaatttaccaatgttgtgacttggcccccgaagccaaactggctataaggtcgctcacagagcggctctatatcgggggccccctgactaattcaaaagggcagaactgcggttaccgccggtgccgcgcaagcggcgtgctgacgactagctgcgggaataccctcacatgttacttgaaagcctctgcggcctgtcgagctgcaaagctccaggactgcacgatgctcgtgaacggagacgaccttgtcgttatctgtgaaagtgcgggaacccaagaggatgcggcgagcctacgagtcttcacggaggctatgactaggtactctgccccccccggggacccgcctcagccagaatacgacttggagttgataacatcatgttcctccaatgtgtcggtcgcgcacgatgcatctggcaaaagggtgtactatctcacccgtgaccccaccacccccattgcacgggctgcatgggagacagctaggcacactccagtcaactcctggctaggcaacatcatcatgtatgcgcccaccttatgggcaaggatgattctgatgactcacttcttctccatccttctagtccaggagcaacttgaaaaggccctagattgtcagatttacggggcctgttactccattgagccacttgatctacctcaaatcattgagcgactccatggtcttagcgcattctcactccatagttactctccaggtgagatcaacagggtggcttcatgcctcaggaaacttggggttccacccttgcgagtctggagacatcgggccagaagtgtccgcgctaagctgctgtcccagggggggagggccgccacttgtggcaagtacctcttcaactgggcagtaaggaccaagcttaaactcactccaatcccggctgcgtcccggctggacttgtccggctggttcgtcgctggttacagcgggggagacatatatcacagcgtgtctcgtgcccgaccccgctggttcatgttgtgcctactcctactttctgtaggggtaggcatctacctgctccccaaccgatgaatggggagctaaacactccaggccaataggccatccccttttttttccttttttttttttttttttttttttttttttttttttttttttttttttttttttttt

SEQ ID NO: 593 - DNA, 9419 bp, Hepatitis C Virus
atagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccagcccgagggcagggcctgggctcagcccgggtacccttggcccctctatggcaatgagggcctggggtgggcaggatggctcctgtcaccccgcggctcccggcctagttggggccccaccgacccccggcgtaggtcgcgcaatttgggtaaggtcatcgataccctcacgtgtggcttcgccgacctcatggggtacattccgctcgtcggcgcccccctagggggcgcagccagggccctggcacatggtgtccgggttctggaggacggcgtgaactatgcaacagggaatttgcccggttgctctttctctatcttcctcttggctctgctgtcctgtttgaccatcccagcttccgcttatgaagtgcgcaacgtgtccgggatataccatgtcacgaacgactgctccaactcaagcattgtgtttgaggcagcggacttgatcatgcatacccccgggtgcgtgccctgcgttcgggagaacaactcctcccgttgctgggtagcgctcactcccacgctcgcggccaggaacgccagcatccccactacggcattacgacgtcacgtcgatttgcttgttggggcggctgccttctgttccgctatgtacgtgggggacctctgcggatctgtctttctcgtctctcagctgttcaccttctcgcctcgccggcatgagacactacaggactgcaattgctcaatctaccctggccatgtgtcaggccaccgcatggcttgggacatgatgatgaactggtcgcctacaacagccctagtggtgtcgcagttactccggatcccacaggctgtcgtggacatggtggcaggggcccactggggagtcctggcgggccttgcctactattccatggcggggaactgggctaaggttttgattgtgatgctgcttttcgccggcgttgacgggaacacccacgtgacaggggggaagcaaggcgccgccgccagcgggcttgcgtccctctttacgcctgggccgtctcagagaatccagcttgtaaacaccaatggcagttggcacatcaacaggactgccctgaactgcaatgactccctccacaccgggttccttgcctcgctgttctacgtacacaagttcaactcgtcggggtgcccagagcgtatggccagctgtcgctccattgatcagtttgaccagggatggggtcccatcacctatgctaagactggcaatctggaccagaggccttattgctggcactacccacctagccaatgtggaatcgtgcccgcgtcgcaggtgtgtggtccagtgtattgcttcaccccaagccctgtcgtcgtggggacaaccgatcgtttcggcgtccctacgtatagctggggggcgaacgagactgacgtgctgcttctcaacaacacgcggccgccgcaaggcaactggttcggctgtacatggatgaatagtactgggttcaccaagacgtgcggggggcccccgtgtaacatcgggggggtcggcaacaacaccttgacctgccccacggactgcttccggaagcaccccgaggccacttacacaaaatgtggttcggggccttggttgacacctaggtgcatagttcactacccatacaggctttggcactacccctgcactgtcaacttcaccatcttcaaggttaggatgtatgtggggggcgtggagcacaggctagatgcagcatgcaattggactcgaggagagcgctgtaacctggatgacagggatagatcggagcttagcccactgctgctgtctacaacagagtggcagatactaccctgctccttcaccgccctaccggctctgtccactggcttgatccatctccatcagaacatcgtggacgtgcaatacctgtacggtatagggtcggcggttgtctcctttgcaatcaaatgggagtatgtcctgttgcttttccttctcctggcggacgcgcgcgtctgtgcctgcttgtggatgatgctactgatagcccaggccgaggccgccttagagaacctggtggtcctcaatgcggcgtctgtggccggagcgcacggcatcctctccctccttgtgttcttctgtgccgcttggtacattaagggcaggctggtccctggggcggcatatgctctttatggcgtatggccgctgctcctgctcctgctggcgttaccaccacgagcttacgccatggaccgggagatggctgcatcgtgcggaggcgcggtttttgtgggtctggcatttttgactctgtcgccatactacaaggtgttcctcgctaggctcatatggtggttacaatattttatcaccagagccgaggcgctcctgcatgtgtggatcccccccctcaacgttcggggaggccgcgatgccatcatcctcctcacgtgtgcggtccacccagagctaatctttgacatcaccaaacttctgattgccatactcggtccgctcatgatgctccaagctggtataaccagagtgccgtacttcgtacgcgctcatgggctcattcgtgcatgcatgttagtgcggaaagtcgctgggggtcattatttccaaatggccctcatgaagctgggcgcactgacgggcacgtacatttacaaccatctcaccccactgcgggattgggcccacgcgggcctacgagaccttgcggtggcagtagagcccgtcgtcttctctgacatggagaccaagatcaccacctggggggcagacaccgcggcgtgtggagacatcatcttgggcctacccgtctccgcccgaaggggaaaggagatactcctgggaccggccgatagccttgaggggcaggggtggcgactccttgcgcccatcacggcttactcccaacagacgcggggcttacttggttgcatcatcaccagcctcacaggccgtgacaagaaccaggtcgagggggaggttcaagtggtttccaccgcgacacaatctttcctggcgacctgcgtcaacggcgtgtgctggactgtttatcatggtgctggctcaaagaccctagctggcccaaaaggccctattacccagatgtacactaatgtagaccaggacctcgtcggctggcaggcgccccccggggcgcgctccctgacaccatgcacttgtggcagctcggacctttatttggtcacgagacatgctgacgtcattccggtgcgccggcggggcgacagtaaggggagcctactctcccccaggcctgtctcctacttgaagggctcttcaggtggtccactgctctgcccctcggggcacgctgtgggcatcttccgggccgctgtatgcacccgaggggtcgcgaaagcagtggattttgtgcccgttgagtccatggaaactactatgcggtctccggttttcacagacaactcatcccccccggccgtaccgcagtcattccaagtggcccatctacacgctcccaccggcagcggtaagagtactaaagtgccggctgcatatgcagcccaagggtacaaggtgctcgtcttgaacccgtccgtcgccgccaccttaagttttggggcgtatatgtctaaggcatatggtgtcgaccctaacatcagaactggggtaaggaccattaccacgggcgcccccatcacgtattccacctacggcaagtttcttgctgacggcggttgctccgggggcgcttatgacatcataatatgtgatgagtgccactcaactgactcgaccaccatcttgggcattggcacagtcctggatcaagcggagacggctggagcgcggctcgtcgtgctcgccaccgctacgcctccgggatcggtaaccgtgccacacccaaacatcgaggaggtaggcctgtctaatactggagagatccccttctacggcaaagccatccccatcgaagccatcaaggggggaaggcatctcattttctgtcattccaagaagaagtgcgacgaactcgccgcaaggctgttaagcctcggggttaatgctgtagcgtattaccgaggtcttgatgtgtccgtcataccgaccagcggagacgtcgttgtcgtggcaacagacgctctaatgacgggctataccggtgactttgactcagtaatcgactgtaacacatgtgtcacccagacagtcgacttcagcttggatcccaccttcaccattgagacgacgaccgtgccccaagacgcagtgtcacgctcgcagcggcgaggtaggactggcaggggcaggagaggcatctacaggtttgtgactccgggagaacggccttcgggcatgttcgattcttcggtcctgtgcgagtgctatgacgcgggctgtgcttggtacgagctcacccccgctgagacctcggttaggttgcgggcttacctgaatacaccagggttgcccgtctgccaggaccatctggagttctgggagagcgtcttcacaggcctcacccacatagatgcccacttcttgtcccagactaagcaggcaggagacaacttcccctacctggtagcataccaagccacagtgtgcgccagggctcaggccccacccccatcatgggatctaatgtggaagtgtctcacacggctaaaacctacactgcacgggccaacgcccctgctgtataggttgggggccgtccaaaatgaggtcgtcctcacacatcccataaccaagtacatcatggcatgcatgtcggctgacctggaggtcgtcactagcacctgggtgctagtaggcggggtccttgcagctctggccgcatactgcttgacaacaggcagtgtggtcattgtgggcaggatcatcttgtccgggaggccggttatcattcccgacagggaagttctctaccgggagttcgatgaaatggaagagtgcgcctcgcacctcccttacatcgaacagggaatgcagcttgccgagcaattcaagcagaaagcgctcgggttgctgcaaacagccaccaagcaagcggaggctgctgctcccgtggtggagtccaaatggcgagcccttgaggccttctgggctaagcacatgtggaatttcatcagcgggatacagtacttagcaggcttatccaccctgcctgggaaccccgcgatagcatcattgatggcattcacagcctctgtcaccagcccgctaaccacccaaaataccctcctgtttaacatcttggggggatgggtagccgctcaactcgctcccccaagcgctgcttcggctttcgtgggcgctggcatcgtcggtgccgctgttggcagcgtaggccttgggaaggtgcttgtggatgttctggcgggctatggagcgggggtggctggcgcactcgtggcctttaaggtcatgagcggcgaggcgccctccactgaggacatgatcaacctactccctgccatcctctctcctggcgccctagtcgtcggggtcgtatgcgcagcaatactgcgccgacacgtgggcccgggagagggggctgtgcagtggatgaaccggctgatagcgttcgcttcgcggggtaatcacgtctcccccacgcactatgtgcctgagagcgacgccgcagcgcgtgtcactcagatcctctccagccttaccatcacgcagctgttgaagaggttacaccagtggattaatgaagactgctccacgccatgctccggctcgtggctgagggatgtttgggactggatatgcacggtgttgactgacttcaaaacctggctccagtccaagctcctaccgcggttaccgggtgtcccttttttctcatgccaacgcgggtacaagggaatctggcggggggacggcatcatgcacaccacctgcccatgtggagcacagatcaccggacatgtcaaaaacggttccatgaggatcgttgggccaaaaacctgcagtaacacgtggcatggaacattccccatcaacgcatataccacaggcccctgcacacccaccccggcgccaaactactccaaggcgttgtggcgggtggctgccgaggagtacgtggaggttacgcgggtgggggatttccactacgtgacgggcatgaccactgacaacgtaaagtgcccatgccaggttccggcccctgaattcttcacggaggtggatggggtgcggttgcacaggtacgctccagcgtgcaaacctctcttacgggatgaggtcacattccaggtcgggctcaaccaatacctggttgggtcacagctcccatgtgagcccgaaccggacgtagccgtgctcacttccatgctcaccgacccctcccacattacagcagaggcggctaagcgtaggttggccagggggtctcccccctctttggccagctcttcagctagccagttgtctgcgccttccttgaaggcgacatgtactacccatcatgactccccggatgctgacctcatcgaggccaacctcctgtggcggcaggagatgggcgggaacatcacccgcgtggagtcggaaaacaaggtagtgatcctggactctttcgatccgcttcatgcggaggaggatgagagggaagtatccgttgcggcggagatcctgcggaaatccaggaagttccccgcggcgatgcctgtatgggcacggccggattacaatcctccactgttagagtcttggaaagacccggactacgtccctccggtggtacacgggtgcccattgccacccaccaaggcccctccaataccacctccacggagaaagaggacggttgtcctgacagagtccaccgtgtcttctgccttggcggagctcgctactaagaccttcagcggctccggatcgtcggccatcgacagcggcacggcgaccgccccccctgaccagacttccgacgacggcgacagaggatccgacgttgagtcgtactcctccatgcccccccttgagggggagccgggggatcccgacctcagtgacgggtcttggtctaccgtgagcgaggaggctggtgaggacatcgtctgctgctcaatgtcatacacatggacaggtgccctgatcacgccgtgcgctgcggaggaaagcaagctgcccatcaacgcgctgagcaactcgttgctgcgccaccacaacatggtctatgccacaacatcccgcagcgcaagcctgcggcagaagaaggtcacctttgacagactgcaagtcctggacgaccactaccgggacgtgcttaaggagatgaaggcgaaggcgtccacggttaaggctaaactcctatctatagaagaagcctgcaagctgacgcccccacattcagccaaatccaagtttggctacggggcaaaggacgtccggaacctatccagcaaggccgtcaaccacatcagctccgtgtggaaggacttgctggaagacactataacaccaattgacactaccatcatggcaaaaagtgaggttttctgcattcaaccagagaaaggaggtcgcaagccagctcgccttatcgtattcccagatctgggagttcgtgtatgcgagaagatggccctttatgatgtggtctccacccttcctcatgccgtgatgggctcctcatacggattccaatactctcctgggcagcgggtcgagttcctggtgaatacctggaaatcaaagaaaaaccctatgggcttttcatatgacacccgctgttttgactcaacagtcactgagaacgacatccgtgttgaggagtcaatttaccaatgttgtgacttggcccccgaagccagacaggccataaggtcgctcacagagcggctttacatcgggggtcccctgactaattcaaaagggcagaactgtggttatcgccggtgccgcgcgagcggcgtgctgacgactagctgcggcaataccctcacatgctacttgaaagcctctgcagcctgtcgagctgcgaagctccaggactgcacgatgctcgtgaacggagacgaccttgtcgttatctgtgagagcgcgggaacccaggaggatgcggcgaacctacgagtcttcacggaggctatgactaggtactctgccccccccggggacccgccccaaccagaatacgacttggaactgataacatcatgttcctccaatgtgtcggtcgcgcacgatgcatctggcaaaagggtgtactacctcacccgcgatcccaccactcccctcgcgcgggctgcgtgggaaacagctagacacactccagttaactcctggctaggcaacattatcatgtatgcgcccaccttatgggcaaggatgattatgatgacccacttcttctccatccttctagctcaggagcaacttgaaaaagccctggattgccagatctacggggcctgttactccattgagccacttgacctacctcagatcattgaacgactccatggtcttagcgcattttcactccatagttactctccaggtgagatcaatagggtggcttcatgcctcaggaaacttggggtaccacccttgcgagtttggagacatcgggccaggagcgtccgcgctaaactactgtcccagggggggagggccgccacctgtggcaaatacctcttcaactgggcagtgaagaccaagcttaaactcactccaattccggctgcgtcccagttggacttgtccggctggttcgttgccggttacagcgggggagacatatatcacagcctgtctcgtgcccgaccccgctggttcatgctgtgcctactcctactttctgtaggggtaggcatctacctgctccccaaccgatgaacggggagctaaacactccaggccaataggccatcccctttttttttttttttttttttttttttttttttttttt

SEQ ID NO: 594 - DNA, 9504 bp, Hepatitis C Virus
gccagcccccgattgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgttaagttcccgggcggtggtcagatcgttggtggagtttacctgttgccgcgcaggggccctaggttgggtgtgcgcgcgactaggaagacttccgagcggtcgcaacctcgtggaaggcgacaacctatccccaaggctcgccggcccgagggcagggcctgggctcagcccgggtacccttggcccctctacggcaatgagggcatggggtgggcaggatggctcctgtcaccccgcggctctcggcctagttggggccccacggacccccggcgtaggtcgcgtaatttgggtaaggtcatcgataccctcacatgcggcttcgccgacctcatggggtacattccgctcgtcggcgcccccctagggggcgctgccagggccctggcacatggtgtccgggttttggaggacggcgtgaactatgcaacagggaatttgcccggttgctctttctctatcttcctcttggctctgctctcctgtctgaccatcccagcttccgcttatgaagtgcgcaacgtgtccgggggataccatgtcacgaacgactgctccaactcaagcattgtgtacgagacagcggacatgatcatgcataccccggggtgcgtgccctgcgttcgggagagcaattactcccgttgctgggtagcgcttactcccacgcttgcggccaggaataacagcgtccctaccatgacaatacgacgccacatcgatttgctcgtggggacggctgctttctgctccgctatgtacgtgggggatctctgcggatctgtcttcctcgtctcccagctgttcaccttctcgcctcgccggcatgagacggtacaggactgcaattgttcaatctatcccggccatctaacaggtcaccgcatggcttgggatatgatgatgaattggtcacctacagcagccctagtggtgtcgcagttactccggatcccacaagctgtcgtggacatggtggcgggggcccactggggggtcctggcgggccttgcctactattccatggtggggaactgggctaaggtgttgatcgtgatgctgctcttcgccggcgttgacgggaggataggcttgataggggggacgacatcccttaacaccttcagggttgcgtctatcttctcacctgggccgtcccagaagattcaacttgtgaacaccaacggcagctggcacatcaacaggactgctctggactgcaaagcctccctccagactgggtttcttgctgggctgctctacgcgaaaaagttcaacacgtccggatgcttggagcgtatggccagttgtcgccccattgatacgttcgctcagggatggggtcccatcacctatacagagcgtgtcaactcggaccagaagccttattgctggcactacgcaccacgacggtgtggtatcatacccgcgtcgcaggtgtgcggtccagtctattgtttcaccccaagccccgttgtggtggggacgaccgatcatcttggtgcccctacgtccgtccggggggagaatggaacagacgtgctgctcctcaacaacacgcggccgccacaaggtaactggttcggctgtacatggatgaatagtactgggttcaccaagacctgcggaggccccccctgcaacatcgggggggggggcggcaacaacaccctgacctgccccacggactgcttccgaaagcaccccgaggctacgtacacaaaatgtggttcggggccttggttgacacctaggtgcttggttgactacccatacaggctctggcactacccctgcactttcaattttaccatcttcaaggtcaggatgtatgtggggggtgtggaacacaggctcagcgttgcatgcaactggactcggggagagcgttgtaatctggaggacagggatagatcagagctcagtccgctgctgctgtctacgacagagtggcagatactgccctgttccttcaccaccctgccagctctgtccaccggtttgattcatctccatcagggcatcgtggacgtgcaatacctgtatggtatagggtcagcgtttgtctcctttgcaatcaagtgggagtatgtcctgttgcttttcctcctcctggcggacgcgcgcgtctgtgcctgcttgtggatgatgctgttgatagcccaggctgaggccgccttagagaacctggtggtcctcaatgcggcgtccgtggccggagcgcatggtatcctctctttccttgtgttcttctgtgccgcctggtacatcaagggcaggctggtccctggagcggcgtatgctctttatggcgtatggccgctactcttgctcctgctagcgttaccaccacgcgcttacgccatggaccgggagatggccgcatcatgtggaggcgcggtttttataggtctggcattcttgaccctgtcaccatactataaagtgttcctcgctaggctcatatggtggttacaatatttcatcactagggctgaagcgcacttgctagtgtgggtcccccccctcaacgttcgggggggccgcgatgccatcattctcctcacatgtgcgatccatccagagctgatctttgacatcaccaaacttctgctcgccatactcggtccgctcatggtgctccaggctggcataactgcagtgccgtactttgtgcgcgcccaagggctcattcgtgcatgcatgttggtgcggaaagtcgccgggggtcattatgtccaaatggccttagtgaagctggccgcactgacaggtacgtacgtttacgaccatctcactccactgcaggattgggcccacgtggccctacgagaccttgcggtggcagtagagccagttgtcttctccgacatggagaccaagatcatcacctggggggcagacaccgcggcgtgtggggacatcattttgggtctacccgtctccgcccgaaggggaaaggagatacttctgggaccggctgatagtcttgaagggcaagggtggcgactcctcgcgcccatcacagcctattcccagcagacccggggccttcttggttgcatcatcaccagcctcacaggccgggacaagaaccaggtcgaaggggaggttcaagtggtttccaccgcaacacaatctttcctggcgacctgtatcaacggcgtgtgttggactgtttatcatggtgccggctcaaagaccttagccggcccaaaaggcccaatcacccaaatgtacaccaatgtagaccaggacctcgtcggctggctggcgccccccggggcgcgctccctgacaccatgcacctgcggcagctcggacctttacttggtcacgagacatgctgatgtcattccggtgcgccggcggggcgacggcagggggagcttactctcccccagacccgtctcctacttgaagggttcttcgggtggtccactgctttgcccttcggggcacgttgtgggcatcttccgggctgctgtgtgcactcggggggttgcgaaggcggttgacttcgtacccgttgaatctatggaaactactatgcggtctccggtcttcacagacaactcgtctcccccggcagtaccgcagacattccaagtggcccatctacacgctcccactggcagcggcaagagcaccaaagtgccggctgcatatgcagcccaagggtacaaggtactagtcctgaacccgtccgttgccgccaccttaagttttggggcgtatatgtctaaggcacatggcaccgaccccaatattagaactggggtaaggaccatcaccacgggcgctcccatcacgtactccacctacggcaagttccttgccgacggcggttgttcggggggcgcctatgatatcataatatgtgatgagtgccactcaactgactcgaccaccatcttgggcatcggcacagtcctggaccaagcggagacggctggagcgcggctcgtcgtgctcgccaccgctacccctccgggatcggtcaccgtgccacaccccaatatcgaggaggtggccctgtccaacactggggaggtccccttctatggtaaagccatccccattgaggccatcaaggggggaaggcatctcatcttctgccactccaagaagaagtgtgacgagctcgccgcaaagctgtcggccctcggactcaatgctgtggcgtattaccggggtcttgatgtgtccgtcataccgaccaacggagacgtcgttgtcgtggcaacagacgctctaatgacgggctttaccggcgactttgactcagtcatcgactgtaacacatgtgttacccagacagtcgatttcagcttggaccccaccttcaccattgagacgacgaccgtgccccaggacgcggtgtcgcgctcgcagcggcgaggtaggactggcaggggtaggaggggcatctacagatttgtgactccaggagaacggccctcgggtatgtttgattcctcggtcctgtgtgagtgctatgacgcgggctgtgcttggtatgagctcacgcccgctgagacctcgattaggttgcgggcttacctgaatacaccagggttgcccgtctgccaggaccatctggagttctgggagggcgtcttcacaggcctcacccacatagacgctcacttcttgtcccagactaagcaggcaggagacaacttcccctaccttgtagcgtaccaagctacagtgtgtgccagggctcaggccccacctccatcgtgggatcaaatgtggaagtgtctcatacggctcaagcccacgctgcacgggccaacacccctgctgtataggttgggagccgtccaaaatgagatcattctcacacaccccataaccaaattcatcatggcttgcatgtcggctgacctggaggtcgtcaccagcacctgggtgctggtaggcggggttctcgcagctctggccgcatactgcttgacaacaggcagtgtggtcattgtgggtaggatcatcttgtccgggaggccggccgttgttcccgacagggaagttctctaccgggagttcgatgaaatggaagagtgcgcctcgcacctcccttacatcgaacaaggaatgcagctcgccgagcagttcaagcagaaggcgctcgggttgctgcaaacagccaccaagcaagcggaggctgctgtccccgtggtagagtccaaatggcaagcccttgaaaccttctgggcaaagcacatgtggaactttatcagcgggatacagtacttagcaggcctatccaccctgcctggaaaccccgcgatagcatcactaatggcattcacagcctctatcaccagcccgcttactacccaaagtaccctcctgtttaacatcttggggggttgggtggctgctcaacttgctccccccagcgctgcttcggccttcgtgggcgccggcatcgccggtgcggccgttggcagcataggccttgggagggtgcttgtggacatcttggcgggctatggggcgggggtggctggtgcactcgtggcctttaaggtcatgagcggcgaaatgccctccaccgaggacctggtcaatttactccctgccatcctctcccctggcgccctggtcgtcggagttgtgtgcgcagcaatactgcgtcgacacgtgggcccgggggagggggctgtgcattggatgaaccggctgatagcgttcgcctcgcggggtaaccacgtctcccccacgcactatgtgcctgagagcgacgccgcagcgcgtgttactcagatcctctccaaccttaccatcactcagttgctaaagaggcttcaccagtggatcaatgaggactgctccacgccatgctccggctcgtggctaagggatgtttgggactggatatgcacggtattgactgacttcaagacctggctccagtccaagctcctgccacgattaccgggagtccctttcttctcatgccaacgcgggtacaagggagtctggcggggggaaggcatcatgcaaaccacctgtccatgtggggcacagatcgccggacatgtcaaaaacggttccatgaggatcgttgggcctaaaacctgcagtaacgtgtggcatggaacgttccccatcaacgcatataccacgggcccctgcaccccctccccggcgccgaactattccaaggcgctgtggagggtggctgctgaagagtacgtggaggttacgcgggtgggggatttccactacgtgacgggcatgaccactgacaacgtaaaatgcccatgccaggttccggcccccgaatttttcacagaggtggacggggtgcggttgcacaggtacgctccggcgtgcaaacctctcctacgggatgaggtctcattccaggtcgggctcaaccaatatctggttgggtcacaactcccatgcgagcccgaaccggatgtagcagtgctcacttctatgctcaccgacccctcccacattacagcagagacggctaggcgtaggttggccagggggtctcccccctccttggccagctcctcagccagccagttatctgcgccttctttgaaggcgacttgcactacccaccatgactccccggacgccgacctcattgaggccaacctcctgtggcggcaggagatgggcgggaacatcacccgagtggagtcagagaacaaagtagtaattctggactctttcgacccgctccgagcggaggaggatgagagggaagtatccgttccggcagagatcctgcggaaatccagggggtttcccccagcgatacccatatgggcacggccggattacaaccctccactgctagagtcctggaaggacccggactacgtccctccggtggtgcatggatgcccattgccacctactagggcccctccaataccacctccacggagaaagaggacgatcgtcctgacagagtccactgtgtcttctgccttggcggagctcgctactaagaccttcagcagctccggatcgtcggccgtcgatagcggcacagcgaccgcccctcctgaccaggcctccgacgacggcgacaaagaatccgacgttgagtcgtactcctccatgcccccccttgagggggagccgggggaccccgatctcagtgacgggtcttggtctaccgttagtgaggaggctagtgaggacgtcgtctgctgctcaatgtcctacacatggacgggcgccctgatcacaccatgcgctgcggaggaaagcaagctacccatcaacgcgctgagcaactctttgctgcgtaaccacaacttggtgtacgccacaacatcccgcagcgcaagccttcggcagaagaaggtcacttttgacagactgcaagtcctggacgaccactaccgggacgtgctcaaggagatgaaggcgaaggcgtccacagtcaaggctaaactcctatctgtagaagaagcctgcaagctgacgcccccacattcggccaaatcaaaatttggctatggggcaaaggacgtccggaacctatccagtagggccgttaaccacatccgctccgtgtggaaggacttgctggaagacactgtgacaccaattgacaccaccgtcatggcaaaaaatgaggttttctgtgttcaaccagagaagggaggccgcaagccagctcgccttatcgtattcccagacctgggagttcgtgtatgcgagaagatggccctttacgacgtggtctccaccctccctcaggccgtgatgggctcctcatacgggttccagtattctcctgggcagcgggtcgagttcctggtgaatgcctggaagtctaagaagtgccctatgggcttctcatatgacacccgctgttttgactcaacggtcaccgagaatgacatccgtgttgaggagtcaatttatcaatgttgtgacttgtcccccgaggccagacaggctataaagtcgctcacagagcggctctacatcgggggccccctaactaattcaaaagggcagaactgcggctatcgccggtgccgcgcaagcggtgtgctgacgactagctgcggtaataccctcacatgttacttgaaggcctctgcagcctgtcgagccgcgaagctccaggactgcacgatgctcgtgaacggagacgacctcgtcgtcatctgtgatagcgcgggggtccaagaggatgaggcatgcctacgagccttcacggaggctatgactaggtactctgccccccccggggacccgcctcagccggcatacgacttggagttgataacatcatgttcctccaacgtgtcggtcgcgcacgacgcatctggcagaagggtgtactacctcacccgtgaccccaccacccccctcgcgcgagccgcgtgggagacagctagacacactccagttaactcctggctaggcaacatcattatgtatgcgcccaccttgtgggtgaggatgattttgatgactcacttcttctccatccttctagcccaggagcaacttgaaaaagccctagattgtcagatctacggggcctgttactccattgagccacttgacctacctcagatcattgagcgactccatggtcttagcgcattttcactccatagttactctccaggtgagatcaatagggtggcttcatgcctcaggaagcttggggtaccacccttgcggatctggagacatcgggccagaagtgtccgcgctaagctgctgtcccagggggggagggccgccacttgtggcaagtacctcttcaactgggcagtaaagaccaagcttaaactcactcctatcccggctgcgtcccagttggatttgtccggctggttcgttgctggttacagcgggggagacatatatcacagcctgtctcgtgcccgaccccgctggttcatgttgtgcctactcctactttccgtaggagtaggcgtctacctgctccccaatcgataaacggggagctaaacactccaggccaataggccgtccccttttttttttttttttttttttttttttttttttttttttttttttttttttttttttttttttttttttttttttttttttttttttt

SEQ ID NO: 595 - DNA, 9344 bp, Hepatitis C Virus
atagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagaccgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgttaagttcccgggcggtggtcagatcgttggtggagtttacctgttgccgcgcaggggccccaggttgggtgtgcgcgcgactaggaagacttccgagcggtcacaacctcgtggaaggcgacaacctatccccaaggctcgccggcccgagggcaggacctgggctcagcccgggtacccttggcccctctatggcaacgagggcatggggtgggcaggatggctcctgtcaccccgcggctcccggcctagttggggccccacggacccccggcgtaggtcgcgtaatttgggtaaggtcatcgataccctcacatgcggcttcgccgacctcatggggtacattccgcttgtcggcgcccccctagggggcgctgccagggccctggcacatggtgtccgggttctggaggacagcgtgaactatgcaacagggaatttgcccggttgctctttctctatcttcctcttggctctgctgtcttgtttgaccatcccagcttccgcttatgaagtgcgcaacgcgtccggggtgtaccatgtcacgaacgactgctccaactcaagcattgtgtatgaagcagcggacatcatcatgcatacccccgggtgcgtgccctgcgtttgggagaataacatctcccgttgctgggtagcgctcactcccacgctcgcagccaggaataacagcatccccactacgacaatacgacgccacgtcgacttgctcgttggggcggctgccttttgctccgctatgtacgtgggggatctctgcggatctgtcttcctcgtctcccagctgttcaccttctcacctcgccggcatatgacagtacaggactgcaattgttcaatctatcctggccacgtatcaggtcaccgcatggcttgggatatgatgatgaactggtcacctacagcagccctggtgatgtcgcagttactccggatcccacaagctgtcgtggacatggtggcgggggcccattggggaatcctggcgggccttgcctactattccatggcggggaactgggctaaggttttgattgtgatgctgctttttgccggcgttgacgggaatactcacgtgacagggggagcgcaagcccgcagcacacgcgggtttgcgtacctcttttcatctgggccttctcagaaaatccagcttgtgaataccaatggcagctggcacatcaacaggactgccctaaactgtaatgattccctccagactgggttcattgccgcgttgttctacgcacacagtttcaacgcgtccggatgcccagaacgcatggccagctgccgtcccattaacagcttcgctcagggatggggtcccatcacttatgctgagcctgtcgactcgggccagaggccttattgctggcactacgcgcctcgaccgtgcggtattgtacccgcgtcggaggtgtgtggtccagtatactgcttcaccccaagtcctgttgtggtggggaccaccgatcgtttcggtgcccctacgtacagctggggggaaaatgagacggatgtgctgctcctcaacaacacgcggcctccgcaaggcaattggttcggctgtacatggatgaatagcactgggttcaccaagacgtgtgggggccccccgtgtaacatcggggggatcggcaacaacaccttgatttgccccacggattgcttccggaagcaccccgaggccacttacacaaaatgtggttcggggccttggttgacacctagatgcttagttgattacccatacaggctctggcactacccctgcactgtcaactttaccatcttcaaggttaggatgtatgtggggggcgtggagcacaggctcagtgctgcatgcaattggacacgaggagagcgttgcgacttggatgacagggatagatcagaactcagcccgctgctgctgtctacaacagagtggcagatactgccctgttcctacaccaccctgccggctctgtccaccggtttaatccatctccatcggaacatcgtggacgtgcaatatctgtacggtatagggtcagcggttgtctccttcgcaatcaaatgggaatacatcctgttgctcttccttctcctagcggacgcgcgcatctgtgcctgcttgtggatgatgctgctgatagcccaggccgaggccgccttagagaacttggtggtcctcaatgcggcgtccgtggccggagcacatggcattctctccttccttgtgttcttctgtgccgcctggtatattaagggcgagctggtccccggggcggcgtatgctctctacggcgtatggccgctgctcttgctcctgttggcattaccgccacgagcctttgccatggaccgggaggtggctgcatcgtgtggaggcgcggtttttataggtctggcactcttgaccttatcaccatactacaaggtgttcctcgctaggctcatatggtggttacagtattttatcactagagccgaggcgtacttgcaagtgtgggtcccccctctcaacgtccggggaggccgcgatgccatcatcctcctcacgtgtgcagtccatccagagctaatctttgacatcaccaaactcctgctcgccatattcggaccgatcatggtgctccaggctggcataactagggtgccgtactttgtacccgcccaagggctcattcgtgcctgtatgttagtgcggaaagccgccgggggtcattatatccaaatggcccttgtaaagctggccgcactgacaggtacgtacgtttatgaccatcttgccccgctgcagcattgggcccatgcgggcctacgagatctcgcggtggcggtagagcccgttgtcttctctgacatggaaaccaaggtcatcacctggggggcagacaccgcagcgtgtggggacatcatcttgggtttgcccgtttccgcccgaaggggaagggagatactcctaggaccagccgatagtcttgaagggcaggggtggcgactcctcgcgcccatcacggcctactcccaacagacgcggggcttacttggctgcatcattactagcctcacaggccgggacaagaaccaggtcgagggggaggttcaagtggtttccaccgcaacacaatctttcctggcgacctgcatcaacggcgtgtgttggactgtcttccacggcgccggctcaaagaccctagccggcccaaaaggtccaatcacccaaatgtacaccaatgtagaccaagacctcgtcggctggcaggcgccccccggggcacgttccatgacaccatgcacctgcggcagctcggacctttacttggtcacgagacatgccgatgtcatcccggtgcgccggcggggcgacggtagggggagccttctctcccccaggcccgtttcttacttgaagggctcttctggtggtccgctgctctgcccttcggggcatgccgtgggcatcttccgggccgctgtgtgcacccggggggtcgcgaaggcggtggacttcatacccgtcgagtctatggaaactactatgcggtctccggtctttacagacaactcatcccctccggctgtaccgcaaacatttcaagtggcccatctacacgcccccactggtagcggcaagagcactaaagtgccggctgcgtatgcaacccaagggtacaaggtactcgtcttgaacccgtccgtcgccgccaccttaagttttggggcatatatgtctaaggcatatggtatggaccctaacctcaggactggggtaaggaccgtcaccacgggcgcccccattacgtactccacttatggcaagttccttgccgacggtggttgctccgggggtgcctatgacatcataatatgtgatgagtgccactcgactgactcgactaccatcttgggcattggcacagtcttggatcaagcggagacggctggagcgcggctcgtcgtgcttgccaccgctacgcctccgggatcggtcaccgtgccacaccccaatatcgaggaggtagccctgtccaacactggagagatccccttctatggcaaagctatccccatcgaggtcatcaaggggggaaggcatctcattttctgccattccaagaagaagtgcgacgagctcgccgcaaagttgtcagccctcggactcaatgctgtagcatattaccggggccttgatgtgtccgtcataccgaccagcggagatgtcgttgtcgtagcaacagacgctctcatgacgggctataccggcaattttgactcagtgatcgactgtaacacatgtgtcaatcagacagtcgatttcagcctggatcccaccttcaccattgaaacgacgaccgtacctcaagacgcggtgtcgcgctcgcagcggcgaggcaggaccggcaggggtagggcaggcatctacagatttgtgactccaggagaacggccctcgggtatgttcgactcctcggtcctgtgtgagtgctatgacgcgggctgtgcgtggtacgagctcacgcccgccgagacctcggttaggttgagggcgtacctaaatacaccagggttgcccgtttgccaggaccatctggagttctgggagagtgtcttcacaggcctcacccacatagatgcccacttcttgtcccagaccaagcaggcgggggacaatttcccctacctggtggcataccaggctacagtgtgcgccagggctcaggctccacctccatcgtgggatcaaatgtggaagtgtctcatacggctaaagcctacactgcacgggccgacgcccctgctgtataggctaggagccgtccaaaatgaggtcaccctgacgcaccccataaccaaatacatcatggcatgtatgtcggctgacctggaggtcgtcaccagcacctgggtgctggtaggcggggtccttgcagctctggccgcgtattgcttgacaacaggcagcgtggtcattgtgggcaggatcatcttgtccgggaagccggctgttattcccgacagggaagttctctaccaggagttcgatgagatggaagagtgcgcttcacacctcccttacatcgaacagggaatgcagctcgccgagcaattcaagcagaaggcgctcgggttgctgcaaatagccaccaagcaagcggaggctgctgctcccgtagtggagtccaagtggcgagcccttgagaccttctgggcgaagcacatgtggaatttcatcagcgggatacagtacttagcaggcttatccaccttgcctgggaaccccgcgatagcatcactgatggcattcacagcctctatcaccagcccgctcactacccaaagtaccctcctgttcaacatcttggggggatgggtggctgcccaactcgctccccccagtgctgcttcagcttttgtaggcgccggcatcgccggtgcggctgttggcagcataggccttgggaaggtgcttgtggatattctggcgggctatggggcaggggtggctggcgcgctcgtagcttttaagatcatgagcggcgaggcgccctccgctgaggacttggttaatttgctccctgccatcctctctcctggcgccctggtggtcggggtcgtgtgcgcagcaatactgcgtcggcacgtgggcccgggagagggggctgtgcagtggatgaaccggctgatagcgttcgcttcgcggggtaaccacgtctcccccacgcactatgtgcctgagagcgacgctgcagcgcgtgtcactcagatcctctccagccttaccatcactcagctgctgaagaggcttcaccagtggattaatgaggactgctccacaccatgctccggctcgtggctaagggatgtttgggactggatatgcacggtgctgtctgacttcaagacctggctcaagtccaagctcatgccgcagctaccgggagtccctttcttctcgtgccaacgcgggtacaagggagtctggcgggaggatggcatcatgcagaccacctgcccatgtggagcacagatcaccggacacgtcaaaaatggttccatgaggatcgttgggcctagaacctgcagcaacacgtggcatggaacattccccatcaacgcatacaccacgggcccttgcacaccctccccggcgccgaactattccagggggttgtggcgggtggctgctgaggagtacgtggaggttacgcgagtgggggatttccactacgtgacgggcatgaccaccgacaacgtgaagtgcccgtgccaggttccggcccctgaattcttcacggaagtggatggggtgcggttgcacaggtacgctccggcgtgcaaacctctcctacgggatgaggtcacattccaggtcgggctcaaccaatacctggttgggtcacagcttccatgcgagcccgaaccggatgttacagtgctcacctccatgctcaccgacccctcccacatcacagcagagacggccaagcgtaggctggccagggggtctcccccctctctggccagctcttcagctagccagttgtctgcgccttccttgaaggcgacatgcactacccatcatgactccccagagcctgacctcattgaggccaacctcttgtggcggcaagagatgggcggaaatatcacccgcgtggagtcagaaaacaaggtagtaattttggactctttcgacccgcttcgtgcggaggaggatgagagggaagtatccgttgcggcggagatcctgcggaaatccaggaagttccctccggcgctgcccgtatgggcacggccggattacaaccctccactgctagagccttggaagagcccggactacgtccctccggtggtacacgggtgcccactaccgcctaccaaggcccccccaataccacctccacggagaaagaggacggttgtcttgacggactccaccgtgtcttctgccttggcggagctcgctactaagaccttcggcagctccggatcgtctgccgccgacagcggcacggcgaccgcccctcctggccaggcctccgacgacggtgacaaggaatccgacgttgagtcatactcctccatgcccccccttgagggagagccgggggaccccgatctcagcgacgggtcttggtctaccatgagcgaggaggctggtgaggacgttgtctgctgctcaatgtcctacacatggacaggcgccctaatcacgccgtgcgctgcggaggaaagcaagctgcccatcaatccgctgagcaactccttgctgcgtcaccacaatatggtctacgccacaacatcccgtagcgcaagcctgcggcagaaaaaggtcacctttgacaggctgcaagtcctggacgaccactaccgggacgtgctcaaggagatgaaggcgaaggcgtccacagttaaggctaaacttctatccatagaagaagcctgcaagctgacgcccccacattcggccagatccaaatatggctatggggcaaaggacgtccggaacctatccagcaaggccatcaaccacatccgctccgtgtgggaggatttgctggaagacaatgagacaccaattgacaccaccatcatggcgaaaagtgaggttttctgcgtccaaccagaaaaaggaggccgcaaaccagctcgccttatcgtgttcccagacctgggggttcgtgtatgcgagaaaatggccctctacgacgtggtctccacccttcctcaggccgtgatgggttcctcatacggattccaatactctcctaagcagcgggtcgagttcctggtaaatacctggaaatcaaagaaaagccctatgggcttctcatatgacacccgctgttttgactcaacggtcactgagaatgacatccgaactgaggagtcaatttaccaatgttgtgacttggcccccgaagccaaaaaggctataaagtcgctcacagagcggctctatattgggggtcccctgactaactcaaaagggcagaactgcggttatcgccggtgccgcgcgagcggcgtgctgacgactagctgcggtaacacccttacatgttttttgaaagcctctgcggcctgtcgagctgcgaagctccaggactgcacaatgctcgtgaacggagacgaccttgtcgttatctgtgaaagcgcgggaacccaagaggatgcggcgagcctacgagccttcacggaggccatgactaggtactctgccccccccggggacccgcctcaaccagaatacgacttggagttgataacatcatgctcctccaatgtgtcggtcgcacacgatgcatctggcaaaagggtgtactacctcacccgcgaccccaccactcccctcgcacgagctgcgtgggagacagctagacacactccagttaactcctggctgggcaatatcatcatgtatgcgcccaccttatgggcaaggatgattctgatgactcacttcttctccatccttctagctcaggagcaacttgaaaaagccctggattgtcagatctacggggcttgttactccattgaaccacttgacctacctcagatcattgagcgactccatggtcttagcgcattttcactccatagttactctccaggtgagatcaatagggtggccgcatgcctcaggaaacttggggttccacccttgcgagtctggagacatcgggccagaagtgtccgcgctaggttgctgtcccagggggggagggccgccacttgtggcaagtacctcttcaactgggcagtaaggaccaagcttaaactcactccaatcccggctgcgtcccggttggacttgtccggctggttcgtcgctggttacagcgggggagacatatatcacagcctgtctcgtgcccgaccccgctggttcatgtggtgcctactcctactctctgtgggggtaggcatctacctgctccccaaccggtgaa

SEQ ID NO: 596 - DNA, 9598 bp, Hepatitis C Virus
atagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacaaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccaacccgagggcagggcctgggctcagcccgggtacccttggcccctctatggcaatgagggcatggggtgggcaggatggctcctgtcaccccgtggctctcggcctaattggggccccacggacccccggcgtaggtcgcgtaatttgggtaaggtcatcgataccctcacatgcggcttcgccgacctcatggggtacattccgctcgtcggcgcccccctaggaggcgctgccagggccctggcgcatggcgtccgggtcctggaggacggcgtgaactatgcaacagggaacttgcccggttgctctttctctatcttcctcttggctctgctgtcctgtttaaccatcccagtttccgcttatgaggtgcgcaatgtgtccggagtgtaccatgtcacgaacgactgctccaactcaagcattgtgtatgaggcagcggacatgatcttgcacacccccggatgcgtgccctgcgttcgggagaacaactcctcccgctgctgggtagcgctcactcccacgcttgcggccaagaatgccagcgtccccactacgacaatgcggcgtcacgtcgatttgctcgttggggcggctgccttctgttccgctatgtacatgggggatctctgcggatctgttttcctcgtctctcagctgttcaccatctcgcctcgccggcatgagacagtacaggactgcaattgctcaatctatctcggccacataacaggtcatcgtatggcttgggatatgatgatgaactggtcgcctacaacagccctagtcgtatcacaattgctccggatcccacaagctgtcgtggacatggtggcgggggcccactggggagtcctggcgggccttgcctactattccatggcggggaactgggctaaggttttgattgtgatgctactctttgccggtgtcgatgggaccacccacgtgacagggggggaaaccgcccgggtcacccgcgggtttacgtccttctttacacttggagcatctcagaagatccagcttataaacaccaatggcagctggcacatcaacaggactgccctgaactgtaatgactccctccagactgggttccttgccgcgctgttctacgcccacaggttcaacgcgtccggatgcccggagcgcatggccagctgccgctccattgacaagttcgatcaggggtggggtcccatcacttacgccgggaatcacagctcggaccagaggccctactgctggcactacgcgcctcgacggtgtggtgttgtacccgcgtcgcaggtgtgtggtccagtgtattgcttcaccccaagccctgttgtggtggggacgaccgatcgtttcggcgcccccacgtataactggggggagaacgagacggacgtactaatcctcaacaacacgcggccgccgcagggcaactggttcggctgtacatggatgaatagcactgggttcaccaagacgtgcggggcccccccatgtaacatcgggggggtcggcaacaacaccctgatttgccctacggactgcttccggaagcaccccgaggccacttacacaaaatgcggttcggggccttggttgacacctaggtgcttagttgactatccatacaggctttggcactacccctgcaccgtcaattttaccatcttcaaggtcaggatgtatgtggggggcgtggagcataggctcagcgctgcatgcaattggactcgaggagagcggtgtaacttggaggacagggacagatcagagcttagcccgttgctgctgtcaacgacggagtggcaggtactgccctgttccttcaccaccctaccggctctgtccactggtttgatccatctccatcagaacatcgtggatgtgcaatacctgtacggtatagggtcagcggttgtctccttcgcaatcaaatgggagtatgtcctgctgcttttccttctcttggcggacgcgcgcgtctgtgcctgcttgtggatgatgctgctgatagcccaggctgaggccgccttagagaacctggtggtcctcaatgcagcgtccgtggccggagcccatggcatttcctccttcctcgtgttcttctgtgctgcctggtacatcaaaggtaggctggtccctggggcggcatatgctttctatggcgtgtggccgctactcctgctcctgctggcgctaccgccacgggcgtacgccatggaccgggagatggctgcatcgtgcggaggcgcggtattcgtaggtctggtactcctgaccttgtcaccatactacaaagtgttcctcgctaggctcatatggtggttacaatacttcatcaccagagccgaggcgcatttgcatgtgtggatccctcccctcaacgttcgggggggacgcgatgccatcatcctcctcacgtgtgcggtccacccagagctaatttttgacatcaccaaaatcttgctcgccatattcggtccgcccatggtgctccaggctgtcataattaaggtgccgtactttgtgcgtgcccaagggctcattcgtgcatgcatgttggtgcggaaggttgctgggggccattatgtccaaatggctttcatgaaactggccgcgctgacaggtacgtacgtctatgaccatctcactccactgcaagactgggcccacgcgggcctacgagaccttgcggtggcagttgagcccgttgtcttctctgacatggagactaagatcatcacctggggggcagacactgcggcgtgtggggacatcatctcgggtctacccgtctccgcccgaaggggaagggagatactcctgggaccggccgacagctttgaagggcaggggtggcgactccttgctcctatcacagcctactcccaacagacgcggggcttgctcggctgcatcgtcaccagcctcacaggccgggacaagaaccaggtcgagggggaggttcaagtggtctccaccgcaacacaatctttcctggcgacctgcgtcaacggcgtgtgctggactgttttccatggcgccggctcaaaaaccttagccggcccaaagggcccaatcacccaaatgtacaccaatgtagaccaggacctcgttggctggccagcgccccctggggcgcggtcgttgacaccgtgcacttgcggcagctcggacctttacttggtcacgagacatgctgatgtcattccggtgcgccggcggggcgacaccagggggagcctactctcccccaggcccgtctcctacttgaagggctcttcgggcggtccgctgctctgtccctcggggcacattgtgggcgtcttccgggctgctgtatgcacccggggggttgcgaaggcggtggacttcatacctgttgagtctatggaaactaccatgcggtccccggtctttacggacaactcgtcccctccggctgtaccgcagacataccaagtggcccatctacacgctcccactggcagcggcaagagcactaaagtgccggctgcatacgcagcccaagggtacaaggtacttgtcctgaatccgtccgttgccgccactctgggttttggggcgtatatgtctaaggcacatggtgtcgaccctaacattagaactggggtaaggaccatcaccacgggcgcttccatcacgtattccacctatggcaagttccttgccgacggtggttgctccgggggcgcctatgacatcataatgtgtgatgagtgccactcaactgactcgacttccatcttgggcatcggcacagtcctggatcaagcggagacggctggagcgcggctcgtcgtgctcgccaccgctacacctccgggatcggttaccgtgccacatcctaatatcgaggaggtagccctgtccaacactggagagattcccttctacggtaaagccatccccatcgagaccatcaagggggggaggcatctcatcttctgccactccaagaagaagtgtgacgagcttgctgcaaagctgtcgagcctcggaatcaatgccgtagcgtattaccggggtctcgatgtgtccgtcataccggctagcgggaacgtcgtcgtcgtggcaacggacgccctaatgacgggctttaccggtgactttgactcggtgatcgactgtaatacatgtgtcacccagacagtcgacttcagcttggatcccaccttcaccattgagacgacaactgtgccccaagacgcagtgtcgcgctcacagcggcggggtaggactggtaggggtaggagaggcatctacaggtttgtgactccaggagaacggccctcgggcatgttcgattcctcggtcctgtgtgagtgctatgacgcgggctgtgcttggtacgagctcacgcccgccgagaccacggttaggttgcgggcttacctaaatacaccagggttgcccgtctgccaggaccatctggagttctgggagggcgtcttcacaggcctcacccacatagatgcccatttcttgtcccaaaccaagcaggcaggagagaacttcccctacctggtggcataccaagccacagtgtgcgccagggcacaagccccgcctccatcatgggatcaaatgtggaagtgcctcatacggctgaagcctacgctacacgggccaacacccctgttgtataggctaggggccgtccaaaatgaggtcaccctcacacaccccataaccaaatatatcatggcatgcatgtcggctgacttggaggtcgtcacgagtacctgggtactggtaggcggagtccttgcggctctggccgcgtattgcctgacaacaggcagcgtggtcattgtgggcagaatcatcttgtccgggaagccggccgtcattcctgacagagaagttctctaccgggagttcgatgagatggaagagtgcgcctcacatctcccctacatcgaacagggaatgcagctcgccgagcaattcaagcagaaagcgctcgggttgctgcaaacagctaccaagcaagcagaggctgctgcacccgtggtggagtccaagtggcaagccctggaagctttctgggcgaagcacatgtggaatttcatcagcgggatacagtacttagcaggcttgtccactctgcctgggaatcccgcaatagcatcattgatggcattcacggcttccatcaccagcccgctcactacccaaagcaccctcctgtttaacatcttgggaggatgggtggccgcccaactcgctccccccagcgctgcctcagctttcgtgggcgccggcatcgctggtgcggccgtcggcagcataggccttgggaaggtgcttgtggacattctagcgggctatggagcaggagtggcgggcgcactcgtggcctttaaggtcatgagcggcgacatgccctccaccgaggacctggttaacctactccctgccatcctctctcctggcgccctggtcgtcggggttgtgtgcgcagcgatactgcgtcggcatgtgggcccgggagagggggctgtccagtggatgaaccggctgatagcgttcgcctcgcggggtaatcacgtctcccccacgcactatgtgcctgagagcgacgccgcagcgcgtgtcactcagatcctctccagccttaccatcactcagctgttgaagaggctccatcagtggattaatgaggactgctccacaccatgttccggctcgtggttaagggatgtttgggactggatatgcacggtgttgactgatttcaagacctggctccagtccaagctcctgccgcggttgccgggagttcctttcttctcatgccaacgtgggtacaggggagtctggcggggagacggcatcatgcagaccacctgcccatgtggagcacagatcaccggacatgtcaagaacggttccatgaggatcgttgggcctaaaacctgcagcaacacgtggcatggaacatttcccatcaacgcgcacaccacgggcccctgcacaccctcccctgcgccaaactattccagggcgctatggcgggtggctgctgaggagtacgtggaggttacgcgggtgggggatttccactacgtgacgggcatgaccactgacaacgtaaagtgcccttgccaggttccggcccccgaattcttcacagaagtggatggggtgcggctgcacagatacgctccggtgtgcaaacctctcctgcgggatgaggtcacattccaggtcgggctcaaccaatacctggtcgggtcacagctcccatgcgagcccgaaccggacgtaacagtgctcacttccctgctcaccgacccctctcatattacagcagagacggccaggcgtaggctggccagggggtctcccccctccttggccagctcttcggccagccagttgtctgcgccttctctgaaggcaacatgcactactcatcatgactccccagacgctgacctcatcgaggccaacctcctgtggcggcaggagatgggcgggaacatcacccgcgtggagtcagagaataaggtaataattctggactctttcgagccgtgtcgagcggaggaggacgagagggaggtgtccgttgcggcggagatcctgcgaagatccaggaggttcccctcggcgttgcccatatgggcgcgcccggattacaaccctccattattagagtcctggaagaacccggactacgtccctccggtggtacacgggtgtccattgccgcctaccaaggcccctccagtgccacctccacggagaaagaggacggttgtcctgacagagtccaccgtgtcttctgccttggcggagctcgctacaaagaccttcggcagctccgaatcgtcggccgtcgacagcggcacagcgtccgcctcccctgaccagccctccaatgacggtgacgcaggatccgacgttgagtcgtattcctccatgcccccccttgagggggagccgggggatcccgacctcagcgacgggtcttggtctaccgtgagcgaggaggccagtgaagacgttgtctgctgctcaatgtcctacacatggacaggtgccctgatcacaccatgcgctgcggaggaaagcaagctgcccatcaatgcgttgagcaactctttgctgcgtcaccacaatatggtctatgccacaacatcccgcagcgcaagccaacggcagaagaaggtcacatttgacagactgcaagtcctggacgaccactaccgggacgtgctcaaggagatgaaggcgaaggcgtccacagttaaggctagacttctatccgtggaagaagcctgcaagctgacgcccccacattcggccaaatccaaatttggctatggggcaaaggacgtccggaacctgtccagcaaggccgttaaccacatccgctccgtgtggaaggacttgctggaagacactgagacaccacttgacaccaccatcatggcaaaaaatgaggttttctgcgtccaaccagagaaaggaggccgcaagccagctcgccttatcgtgttcccagacttgggggttcgtgtgtgcgagaaaatggctctttatgacgtggtctccacccttcctcaggccgtgatgggcccctcatacggattccagtactctcctgggcagcgggtcgagttcctggtgaatgcctggaaatcaaagaaatgccctatgggcttcgcgtatgacacccgctgttttgactcaacggtcaccgagagtgacatccgtgttgaggagtcaatttatcaaagttgtgacttggcccccgaagccagacaggccataaggtcgctcacagagcggctttacatcgggggtcccctgactaattcaaaagggcagaactgcggctatcgccggtgccgcgcgagcggcgtgctgacgaccagctgcggtaataccctcacatgttacttgaaagcctctgcggcctgtcgagctgcgaagctccaggactgcacgatgctcgtgtgcggagacgacctcgtcgttatctgtgaaagcgcggggacccaagaggatgcggcgagcctacgagtcttcacggaggctatgactaggtactctgccccccccggggacccgccccaaccagaatacgacttggagttgataacatcatgctcctccaatgtgtcggtcgcgcacgatgcgtctggcaaaagggtgtactatctcacccgtgaccccaccaccccccttgcgcgggctgcgtgggagacagctagaagcactccagtcaactcctggctaggcaacatcatcatgtatgcgcccaccttatgggcaaggatgattctgatgacccacttcttctccatccttctagcccaggagcaacttgaaaaggccctagattgtcagatctacggagcctgttactccattgagccacttgacctacctcagatcattcagcgactccatggtcttagcgcattttcactccatagttactctccaggtgagatcaatagggtggcttcatgcctcaggaaacttggggtaccgcccttgcgagtctggagacaccgggccagaagtgtccgcgctaagctactgtcccagggggggagggctgccacttgtggcaggtacctcttcaactgggcagtaaagaccaaacttaaactcactccaatcccggctgcgtcccagttggacttgtccaactggttcgttgctggttacagcgggggagacatatatcacagcctgtctcgtgcccggccccgctggttcatgttgtgcctactcctactttctgtaggggtaggcatctacctgctccccaaccggtgaacggggagctaaacactccaggccaataggccatcccctttgttttttttttttttttttttttttttttttttttttttttttttttttttttttttttttttttttttttttttttttttttttttttttttttttttttatttctccttcttttggtggctccatcttagccctagtcacggctagctgtgaaaggtccgtgagccgcatgactgcagagagtgctgatactggcctctctgcagatcatgt

SEQ ID NO: 597 - DNA, 9587 bp, Hepatitis C Virus
gccagcccccgattgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggattaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgttaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggcaggacctgggcccagcccgggtacccttggcccctctatggtgacgagggcatggggtgggcaggatggctcctgtcaccccgtggctctcggcctaattggggccccacagacccccggcgtaggtcgcgtaatttgggtaaggtcatcgataccctcacatgcggcttcgccgacctcatggggtacattccgcttgtcggcgcccctctaggaggcgttgccagggccctggcgcatggcgtccgggttctggaggacggcgtgaattatgcaacagggaatttgcccggttgctctttctctatcttcctcttggctctgctgtcttgcttgactaccccagcttccgcttatgaagtgcgcaacgtgtccgggatataccatgtcacgaacgactgctccaactcaagcattgtgtatgaggcagcggacatcatcatgcatacccccgggtgcgtgccctgcgttcgggagaagaacacctcccgttgctgggtagcgctcactcccacgctcgcagccaggaacatcagcgtccccactacgacaatacgacgccatgtcgacttgctcgttgggacggctgctttctgctctgctatgtacgtgggggatctctgcggatctgttttcctcgtctcccagctgttcaccttctcacctcgccggcatgaaacagtacaggactgcaattgctcactctatcctggccacgtatcaggtcaccgtatggcttgggacatgatgatgaactggtcgcctacagcagctctagtggtgtcgcagttgctccggatcccacaagctatcgtggatatggtggcgggggcccactggggagtcctggcgggccttgcctactattccatggtggggaactgggccaaggttttgattgtgatgctgctctttgccggcgctgacgggaccacccacgtgacagggggggtgcaagcccacggtgcttacgggcttgcatccctctttaacgttgggccccatcagaaaatccagcttgtaaatacaaatggcagctggcacatcaacaggactgccttaaactgcaatgacaccctccagaccggattccttgccgcgctgttctacaaacacaggttcaacgcgtccggatgcccagagcgtatggccagctgccgtcccattgacaagttcgctcagggatggggtcccatcacttatgctgagcctgacaggctggaccagaggccttattgctggcactacccaccccgaccgtgtggtatcgtacccgcgttggaggtgtgtggtccagtgtattgcttcaccccaagccctgttgtggtggggacgaccgatcgtttcggcgtccctacctatagctggggggagaatgagacggatgtgctgctcctcaacaacacgcggcctccgcaaggcaattggttcggctgtacgtggatgaataacaccgggttcaccaagacgtgtgggggccctccgtgtaacatcgggggggtcggcaacaacaccttgacctgccccacggattgcttccggaagcaccccgaggctacttacacaaaatgtggttcagggccttggttgacacctaggtgcttagttgactacccctataggctctggcactacccctgcactgtcaactttaccgtcttcaaggtcaggatgtatgtggggggcattgagcacaggctcgatgctgcatgcaattggactcgaggagagcgctgtgacttggaggacagggatagatcagaactcagcccgctgttgctgtctacaacagagtggcagatactgccctgttccttcaccaccctaccggccctgtccactggtttaatccatctccaccggaacatcgtggacgtgcagtatctgtacggcataggatcagcggttgtctcctttgcaatcaaatgggaatacatcctgttgcttttccttctcctggcggacgcgcgcgtctgtgcctgcttgtggatgatgctgctgatagcccaggctgaggccgccttagagaacttggtggtcctcaatgcggcgtccgtggccggagcgcatggtatcctctccttccttgtgttcttctgcgccgcctggtgtattaagggtaagctggtccctggggcggcgtatgctttctatggcgtatggccgctgcttctgctcctgttggcgttgccgccacgtgcttacgccatggaccgggagatggctgcatcatgtggaggcgcagtttttgtaggattggcattcttgactttgtcgccatactataaagtgttcctcgctaggctcatatggtggttacaataccttatcaccagagccgaggcgcacttgcagatgtgggtccctcctcttaatatccgggggggccgcgatgccatcatcctcctcatgtgcgcggtccacccagagctaatctttgacatcaccaaactcctgcttgccatacttggtccgctcatggtgctccaggccggcataactagagtgccgtacttcgtacgcgctcaagggctcattcgtgcatgcatgttggtgcggaaagccgccgggggtcattatgtccaaatggccttcgtgaagctggccgcactgacaggcacgtacgtttatgaccatcttgccccactgcaacattgggcccacacgggcctacgagaccttgcggtggcagtagagcccgttgtcttctctgacatggaaaccaagatcatcacctggggggcagataccgcggcatgtggggacatcatcttgggtctacccgtctccgcccggaggggaagggagatactcctgggaccagccgatagtcttgaggggcaggggtggcgactcctcgcgcccatcacggcttactcccaacagacgcggggcctactcggttgcatcatcaccagcctcacaggtcgggacaagaaccaggttgagggggaggttcaagtggtttccaccgctacacaatctttcctggcgacctgcatcaatggcgtgtgttggactgttttccacggtgccggctcaaagaccctagccggcccaaaaggtccaatcacccaaatgtacaccaatgtagaccaggacctcgtcggctggcaggcgccccccggggcacgttccatgacaccatgcacctgcggcagctcggacctttacttggtcacgagacatgctgatgtcatcccggtgcgccgacggggcgacggtagggggagccttctctcccccaggcccgtctcctacttgaagggctcttcgggtggtccgctgctctgcccttcggggcatgccgtgggcatcttccgggccgctgtgtgcacccggggggtcgcgaaggcggtggacttcatacccgtcgagtctatggaaaccactatgcggtctccagtcttcacagacaactcatcccccccggctgtaccgcagacatttcaagtggctcatctgcacgcccccactggcagcggcaagagcactaaagtgccggctgcatatgcagcccaagggtacaaggtacttgtcctgaacccgtccgttgctgccaccttaggttttggggcgtatatgtctaaggcatatggtaccgaccccaacatcagaactggggtaaggaccatcaccacgggcgctcccatcacgtattccacctatggcaagttcctcgccgacggtggttgctccgggggtgcctacgacatcataatatgtgatgagtgccactcaactgactcgactaccatcttgggcatcggcacagtcctggatcaagcggagacggctggagcgcggctcgtcgtgctcgccaccgctacgcctccaggatcggtcaccgtgccgcaccccaatatcgaggaggtggccctgtccaacactggagagatccccttctatggcaaagccatccccatcgaggtcatcaaagggggaaggcatctcattttctgccactccaagaaaaagtgcgacgagctcgccgcaaagctgtcgtccctcggactcaatgctgtagcgtattaccggggtcttgatgtgtccgtcataccgactagcggagatgtcgttgtcgtggcaacggacgctctaatgacgggctttaccggcgacttcgactcagtgatcgactgtaatacatgtgtcactcagacagtcgacttcagcttggatcccaccttcaccattgaaacgacgaccgtgccccaagacgcggtatcgcgctcacagcggcgaggtaggactggcaggggtaggggaggcatctacaggtttgtgactccaggggaacggccctcgggcatgttcgattcctcggtcctgtgtgagtgctatgacgcgggctgtgcgtggtacgagctcacgcccgccgagacctcgattaggttgcgggcgtacctaaatacaccagggttgcccgtctgccaggaccatctggagttctgggagagtgtcttcacaggcctcacccatatagatgcccacttcttgtcccagactaagcaggcaggagacaacttcccctacctggtggcataccaggctacagtgtgcgccagggctcaggctccacctccatcgtgggatcaaatgtggaagtgtctcacacggctaaaacctacactgcacgggccaacacccttgctgtataggctaggagccgtccaaaatgaggtcaccctcacacaccccataaccaaatacatcatggcatgcatgtcggctgacctggaggtcgtcaccagcacttgggtgctggtaggcggagtccttgcagctctggccgcgtattgcctgacaacaggcagcgtagtcattgtgggcaggatcatcttgtccgggaagccggccgtcattcccgacagggaagttctttaccgggagttcgatgagatggaagagtgcgcctcacacctcccttacatcgaacagggaatgcagctcgccgaacaattcaaacagaaggcgctcgggttgctgcaaacagccaccaagcaagcggaggctgctgctcccgtggtggagtccaagtggcgcgctcttgagaccttctgggcgaagcacatgtggaatttcatcagcgggatacagtatttagcaggcttatccactctgcctgggaaccccgcgatagcatcactgatggcatttacagcctctatcaccagcccgctcaccacccaaagtaccctcctgtttaacatcttggggggatgggtggctgcccaactcgctccccccagcgctgcttctgcttttgtgggcgccggcgttgccggtgcggctgttggcagcataggcctcgggaaggtgcttgtggacatcctggcgggctatggggcaggggtggctggcgcactcgtagcttttaagatcatgagcggcgagatgccctccaccgaggacctggtcaatttacttcctgccatcctctctcctggtgccctggttgtcggggtcgtgtgcgcagcaatactgcgccggcacgtgggcccaggagagggggctgtgcagtggatgaaccggctgatagcgttcgcttctcggggtaaccacgtctcccccacgcactatgtgcctgagagcgacgccgcagcgcgtgttactcagatcctctccagccttaccatcactcagctgctgaagagacttcaccagtggatcaatgaggactgttccacgccatgctccggctcgtggctaagggatatttgggactggatatgcacggtattggctgactttaagacctggctcaagtccaagctcatgccgcaattaccgggagtccctttcttctcttgccaacgcggctacaagggagtctggcggggggacggtatcatgcagaccacctgcccatgtggagcacagatcaccggacatgtcaagaacggttccatgaggatcgctgggcctaaaacctgcagcaacacgtggcatggaacattccccatcaacgcgtacaccacgggcccctgcacaccctccccggcgccaaactattccagggcgctgtggcgggtggctgctgaggagtacgtggaggttacgcgggtgggggatttccactacgtgacgggcatgaccactgacaacgtgaagtgtccatgccaggttccggcccccgaattcttcacggaagtggatggagtgcagttgcacaggtacgctccggcgtgtaaacctctcctacgggatgaggtcacattccaggtcgggctcaaccaatacctggttgggtcgcagctcccatgcgagcccgaaccggatgtagcagtgctcacttccatgctcaccgatccttcccacattacagcagagacggccaagcgtaggttggccagggggtctcccccctccctggccagctcttcagctagccagttgtctgcgccttccttgaaggctacatgtactacccaccatgactccccggacgctgacctcatcgaggccaacctcttgtggcggcaagagatgggcgggaacatcacccgcgtggagtcagagaacaaggtagtaattctggactctttcgacccgcttcgagcggaggaggatgagagggaggtatccgttgcggcggagatcctgcggaaatccaggaagttcccccctgcgctgcccgtatgggcacgcccggattataatcctccactgctagagccctggaaggacccggactatgttcctccggtggtacacgggtgcccattgccgcctaccaaggcacccccaataccacccccacggagaaagaggacggttgccctgacagagtccaccgtgtcttctgccttggcggagctcgctactaagaccttcggcagctccggatcgtcggccgccgacagcggcacggcgactgcccctcctgaccaggcctccgacgacggcgacaagggatccgacgttgagtcatactcctccatgcccccccttgagggagagccgggggaccctgatcttagcgacgggtcttggtctaccgtgagcgaggaggctagtgaggacgtcgtctgctgctcaatgtcctactcatggacaggtgccctgatcacgccatgcgctgcggaggaaagcaagctgcccatcaacccgttgagcaactccctgctgcgtcaccacaatatggtctacgccacaacatcccgtagcgcaggcctgcggcagaagaaggtcacctttgacaggctgcaagtcctggacgatcattaccgggacgtgctcaaggagatgaaggcgaaggcgtccacagttaaggctaagcttctatctatagaagaagcctgcaaactgacgcccccacactcggccaaatccaaatatggctatggggcaaaggacgtccggaacctatccagcagggccgtcaaccacatccgctccgtgtgggaggacttgctggaagacactgagacaccaattgacactaccatcatggcaaagagtgaggttttctgtgtccagccagagaaaggaggccgcaagccagctcgccttatcgtattcccagacctgggagttcgtgtgtgcgagaagatggccctctacgatgtggtctccactcttcctcaggccgtgatgggctcctcatacgggttccagtactctcctaaacagcgggttgaattcctggtgaacacctggaaatcaaagaaatgccctatgggcttctcatatgacacccgctgttttgactcaacggtcactgagaatgacatccgtgttgaggagtcaatttaccaatgctgtgacttggcccccgaagccaaactggccataaagtcgctcacagagcggctctatgttgggggtcccctgactaattcaaaagggcagaactgcggttatcgccggtgccgcgcgagcggcgtgctgacgactagctgcggtaataccctcacatgttatctgaaagcctctgcggcctgtcgagctgcaaagctccaggactgcacgatgctcgtgaacggagacgaccttgtcgttatctgtgaaagcgcgggaacccaagaggatgcggcgagcctacgagtcttcacggaggctatgactaggtattctgccccccccggggacccgcctcaaccagaatacgacttggagttgataacatcatgttcctccaatgtgtcggtcgcacacgatgcatctggtaaaagggtgtactacctcacccgtgaccccaccaccccccttgcgcgggctgcgtgggagacagctagacacactccagtcaactcctggctaggcaatatcatcatgtatgcgcctaccttatgggcaaggatgattctgatgacccacttcttctccatccttctagctcaggagcagcttgaaaaagccctggattgccagatctacggggcctgttactccattgagccacttgacctacctcagatcattgagcggctccatggtcttagcgcattttcactccatagttactctccaggtgagatcaatagggtggcttcatgcctcaggaaacttggggtcccacccttgcgagtctggagacatcgggccagaagtgtccgcgctaagttactgtcccagggggggagggccgccacttgtggcaagtacctcttcaactgggcagtaaagaccaagcttaaactcactccaattccggctgcgtcccggttggacttgtccggctggttcgtcgccggttacagcgggggagacatatatcacagcctgtctcgcgcccgaccccgctggttcatgtggtgcctactcctactttccgtaggggtaggcatctacctgctccccaaccggtgaacggggagctaaacactccaggccaataggccattcctttttttttttttttttttttttttctttttttttccttttttttttttttttttttttttccttttctttcttctttggtggctccatcttagccctagtcacggctagctgtgaaaggtccgtgagccgcatgactgcagagagtgctgatactggcctctctgcagatcatgt

SEQ ID NO: 598 - DNA, 9658 bp, Hepatitis C Virus
gccagcccccgattgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaagggcgcgccatggaagacgccaaaaacataaagaaaggcccggcgccattctatccgctggaagatggaaccgctggagagcaactgcataaggctatgaagagatacgccctggttcctggaacaattgcttttacagatgcacatatcgaggtggacatcacttacgctgagtacttcgaaatgtccgttcggttggcagaagctatgaaacgatatgggctgaatacaaatcacagaatcgtcgtatgcagtgaaaactctcttcaattctttatgccggtgttgggcgcgttatttatcggagttgcagttgcgcccgcgaacgacatttataatgaacgtgaattgctcaacagtatgggcatttcgcagcctaccgtggtgttcgtttccaaaaaggggttgcaaaaaattttgaacgtgcaaaaaaagctcccaatcatccaaaaaattattatcatggattctaaaacggattaccagggatttcagtcgatgtacacgttcgtcacatctcatctacctcccggttttaatgaatacgattttgtgccagagtccttcgatagggacaagacaattgcactgatcatgaactcctctggatctactggtctgcctaaaggtgtcgctctgcctcatagaactgcctgcgtgagattctcgcatgccagagatcctatttttggcaatcaaatcattccggatactgcgattttaagtgttgttccattccatcacggttttggaatgtttactacactcggatatttgatatgtggatttcgagtcgtcttaatgtatagatttgaagaagagctgtttctgaggagccttcaggattacaagattcaaagtgcgctgctggtgccaaccctattctccttcttcgccaaaagcactctgattgacaaatacgatttatctaatttacacgaaattgcttctggtggcgctcccctctctaaggaagtcggggaagcggttgccaagaggttccatctgccaggtatcaggcaaggatatgggctcactgagactacatcagctattctgattacacccgagggggatgataaaccgggcgcggtcggtaaagttgttccattttttgaagcgaaggttgtggatctggataccgggaaaacgctgggcgttaatcaaagaggcgaactgtgtgtgagaggtcctatgattatgtccggttatgtaaacaatccggaagcgaccaacgccttgattgacaaggatggatggctacattctggagacatagcttactgggacgaagacgaacacttcttcatcgttgaccgcctgaagtctctgattaagtacaaaggctatcaggtggctcccgctgaattggaatccatcttgctccaacaccccaacatcttcgacgcaggtgtcgcaggtcttcccgacgatgacgccggtgaacttcccgccgccgttgttgttttggagcacggaaagacgatgacggaaaaagagatcgtggattacgtcgccagtcaagtaacaaccgcgaaaaagttgcgcggaggagttgtgtttgtggacgaagtaccgaaaggtcttaccggaaaactcgacgcaagaaaaatcagagagatcctcataaaggccaagaagggcggaaagatcgccgtgcggcgcgccatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagtttaaacagaccacaacggtttccctctagcgggatcaattccgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgataataccatggcgcctattacggcctactcccaacagacgcgaggcctacttggctgcatcatcactagcctcacaggccgggacaggaaccaggtcgagggggaggtccaagtggtctccaccgcaacacaatctttcctggcgacctgcgtcaatggcgtgtgttggactgtctatcatggtgccggctcaaagacccttgccggcccaaagggcccaatcacccaaatgtacactaatgtagaccaggatctcgtcggctggccggcgccccccggggcgcgttccctgacaccatgcacctgtggcagctcggacctttacttggttacgagacatgcagatgttattccggtgcgccggcggggcgacaatagagggagcttgctctcccccaggcctgtctcctacttgaagggctcttcgggtggcccactgctctgcccttcggggcacgctgtgggcgtcttccgggccgctgtatgcacccggggggttgcaaaggcggtggattttgtccccgttgagtccatggaaactactatgcggtccccggtcttcacagacaactcatctcccccggccgtaccgcaaacattccaagtggcccatctacacgctcccactggcagcggcaagagcactagagtgccggccgcatatgcggcccaagggtacaaggtgcttgtcctgaacccgtctgttgccgctaccttaggttttggggcgtatatgtctaaagcacatggtaccgaccctaacatcaggactggggtaaggaccattaccacgggcgcccccattacgtactccacctatggcaagttccttgccgacggtggttgctccgggggcgcttacgacatcataatgtgcgatgagtgccactcaactgactcaactactatcttgggcatcggcacagtcctggaccaagcggagacggctggagcgcggcttgtcgtgctcgccaccgctacgcctccaggatcggtcaccgtgccacaccccaatatcgaggaggtggccctgtcgaacactggagagatccccttctacggcaaagccatccccatcgaagccatcaaggggggaaggcacctcattttctgtcactccaagaagaagtgcgacgagcttgccgcaaagctgtcaggcctcggaatcaatgctgtagcgtattaccggggtcttgatgtgtccgtcataccgaccagcggagacgtcgttgtcgtggcaacagacgctctaatgacgggctataccggtgactttgattcagtgatcgactgtaatacgtgtgtcacccagacagtcgacttcagcttggaccccaccttcaccattgagacgacgaccgtgccccaagacgcagtgtcgcgctcgcagcggcggggtaggactggcaggggcagggggggcatatacaggtttgtaactccgggggaacggccctcgggcatgttcgattcctcggtcctgtgcgagtgctatgacgcgggctgtgcttggtacgagctcacccccgctgagacctcggttaggttgcgggcttacctaaatacaccaggattgcccgtttgccaggaccatctggagttctgggagagcgtcttcacaggcctcacccatatagatgcccacttcctgtcccagaccaagcaggcaggagataacttcccctacctggtggcataccaagccacagtgtgcgccagggctcaggccccacctccatcgtgggatcaaatgtggaagtgtctcatacggctaaaacccacgctgcacgggccaacgcccctgctgtataggctaggggccgtccaaaatgaggtcaccctcacacaccccataaccaaatacatcatggcatgcatgtcggccgacctggaagtcgtcaccagcacctgggtgctggtaggcggagtcctcgcagctctggccgcatattgcctgacaacaggcagtgtggttatcgtgggtaggatcatcttgtccgggaggccggctgtcgttcccgatagggaagtcctctaccgggagttcgatgaaatggaagaatgcgcctcgcacctcccttacatcgaacagggaatgcaactcgccgagcaattcaagcagaaggcgctcgggttgttgcaaacagccaccaagcaggcggaggctgccgctcccgtggtggagtccaagtggcgagctttggagaccttctgggcaaagcacaagtggaatttcatcagcgggatacagtacttagcgggcttatccaccctgcctgggaaccccgcgatagcatcactgatggcattcacagcctctatcaccagcccgctcaccacccagaacaccctcctgtttaacatcttgggggggtgggtagccgcccaactcgctccccccagcgctgcttcggctttcgtgggcgctggtatcgctggtgcggctgttggcagcataggtcttgggaaggtgctagtggacattctggcgggctatggggcaggggtggctggcgcgctcgtggccttcaaggtcatgagcggcgaggcgccctctgccgaggacctgatcaatttgctccctgccatcctctctcctggtgccctggtcgtcggagtcgtgtgtgcagcaatactgcgtcggcatgtgggcccgggagagggggccgtgcagtggatgaaccggctgatagcgttcgcttcgcggggtaaccatgtctcccccacgcactatgtgcctgagagcgacgccgcagcgcgtgtcactcaggtcctctccagccttaccatcacccagctgctgaagaggctccaccagtggattaatgaggactgttctacgccgtgttccggctcgtggctgagggatgtttgggactgggtgtgcacggtgttgagtgacttcaagacctggctccagtccaagctcctgccgcggttaccgggtgtccctttcctctcatgccaacgtgggtacaagggagtctggcggggggacggcatcatgcacaccacctgcccatgtggagcacagatcgccggacatgtcaaaaacggttccatgaggatcatcgggccgaaaacctgcagcaacacgtggcatggaacattccccatcaacgcgtacaccacgggcccctgcacgccttccccggcgccaaactattccaaggcgctgtggcgggtggctgctgaggagtacgtggaggtcacgcgggtgggggatttccactacgtgacgggcataaccaccgacaacgtaaagtgcccatgtcaggttccagctcctgagtttttcacggaggtggatggggtgcggttgcacaggtacgccccggtgtgcaaacctctcttacgggatgaggttgtattccaggtcgggctcaatcaatacctggttgggtcacagctcccatgcgagcccgaaccggacgtagcagtgctcacttccatgctcaccgacccctcccacattacagcagaggcggctaagcgtaggttggccagggggtctcccccctccttggccagctcagctagccagctgtctgcgccctccttgagggcgacatgcactacccattcttcctataatcttgactctccggacgtcgacctcattgcggccaacctcctgtggcggcaggagatgggcggaaacatcacccgcgtggagtcggagaacaaggtggtagtcctagactctttcgagccgcttcgagcggagggggatgagaatgaaatatccattgcggcggagatcctgcggaagtccaagaagttccccgcggcgatacccatatgggcacggccggattacaatcctccattgttagagtcttggaagaacccggactacgtccctccggtggtacacgggtgcccattgccacctgtcaaggcccctccaataccacctccacggagaaaaaggacggttgtcctgacggactccaccgtgtcttctgttttggcggagctcgctaccaaaaccttcggcagctccgaattgtcggccgccgacagcggcacggcgaccgcccctcctgaccagacctccgacaacggcggcaaagactccgacgctgagtcatgctcctctatgcccccccttgagggggagccgggggaccccgatctcagcgacgggtcttggtctaccgtgagcgaggaggctggtgagagcgtcgtctgctgctcaatgtcctacacatggacaggtgccctgatcacgccatgcgccgcggaagaaagcaagctgcccatcaacgcgttgagcaactctttgctgcgccatcacaacatggtctacgccacgacatcccgcagcgcgggcctgcggcagaagaaggtcacctttgacagactgcaggtcctggatgaccattaccgggacgtgcttaaggagatgaaggcaaaggcgtccacagtcaaggctaaacttctatccatagaagaagcctgccgcctgacgcccccacattcggccaaatccaagtttggctatggggcaaaggacgtccggaacctatccagcagggccatcaaccacatccgctccgtgtgggaggacttgctggaggacactgtgacaccaattgacaccaccgtcatggcaaagaatgaggttttctgcgtccaaccagagaagggaggccgcaagccagcccgccttatcgtattcccagatttgggagttcgtgtatgcgagaagatggctctctacgatgtggtctccacccttcctcaagccgtgatgggctcctcatacggattccagtactctcccgggcagcgggtcgagttcctggtaaaagcctggaaatcaaagaaaaaccctatgggcttctcatatgacacccgctgttttgactcaacggtcactgagaatgacatccgtgttgaggagtcaatttaccaatgttgtgacttggcccccgaagccagacaggctataaaatcgctcacagagcggctttatatcgggggtcccctgactaattcaaaagggcagagctgtggttatcgccggtgccgcgcgagcggcgtgctgacgactagctgcggtaataccctcacatgttacttgaaagcctctgccgcctgtcgagctgcaaagctccaggactgcacgatgctcgtgaacggggacgaccttgtcgttatctgcgaaagcgcgggaacccaggaggatgcggcgagcctacgagtcttcacggaggctatgactaggtactccgccccccccggggacttgccccaaccagaatacgacttggagttgataacatcatgttcctccaatgtgtcggtcgcgcacgatgcatctggcaaaagggtgtactacctcactcgcgatcccaccacccccatcgcacgggctgcgtgggaaacagctagacacactccagttaactcctggctaggcaacattatcatgtatgcgcccaccttatgggcaaggatgattctgatgacccatttcttctccatccttctagctcaggagcaacttgaaaaagccctggattgccaaatctacggggcctgttactccattgagccacttgacctacctcagatcattgaacgactccatggtcttagcgcattttcactccatagttactctccaggtgagatcaatagggtggcttcatgcctcaggaaacttggggtaccgcccttgcgagtctggagacatcgggccagggacgtccgcgctaaactactgtcccagggggggagggccgccacttgcggcaaatacctcttcaactgggcagtaaagaccaagctcaaactcactccaatcccggctgcgtcccagttggacttatccggctggttcgttgctggctacagcgggggagacatatatcacagcctgtctcgtgcccgaccccgctggttcatgctgtgcctactcctactttctgtaggggtaggcatctacttgctccccaatcgatgaacggggagctaaacactccaggccaataggccatttcctgtttttttttttttttggtttttttttttttttttttttttttttttttttttttttcctttccttctttttttttttttccctctttatggtggctccgtcttagccctagtcacggctagctgtgaaaggtccgtgagccgcatgactgcagagagtgctgatactggcctctctgcagatcatgtctaga

SEQ ID NO: 599 - DNA, 9359 bp, Hepatitis C Virus
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggtggtggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggcaggacctgggctcagcccgggtacccttggcccctctatggcaatgagggcatggggtgggcaggatggctcctgtcaccccgcggctctcggcctagttggggccccacggacccccggcgtaggtcgcgtaatttgggtaaggtcatcgataccctcacatgcggcttcgccgacctcatggggtacattccgctcgtcggcgcccccctagggggcgctgccagggccctggcgcatggcgtccgggttctggaggacggcgtgaactatgcaacagggaatttgcccggttgctctttctctatcttcctcttggctttgctgtcctgtttgactatcccagcttccgctatcgaagtgcgcaacgtgtccggagtgtaccatgtcacgaacgactgctccaacgcaagcattgtgtatgaggcagcggacatgattatgcatacccccgggtgcgtgccctgcgttcgggagaacaactcctcccgctgctgggtcgcgctcactcccacgctcgcggccaggaactccagcatccccactgcgacaatacgacgtcacgtcgatttgctcgttgggacggctgctttctgctccgttatgtacgtgggagatctttgcggatctgttttccttatctctcagctgttcaccttctcgcctcgccggcatgagacagtacaggactgcaattgctcaatctatcccggccacgtatcgggtcaccgcatggcttgggacatgatgatgaactggtcacctacaacagctctagtggtgtcgcaattactccggatcccacaagctgtcggggacatggtggcgggagcccactggggagtcctggcgggcctcgcctactattccatggtagggaactgggctaaggtcttggttgtgatgctactttttgccggcgtcgacggggggactcacacgataggggaggcgacggcccgtactgccagcgggctcgtgggcctctttgcgcctgggccaaaacaaaacatccagcttgtaaacaccaacggcagctggcacatcaacaggactgccctgaactgcaatgactccctcaagactgggttcatctctgcgctgttctacgcccacatgttcaacgcgtccggatgcccggagcgcatggtcagctgccgccccattgacaagttcgctcaggggtggggtcccatcacttacgctgagccgcgcatcttggaccagaagccctattgttggcactacgcaccccaaccgtgcggtattgtacccgcgttgcaggtgtgtggtccagtgtactgtttcaccccaagccctgttgtggtggggacgaccgaccgtttcggcgttcccacgtatagctggggggagaatgagacggacgtgctgcttctcaacaacacgcggccgccgcgaggcaattggttcggctgcacatggatgaatgccactgggttcactaagacgtgcgggggccccccgtgcgacatcgggggggccggtaatgacaccttgatctgccccacggattgcttccggaagcaccccgaggccacttacaccagatgcggttcggggccctggctgacacccaggtgcatggttcactacccatacaggctctggcactacccctgcgctgtcaactttaccatcttcaaggttaggatgaatgtggggggcgtggagcacaggcttgacgccgtatgcaactggacccgaggagagcgatgtgacttggaggacagggatagatcagagcttagcccgctgctgctgtctacgacagagtggcaggtattgccctgttccttcaccaccctaccggctctgtccaccggcttgatccatctccatcggaatatcgtggacgtgcaatacctgtacggtatagggtcagctgttgtctcctacgcaattaagtgggagtatgtcctgttgctcttctttttcctggcggacgcgcgggtctgtgcctgcttgtggatgatgctgctaatagctcaggctgaggccgccttagagaacttggtggtcctcaatgcggcgtccgtggccggaacgcatggcattctctctttccttgtgttcttctgtgctgcctggtacatcaagggcaggctggtccctggggcggcatatgctttctatggcgtatggccgctgctcctgctcctgctggcgttgccaccacgggcatacgccgcggaccgggagatggctgcatcgtgcggaggcgcggtttttataggtctggcacttttgaccttgtcaccacactataaagtgttcctcgccaggctcatatggtggttacaatattttatcaccagagccgaggcgcatttgcaggtgtggatccccccccttaacgttcgggggggccgcgatgccatcatcctcctcatgtgcgtggtccacccagagctaatctttaccatcaccaaaatcttgctcgccatactcggcccgctcatggtgttccaggctggcataaccaaggtgccgtactttgtgcgcgcccatgggctcattcgtgcatgcttgctggtgcggaaagtcgctgggggtcattatgtccaaatggctttcatgaggctggccgcactgacaggcacgtacgtttatgaccatcttactccactgcgggactgggcccacgagggcctaagagaccttgcagtggcagttgagcccgtcgtcttctctgacatggagaccaagatcattacctggggggcagacaccgcggcgtgtggggacatcatatcatgcctgcccgtctccggccgcagggggagggaggtacttttgggaccggcagatagttttgaggggcaggggtggcgactccttgcgcccatcacggcctatgcccaacagacgcggggcctacttggctgcatcatcaccagcctcacaggccgggacaagaaccaggtcgagggggaggttcaagtggtttccaccgcaacgcaatctttcctggcgacctgcgtcaacggcgtgtgttggactgtctaccacggcgccggcacaaagaccctcgccggccaaaagggcccaatcacccaaatgtacaccaatgtagaccaggacctcgtcggctggcaagcgcctcccggggcgcgatccttgacaccgtgcacctgtggcagctcagacctttacttggtcacgaggcacgctgatgtcattccggtgcgccggcggggcgacagcagaggaagcctactctcccccaggcccatctcctacttgaagggctcctcgggtggtccactgctctgcccctcggggcatgccgtgggcatcttccgggctgctgtgtgcacccggggggttgcgaaggcggtggactttgtgcccgttgagtctatggaaacaactatgcggtccccggtcttcacggacaactcgtcccccccggccgtaccgcagacattccaagtggcccatctacacgctcccaccggtagcggcaagagcactaaggtgccggctgcgtatgcagcccaagggtacaaggtactcgtcctgaacccgtctgttgccgccaccctaggtttcggggcgtatatgtctaaggcacatggtgtcgaccctaacatcagaactggggtaaggaccatcaccacgggtgcccccattacgtactccacctatggcaagttccttgccgatggcggttgctctgggggcgcctatgacatcataatatgtgatgagtgccactcaactgactcgactaccatcttgggcatcggcacagtcctggaccaagcggagacggctggagcgcgactcgtcgtactcgccaccgctacgcctccgggatcggtcaccgtgccacatcccaacatcgaggaggtggctctgtccaacgttggagagatccccttctatggtaaagccatccccatcgagaccatcaagggggggaggcacctcatattttgccattccaggaaaaaatgtgatgagctcgccgcaaagttgtcgagtctcgggctcaacgctgtagcgtactaccggggtcttgatgtgtccgtcataccgaccagcggagacgtcgttgtcgtggcaacagacgctctaatgacgggtttcactggcgactttgactcagtgatcgactgtaatacatgtgtcacccagacagtcgacttcagcttggaccctaccttcaccattgagacgacgaccgtgccccaagacgcggtgtcgcgctcgcagcggcgaggcaggactggtaggggcaggacaggcatctacaggtttgtgactccaggagaacggccttcgggcatgttcgattcctcggtcctgtgtgagtgctatgacgcgggctgtgcttggtacgagctcacgcccgccgagacttcagttaggttgcgggcttacctgaatacaccagggttgcccgtctgccaggaccatctggagttctgggagggcgtcttcacaggcctcacccacatagatgcccacttcctgtcccagactaagcaggcaggagacaacttcccctacttggtagcataccaggctacggtgtgcgccagggctcaagctccacccccatcatgggaccaaatgtggaaatgtctcatacggctaaagcccacgctgcacgggccaacacccctgctgtataggctaggagccgtccaaaatgaggtcaccctcacacaccccataaccaaattcatcatggcatgcatgtcggctgacctggaggtcgccaccagcacttgggtgctggtaggcggagtcctcgcagctctggccgcgtattgcctgacaacaggcagcgtggtcattgtgggcaggattattttgtccggaaagccggctattatacccgacagggaagtcctctaccaacagttcgatgagatggaagagtgtgctacacacctcccttacattgaacaaggaatccacctcgccgaacaattcaagcagaaggcactcgggttgttacagacagccaccaagcaagcagaggctgctgctcccgtggtggagtccaagtggcgagcccttgagagcttctgggcgaagcatatgtggaatttcatcagcggggtacaatacttagcaggcttgtccactctgcctgggaaccccgcaatagcatcactgatggcattcacagcctctatcaccagcccgctcaccacccaaagtaccctcctgttcaacatcttggggggatgggtggccgcccaactcgccccccccagcgctgcttctgctttcgtaggcgccggcatcgccggcgcggccgttggcagcataggccttgggaaggtgctagtggacattttggcgggttatggagcgggggtggcaggcgccctcgtggcctttaaggtcatgagtggtgagatgccttctactgaggacttggtcaacttgctccctgccatcctctcccctggtgccctagtcgtcggggtagtgtgcgcagcaatactgcggcggcatgtgggcccaggggagggggctgtgcagtggatgaaccggctgatagcgttcgcctcgcggggtaaccacgtctcccccacgcactatgtgcccgagagcgacgctgcagcgcgtgtcactcagatcctctccagccttaccatcacccagctgctgaagaggctccatcagtggatcaacgaggactgctccacgccatgctccggctcgtggctaagggacgtttgggactggatatgcacggtgttaaccgattttaagacctggctccagtccaagctcctgccgcggttaccgggagtccccttcctctcatgtcaacgtgggtacaagggcatctggcggggagacggcatcatgcaaaccacctgcccatgtggagcgcagatcaccggacatgtcaagaacggttccatgaggatcgttgggcctaggacctgcagcaacacgtggcatggaacattccccatcaacgcgtacaccacgggcccctgcacgccctccccggcgcccaattattccagggcgctgtggagggtgactgctgaggagtacgtggaggttacgcaggtgggggatttccactacgtgacgggcatgaccactgacaacgtaaagtgcccatgccaggttccggcccccgaattcttcacggaggtggatggggtgcggctgcacaggtacgctccgccgtgcaaacctctcctacgggaggaggtcacattccaggtcgggctcaaccaatacctggtcgggtcacagctcccatgtgagcccgaaccggatgtaacggtgctcgcttccatgctcacagacccctcccacatcacagcagaggcggctaagcgtaggctggccagggggtcccccccctccttggccagctcttcagctagccagttgtctgcgccttccttgaaggcgacatgcactacccgtcatgactccccagatgctgacctcatcgaggccaatctcctgtggcggcaggagatgggcgggaacatcacccgcgtggagtcagagaacaaggtagtaattctggactctttcgagccgcttcgagcggaggaagatgagagggaagtgtccgttccggcggaaatcctgcggagatccaggaaatttccccgagcgatgcccatatgggcaaggccggattacaaccctccactgctagagtcctggaaggacccggactacgttcctccagtggtacatgggtgcccattgccacctactaaggcccctccaataccacctccacggaggaaaaggacggttgtcctgacagaatccaccgtgtcttctgccttggctgagctcgccacaaagaccttcggcagctccgaatcgtcggccgtcgacagcggtacggcgaccgcccctcctgaccagctctccgacgacggcgacgcagggtccgatgttgagtcgtactcctccatgcccccccttgagggggagccgggggatcccgatctcagcgacgggtcttggtctaccgtgagcgaggaagctagtgaggacgtcgtctgctgctcgatgtcctacacatggacaggcgccctgatcacgccatgctccgcggaggaaagcaagctgcccatcaacgcgttgagcaactctttgctgcgtcaccacaacatggtctatgccacaacatctcgcagcgcaagccaacggcagaagaaggtcacctttgacagactgcaggtcctggacgaccattaccgggacgtgcttaaggagatgaaggcgaaggcgtccacggttaaggctaaacttctatccgtagaagaagcctgcaagctgacgcccccacactcggccaaatccaagtttggctatggggcaaaggacgtccggaacctatccagcaaggccattaaccacatccgctccgtgtggaaggacttgctggaagacactgagacaccaattgacaccaccatcatggcaaaaaatgaggttttctgcgtccaaccagagaaaggaggccgcaagccagctcgccttatcgtattcccagacttgggggttcgtgtgtgcgagaaaatggccctctatgacgtggtctccacccttcctcaggccgtgatgggctcctcatacgggttccagtactctcctggacagcgggtcgagttcctggtgaatgcctggaaaaaaaagaagaaccctatgggcttcgcatatgacacccgctgttttgactcaacggtcaccgagagtgacatccgtgttgaggagtcaatctaccaatgttgtgacttggcccccgaggccagacaggccataaggtcgctcacagagcggctttatatcgggggtcccctgactaactcaaaaggccagaactgcggttatcgccggtgccgcgcgagcggtgtgctgacgaccagctgcggtaataccctcacatgttacttgaaggcctctgcagcctgtcgagctgccaagctccaggactgcacgatgctcgtgtgcggggacgaccttgtcgttatctgtgaaagcgcgggaactcaggaggacgcggcgagcctacgagtcttcacggaggctatgactaggtactctgccccccccggggacccgcccaaaccagaatacgacttggagttgataacatcatgctcctccaatgtgtcggtcgcgcacgacgtatctggcaaaagggtgtactacctcacccgtgaccccaccaccccacttgcacgggctgcgtgggagacagctagacacactccagtcaactcctggctaggcaacatcatcatgtatgcgcccaccttatgggcaaggatgatcctgatgactcacttcttctccatccttctagctcaggaacaacttgaaaaggctctagattgtcagatctacggggcctgttactccattgagccacttgacctacctcagatcattcagcgactccatggtcttagcgcattttcactccatagttactctccaggtgaaatcaatagggtggctgcatgcctcagaaaacttggggtaccacccttgcgagtctggagacatcgggccagaagtgtccgcgctaagctcctgtcccagggggggagggctgccaactgtggcaaatacctcttcaactgggcagtaaggaccaagcttaaactcactccaattccggctgcgtcccagttggacttgtccaactggttcgttgctggttacagcgggggagacatatatcacagcctgtctcgtgcccgaccccgctggttcatgttgtgcctactcctactttccgtaggggtaggcatctacctgctccccaaccga

SEQ ID NO: 600 - DNA, 9359 bp, Hepatitis C Virus
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggtggtggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggcaggacctgggctcagcccgggtacccttggcccctctatggcaatgagggcatggggtgggcaggatggctcctgtcaccccgcggctctcggcctagttggggccccacggacccccggcgtaggtcgcgtaatttgggtaaggtcatcgataccctcacatgcggcttcgccgacctcatggggtacattccgctcgtcggcgcccccctagggggcgctgccagggccctggcgcatggcgtccgggttctggaggacggcgtgaactatgcaacagggaatttgcccggttgctctttctctatcttcctcttggctttgctgtcctgtttgactatcccagcttccgctatcgaagtgcgcaacgtgtccggagtgtaccatgtcacgaacgactgctccaacgcaagcattgtgtatgaggcagcggacatgattatgcatacccccgggtgcgtgccctgcgttcgggagaacaactcctcccgctgctgggtcgcgctcactcccacgcttgcggccaggaactccagcatccccactgcgacaatacgacgtcacgtcgatttgctcgttgggacggctgctttctgctccgttatgtacgtgggagatctttgcggatctgttttccttatctctcagctgttcaccttctcgcctcgccggcatgagacagtacaggactgcaattgctcaatctatcccggccacgtatcgggtcaccgcatggcttgggacatgatgatgaactggtcacctacaacagctctagtagtgtcgcagttactccggatcccacaagctgtcgtggacatggtggcgggagcccactggggagtcctggcgggcctcgcctactattccatggtagggaactgggctaaggtcttggttgtgatgctactttttgccggcgtcgacgggaggactcacacgataggggaggcgacggctcgtactgtcagcgggctcgtgggcctctttacgcctgggccaaaacaaaacatccagcttgtaaacaccaacggcagctggcacatcaacaggactgccctgaactgcaatgattccctcaagactgggttcatttctgcgctgttctacacccacaggttcaacgcgtccggatgcccggagcgcatggtcagttgccgccccattgacaagttcgctcaggggtggggtcccatcacttacgctgagccgcgcatcttggaccagaagccctattgttggcactacgcaccccaaccgtgcggtattgtacccgcgttgcaggtgtgtggtccagtgtactgtttcaccccaagccctgttgtggtggggacgaccgaccgttacggcgttcccacgtatagctggggggagaatgagacggacgtgctgcttctcaacaacacgcggccgccgcgaggcaattggttcggctgcacatggatgaatgccactgggttcactaagacgtgcgggggccccccgtgcgacatcgggggggccggtaatgacaccttgatctgccccacggattgcttccggaagcaccccgagtccacttacaccagatgcggttcggggccctggctgacacccaggtgcatggttcactacccatataggctctggcactacccctgcactgtcaactttaccatcttcaaggttaggatgtatgtggggggtgtggagcacaggctcgaagccgcatgcaactggacccgaggagagcgttgtgacttggaagacagggatagatcagagcttagcccgctgctgctgtctacgacagagtggcaggtattgccctgttccttcaccaccctaccggctctgtccaccggcttgatccatctccatcggaatatcgtggacgtgcaatacctgtacggtatagggtcagctgttgtctcctacgcaattaagtgggagtatgtcctgttgctcttctttttcctggcggacgcgcgggtctgtgcctgcttgtggatgatgctgctaatagctcaggctgaggccgccttagagaacttggtggtcctcaatgcggcgtccgtggccggaacgcatggcattctctctttccttgtgttcttctgtgctgcctggtacatcaagggcaggctggtccctggggcggcatatgctttctatggcgtatggccgctgctcctgctcctgctggcgttgccaccacgggcatacgctgcggaccgggagatggctgcatcgtgcggaggcgcggtttttataggtctggcactcttgaccttgtcaccacactataaagtgttcctcgccaggctcatatggtggttacaatattttatcaccagagccgaggcgcatttgcaggtgtggatccccccccttaacgttcgggggggccgcgatgccatcatcctcctcatgtgcgtggtccacccagagctaatctttaccatcaccaaaatcttgctcgccatactcggcccgctcatggtgttccaggctggcataaccaaggtgccgtactttgtgcgcgcccatgggctcattcgagcatgcttgctggtgcggaaagtcgctgggggtcattatgtccaaatggctttcatgaggctggccgcactgacaggcacgtacgtttataaccatcttactccactgcgggactgggcccacgagggcctaagagaccttgcagtggcagttgagcccgtcgtcttctctgacatggagaccaagatcattacctggggggcagacaccgcggcgtgtggggacatcatcttaggcctgcccgtctccggccgcaggggaagggaggtacttttgggaccggcagatagttttgaggggcaggggtggcgactccttgcgcccatcacggcctatgcccaacagacgcggggcctacttggctgcatcatcaccagcctcacaggccgggacaagaaccaggtcgagggggaggttcaagtggtttccaccgcaacgcaatctttcctggcgacctgcgtcaacggcgtgtgttggactgtctaccacggcgccggcacaaagaccctcgccggccaaaagggcccaatcacccaaatgtacaccaatgtagaccaggacctcgtcggctggcaagcgcctcccggggcgcgatccttgacaccgtgcacctgtggcagctcagacctttacttggtcacgaggcacgctgatgtcattccggtgcgccggcggggcgacagcagaggaagcctactctcccccaggcccatctcctacttgaagggctcctcgggtggtccactgctctgcccctcggggcatgccgtgggcatcttccgggctgctgtgtgcacccggggggttgcgaaggcggtggactttgtgcccgttgagtctatggaaacaactatgcggtccccggtcttcacggacaactcgtcccccccggccgtaccgcagacattccaagtggcccatctacacgctcccaccggtagcggcaagagcactaaggtgccggctgcatatgcagcccaagggtacaaggtactcgtcctgaacccgtctgttgccgccaccctaggtttcggggcgtatatgtctaaggcacatggtgtcgaccctaacatcagaactggggtaaggaccatcaccacgggtgcccccattacgtactccacctatggcaagttccttgccgatggcggttgctctgggggcgcctatgacatcataatatgtgatgagtgccactcaactgactcgactaccatcttgggcatcggcacagtcctggaccaagcggagacggctggagcgcgactcgtcgtactcgccaccgctacgcctccgggatcggtcaccgtgccacatcccaacatcgaggaggtggctctgtccaacgttggagagatccccttctatggtaaagccatccccatcgagaccatcaagggggggaggcacctcatattttgccattccaggaaaaagtgtgatgagctcgccgcaaagttgtcgagtctcggactcaacgctgtagcgtactaccggggtcttgatgtgtccgtcataccgaccagcggagacgtcgttgtcgtggcaacagacgctctaatgacgggtttcactggcgactttgactcggtgatcgactgtaatacatgtgtcacccagacagtcgacttcagcttggaccctaccttcaccattgagacgacgaccgtgccccaagacgcggtgtcgcgctcgcagcggcgaggcaggactggtaggggcaggacaggcatctacaggtttgtgactccaggagaacggccttcgggcatgttcgattcctcggtcctgtgtgagtgctatgacgcgggctgtgcttggtacgagctcacgcccgccgagacttcagttaggttgcgggcttacctgaatacaccagggttgcccgtctgccaggaccatctggagttctgggagggcgtcttcacaggcctcacccacatagatgcccacttcctgtcccagactaagcaggcaggagacaacttcccctacttggtagcataccaggctacggtgtgcgccagggctcaggctccacccccatcatgggaccaaatgtggaaatgtctcatacggctaaagcccacgctgcacgggccaacacccctgctgtataggctaggagccgtccaaaatgaggtcaccctcacacaccccataaccaaattcatcatggcatgcatgtcggctgacctggaggtcgccaccagcacttgggtgctggtaggcggagtcctcgcagctctggccgcgtattgcctgacaacaggcagcgtggtcattgtgggcaggattattttgtccggaaagccggctattatacccgacagggaagtcctctaccaacagttcgatgagatggaagagtgtgctacacacctcccttacattgaacaaggaatccacctcgccgaacaattcaagcagaaggcactcgggttgttacagacagccaccaagcaagcagaggctgctgctcccgtggtggagtccaagtggcgagcccttgagagcttctgggcgaagcatatgtggaatttcatcagcggggtacaatacttagcaggcttgtccactctgcctgggaaccccgcaatagcatcactgatggcattcacagcctctatcaccagcccgctcaccacccaaagtaccctcctgttcaacattctggggggatgggtggccgcccaactcgccccccccagcgctgcttctgctttcgtaggcgccggcatcgccggcgcggccgttggcagcataggccttgggaaggtgctagtggacatattagcgggttatggagcgggggtggcaggcgccctcgtggcctttaaggtcatgagtggtgagatgccttctactgaggacttggtcaacttgctccctgccatcctctcccctggtgccctagtcgtcggggtagtgtgcgcagcaatactgcggcggcatgtgggcccaggggagggggctgtgcagtggatgaaccggctgatagcgttcgcctcgcggggtaaccacgtctcccccacgcactatgtgcccgagagcgacgctgcagcgcgtgtcactcagatcctctccagccttaccatcacccagctgctgaagaggctccatcagtggatcaacgaggactgctccacgccatgctccggctcgtggctaagggacgtttgggactggatatgcacggtgttaactgattttaagacctggctccagtccaagctcctgccgcggttaccgggagtccccttcctctcatgccaacgtgggtacaagggcatctggcggggagacggcatcatgcaaaccacctgcccatgtggagcgcagatcaccggacatgtcaagaacggttccatgaggatcgttgggcctaggacctgcagcaacacgtggcatggaacattccccatcaacgcgtacaccacgggcccctgcacgccctccccggcgcccaattattccagggcgctgtggagggtgactgctgaggagtacgtggaggttacgcgggtgggggatttccactacgtgacgggcatgaccactgacaacgtaaagtgcccatgccaggttccggcccccgaattcttcacggaggtggatggggtgcggctgcacaggtacgctccgccgtgcaaacctctcctacgggaggaggtcacattccaggtcgggctcaaccaatacctggtcgggtcacagctcccatgtgagcccgaaccggatgtaacggtgctcgcttccatgctcacagacccctcccacatcacagcagaggcggctaagcgtaggctggccagggggtcccccccctccttggccagctcttcagctagccagttgtctgcgccttccttgaaggcgacatgcactacccgtcatgactccccagatgctgacctcatcgaggccaatctcctgtggcggcaggagatgggcgggaacatcacccgcgtggagtcagagaacaaggtagtaattctggactctttcgagccgcttcgagcggaggaagatgagagggaagtgtccgttccggcggaaatcctgcggagatccaggaaatttccccgagcgatgcccatatgggcaaggccggattacaaccctccactggtagagtcctggaaggacccggactacgttcctccggtggtgcatgggtgcccattgccacctactaaggcccctccaataccacctccacggaggaaaaggacggttgtcctgacagaatccaccgtgtcttctgccttggctgagctcgccacaaagaccttcggcagctccgaatcgtcggccgtcgacagcggtacggcgaccgcccctcctgaccagctctccgacgacggcgacgcagggtccgatgttgagtcatactcctccatgcccccccttgagggggagccgggggatcccgatctcagcgacgggtcttggtctaccgtgagcgaggaagctagtgaggacgtcgtctgctgctcgatgtcctacacatggacaggcgccctgatcacgccatgctccgcggaggaaagcaagctgcccatcaacgcgttgagcaactctctgctgcgtcaccacaacatggtctatgccacaacatctcgcagcgcaagccaacggcagaagaaggtcacctttgacagactgcaggtcctggacgaccattaccgggacgtgcttaaggagatgaaggcgaaggcgtccacggttaaggctaaacttctatccgtagaagaagcctgcaagctgacgcccccacactcggccaaatccaagtttggctatggggcaaaggacgtccggaacctatccagcaaggccattaaccacatccgctccgtgtggaaggacttactggaagacactgagacaccaattgacaccaccatcatggcaaaaaatgaggttttctgcgtccaaccagagaaaggaggccgcaagccagctcgccttatcgtattcccagacttgggggttcgtgtgtgcgagaaaatggccctttatgacgtggtctccacccttcctcaggccgtgatgggctcctcatacgggttccagtactctcctggacagcgggtcgagttcctggtgaatgcctggaaaaaaaagaagaaccctatgggcttcgcatatgacacccgctgttttgactcaacggtcaccgagagtgacatccgtgttgaggagtcaatctaccaatgttgtgacttggcccccgaggccagacgggccataaggtcgctcacagagcggctttatatcgggggtcccctgactaactcaaaaggccagaactgcggttatcgccggtgccgcgcgagcggtgtgctgacgaccagctgcggtaataccctcacatgttacttgaaggcctctgcagcctgtcgagctgccaagctccaggactgcacgatgctcgtgtgcggggacgaccttgtcgttatctgtgaaagtgcggggactcaggaggacgcggcgagcctacgagtcttcacggaggctatgactaggtactctgccccccccggggacccgcccaaaccagaatacgacttggagttgataacatcatgctcctccaatgtgtcggtcgcgcacgacgtatctggcaaaagggtgtactacctcacccgtgaccccaccaccccacttgcacgggctgcgtgggagacagctagacacactccagtcaactcctggctaggcaacatcatcatgtatgcgcccaccttatgggcaaggatgatcctgatgactcacttcttctccatccttctagctcaggaacaacttgaaaaggctctagattgtcagatctacggggcctgttactccattgagccacttgacctacctcagatcattcagcgactccatggtcttagcgcattttcactccatagttactctccaggtgaaatcaatagggtggctgcatgcctcagaaaacttggggtaccacccttgcgagtctggagacatcgggccagaagtgtccgcgctaagctcctgtcccagggggggagggctgccaactgtggcaaatacctcttcaactgggcagtaaggaccaagcttaaactcactccaattccggctgcgtcccagttggacttgtccaactggttcgttgctggttacagcgggggagacatatatcacagcctgtctcgtgcccgaccccgctggttcatgttgtgcctactcctactttccgtaggggtaggcatctacctgctccccaaccga

SEQ ID NO: 601 - DNA, 9359 bp, Hepatitis C Virus
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggtggtggtcagatcgttggtggagtttacctgttgccgcgcaggggccccaggttgggtgtgcgcgcgactaggaagacttccgagcggtcgcaacctcgtggaaggcgacaacctatccccaaggctcgccagcccgagggcaggacctgggctcagcccgggtacccttggcccctctatggcaatgagggcatggggtgggcaggatggctcctgtcaccccgcggctctcggcctagttggggccccacggacccccggcgtaggtcgcgtaatttgggtaaggtcatcgataccctcacatgcggcttcgccgacctcatggggtacattccgctcgtcggcgcccccctagggggcgctgccagggccctggcgcatggcgtccgggtcctggaggacggcgtgaactatgcaacagggaatttgcccggttgctctttctctatcttcctcttggctttgctgtcctgtttgaccatcccagcttccgccatcgaagtgcgcaacgtgtccggagtgtaccatgtcacgaacgactgctccaacgcaagcattgtgtatgaggcagcggacatgattatgcatacccccgggtgcgtgccctgcgttcgggagaacaactcctcccgctgctgggtagcgctcactcccacgctcgcggccaggaactccagcatccccactacgacaatacgacgtcacgtcgatttgctcgttggggcggctgctttctgctccgctatgtacgtgggagatctttgcggatctgttttcctcgtctctcagctgttcaccttctcgcctcgccgacatgagacagtacaggactgcaattgctcaatctatcccggccacttatcgggtcaccgcatggcttgggacatgatgatgaactggtcacctgcaacagctctagtggtgtcgcagttactccggatcccacaagctgtcgtggacatggtggcgggagcccactggggagtcctggcgggcctcgcctactattccatggtggggaactgggctaaggtcttgattgtgatgctactttttgccggcgtcgacgggcagacttacatgacggggggggcgcaggcccataccactcgcgggcttgcgaacctcttttcgcctgggccgtcccaaaacatccagcttataaacaccaacggcagctggcacatcaacaggactgctctgaactgcaatgactccctcaacactgggttccttgccgcgctgttctacgcccgcaacttcaacgcatccggatgcccgcagcgcatggccagctgccgccccatcgacaagttcgctcaggggtggggtcccatcacttacgctaggccgcccagcttggaccagaagccctattgctggcactacgcaccccaaccgtgtggtattgtacccgcggcgcaggtgtgcggtccagtgtactgtttcaccccaagcccagttgtggtggggacgaccgatcggttcggcgtcccaacgtatagctggggggagaatgagacggacgtgctgcttcttaataacacgcggccaccgcgaggcaactggttcggctgcacatggatgaatagcactgggttcaccaagacgtgcgggggccccccgtgcaacatcgggggagtcggtaatgacaccttgatctgccccacggattgcttccggaagcaccccgaggccacttacaccaaatgcggttcggggccctggctgacacctaggtgcatggttgactacccatacaggctttggcactacccctgcactcttaattttaccatctttaaggttaggatgtatgtggggggtgtggagcacaggctcaacgccgcatgcaactggacccgaggagagcgttgtgacttggaggacagggatagatcagagcttagcccgctgctgctgtctacaacagagtggcagatattgccctgttccttcaccaccctaccggctctgtccaccggcttgatccatctccatcggaacatcgtggacgtgcaatacctgtacggtatagggtcagcggttgtctcctacgcaattaagtgggagtacgtcctgttgctcttccttttcctggcggacgcgcgcgtctgtgcctgcttgtggatgatgctgctaatagctcaggctgaggccgccttagagaacttggtggtcctcaatgcggcgtccgtagccggaacgcatggcatcttctctttccttgtgttcttctgtgctgcctggtacatcaagggcaggctggtccctggggcggcatatgctttctatggcgtatggccgctgctcctgctcctgctggcgttgccaccacgagcatacgccatggaccgggagatggctgcatcgtgcggaggcgcggtttttataggtctggcacttttgaccttgtcaccacactatagagcattcctcgccaggctcatatggtggttgcaatattttatcaccagagccgaggcgcacttgcaggtgtggatcccccccctcaacgttcgggggggccgcgatgccatcatcctcctcacgtgcgcgatccacccagagctagtctttaccatcaccaaaatcttgctcgccatactcggcccgctcatggtgctccaggctgccataaccagggtgccgtactttgtgcgcgcccatgggctcattcgtgcatgcttgctggtgcggaaagtcgctgggggtcattatgtccaaatggctttcatgaagctggccgctctgacaggcacgtacgtttatgaccatcttactccactgcgggactgggcccacgagggcctacgggaccttgcagtagcagttgagcccgttgtcttctctgacatggagaccaagatcattacctggggggcagacaccgcggcatgtggggacatcatcttaggcctgcccgtctccgcccgcagggggagggagatattcttgggaccggcagatagtcttgaggggcaggggtggcgactccttgcgcccatcacggcctatgcccaacagacgcggggcctacttggctgcatcgtcaccagcctcacaggccgggacaagaaccaggtcgagggggaggttcaagtggtttccaccgcaacacaatctttcctggcgacctgcgtcaacggcgtgtgttggactgtctaccacggcgccggcacaaagaccctcgccggccaaaagggcccaattacccaaatgtacaccaatgtagacctggacctcgtcggctggcaagcgccttccggggcgcgatccctgacaccgtgcacctgtggcagctcggacctttacttggtcacgaggcatgctgatgtcattccggtgcgccggcggggcgacagcagaggaagcctactctcccccaggcccgtctcctacttgaagggctcttcgggtggtccactgctctgcccctcggggcatgctgtgggcatcttccgggctgctgtgtgcacccggggggttgctaaggcggtggactttgtgcccgttgagtctatggaaacaactatgcggtccccggtcttcacggacaactcgtcccccccggccgtaccgcagacattccaagtggcccatctacacgctcccactggcagcggcaagagcactaaggtgccggctgcgtatgcagcccaagggtacaaggtactcgtcctgaacccgtctgttgccgccaccctaggtttcggggcgtatatgtctaaggcacatggtgtcgaccctaacatcagaactggggtaaggaccatcaccacgggtgcccccattacgtactccacctatggcaagtttcttgccgacggtggttgctctgggggcgcctatgacatcataatatgtgatgagtgccactcaactgactcgactagcatcttgggcatcggcacagtcctggaccaagcggagacggctggagcgcgactcgtcgtactcgccaccgctacgcctccaggatcggtcaccgtgccacatcccaatatcgaggaggtggctctgtccaacattggagagatccccttctatggtaaagccatccccatcgagaccatcaagggggggaggcacctcatattttgccattccaagaagaaatgtgatgagctcgccgcaaagctgtcgggcctcgggcttaacgctgtagcgtattaccggggtctcgatgtgtccgtcataccgaccagcggagacgtcgttgtcgtggcaacagacgctctaatgacgggttacactggcgactttgactcagtgatcgactgtaatacatgtgtcacccagacagtcgacttcagcttggaccctaccttcaccatcgagacgacgaccgtgccccaagacgcggtgtcgcgctcgcagcggcgaggcaggactggtaggggcaggacaggcatctacaggtttgtgactccaggagaacggccctcgggcatgttcgattcctcggtcctgtgtgagtgctatgacgcgggctgtgcttggtacgagctcacgcccgccgagacctcagttaggttgcgggcttacctgaatacaccagggttgcccgtctgccaggaccatctggagttctgggaaggcgtcttcacaggcctcacccacatagatgcccacttcctgtcccagactaagcaggcaggagacaacttcccctacttggtagcataccaggctacggtgtgcgccagggctcaggctccacccccatcgtgggaccaaatgtggaaatgtctcatacggctaaagcccacgctgcacgggccaacacccctgctgtataggctaggagccgtccaaaatgaggtcaccctcacacaccccataaccaaattcatcatggcatgcatgtcggctgacctggaggtcgccacgagcacctgggtgctagtaggcggggtcctcgcagctctggccgcgtattgcctgacaacaggcagcgtggtcattgtaggcaggatcatcttgtccggaaagccggctattgtacctgacagggaagtcctctaccaggagttcgatgagatggaagagtgcgctacacacctcccttacattgaacaaggaatgcagctcgccgaacaattcaagcagaaggcactcgggttgctacagacagccaccaagcaagcagaggctgctgctcccgtggtggagtccaagtggcgagcccttgagagcttctgggcgaagcatatgtggaatttcatcagcgggatacagtacttagcaggcttgtccactctgcctggaaaccccgcaatagcatcactgatggcattcacagcctccatcaccagcccgctcaccacccaacataccctcctgttcaacatcttggggggatgggtggccgcccaactcgccccccccagcgctgcttctgctttcgtaggcgctggcatcgccggcgcggccgttggcagcataggccttgggaaggtgctagtggacatcttggctggttatggagcgggggtggcaggcgccctcgtggcctttaaggtcatgagtggtgagatgccttccactgaggacttggtcaacttgctccctgccatcctctcccctggtgccctagtcgtcggggtagtgtgcgcagcaatactgcgtcggcacgtgggtccaggggagggggctgtgcagtggatgaaccggctgatagcgttcgcttcgcggggtaaccacgtctcccccacgcactatgtgcccgagagcgacgctgcagcgcgtgtcactcagatcctctctagccttaccatcactcagctgctgaagagactccatcagtggatcaacgaggactgctccacgccatgctccggctcgtggctgagggacgtttgggactggatatgcacggtgttaactgattttaagacctggctccagtccaagctcctgccgcggttaccgggagttcccttcctctcatgccaacgagggtacaagggcatctggcggggagacggcatcatgcaaaccacctgcccatgtggagcgcagatcaccggacatgtcaaaaacggttccatgaggatcgttgggcctaggacctgcagcaacacgtggcatggaacattccccatcaacgcatacaccacgggctcctgcacgccctccccggcgcccaattattccagggcgctgtggagggtggctgctgaggagtacgtggaggttacgcgggtgggggatttccactacgtgacgggcatgaccactgacaacgtaaagtgcccatgccaggttccggcccccgaattcttcacggaggtggacggggtgcggctgcacaggtacgctccgccgtgcaaacctctcctacgggaggaggtcacattccaggtcgggctcaaccaatacttggtcgggtcacagctcccatgcgagcctgaaccggatgtagcggtgctcacttccatgctcaccgacccctcccacatcacagcagaggcggctaagcgtaggctggccagggggtctcccccctccttggccagctcttcagctagccagctgtctgcgccttccttgaaggcgacatgcactacccgtcatgactccccagatgctgacctcatcgaggccaatctcctgtggcggcaggagatgggcgggaacatcacccgcgtggagtcagagaacaaggtagtaattctggactctttcgagccgcttcgagcggaggaagatgagagggaagtatccgttccggcggaaatcctgcgaagatccaggaaatttccccgagcgatgcccgtatgggcaaggccggattacaaccctccactggtagagtcctggaaggacccggactacgtccctccggtggtacatgggtgcccattgccgcctactaaggcccctccaataccacctccacggaggaaaaggacggttgtcctgacagaatccaccgtgtcttctgccttggctgagctcgccacaaagaccttcggcagctccgaatcgtcggccgtcgacagcggcacggcgaccgcccctcctgaccagccctccgacgacggcgacgcagggtccgatgttgagtcgtactcctccatgcccccccttgagggggagccgggggatcccgatctcagcgacgggtcttggtctaccgtgagcgaggaagctagtgaggacgtcgtctgctgctcgatgtcctacacatggacaggcgccctgatcacaccatgctccgcggaggaaagcaagctgcccatcaacgcgttgagcaactctttgctgcgtcaccacaacatggtctatgccacaacatctcgcagcgcaagccagcggcagaagaaggtcacctttgacagactgcaagtcctggacgaccattaccgggacgtgctcaaggagatgaaggcgaaggcgtccacagttaaggctaaacttctatccgtagaagaagcctgcatgctgacgcccccacactcggccaaatccaaatttggctatggggcaaaggacgtccggaacctatccagcaaggccattaaccacatccgctccgtgtggaaggacttgctggaagacactgagacaccaattgacaccaccatcatggcaaaaaatgaggttttctgcgtccaaccagagaaaggaggccgcaagccagctcgccttatcgtattcccagacttgggggttcgtgtgtgcgagaaaatggccctttatgacgtggtctccacccttcctcaggccgtgatgggctcctcatacgggttccagtactctcctggacagcgggtcgagttcctggtgaatgcctggaaaaaaaagaagaaccctatgggcttcgcatatgacacccgctgttttgactcaacggtcaccgagagtgacatccgtgttgaggagtcaatctaccaatgttgtgacttggcccccgaagccagacaggccataaggtcgctcacagagcggctttatgtcgggggtcccctgactaactcaaaagggcagaactgcggttatcgccggtgccgcgcgagcggtgtgctgacgactagctgcggtaataccctcacatgttacttgaaggcctctgcagcctgtcgagctgccaagctccaggactgcacgatgctcgtgtgcggagacgaccttgtcgttatctgtgaaagcgcgggaacccaggaggacgaggcgagcctacgagtcttcacggaggctatgactaggtactccgccccccccggggacccgcccaaaccagaatacgacttggagctgataacatcatgctcctccaatgtgtcggtcgcgcacgatgcatctggcaaaagggtatactacctcacccgtgaccccaccaccccacttgcacgggctgcgtgggagacagctaaacacactccagtcaactcctggctaggcaacatcatcatgtatgcgcccaccttatgggtaaggatggtcctgatgactcacttcttctccatccttctagctcaggaacaacttgaaaaggctctagactgtcagatctacggggcctgttactccattgagccacttgacctacctcagatcattcagcgactccatggtcttagcgcattttcactccatagttactctccaggtgaaatcaatagggtggctgcatgcctcagaaaacttggggtaccacccttgcgagtctggagacatcgggccagaagtgtccgcgctaagctcctgtcccagggggggagggctgccacctgtggcaaatacctcttcaactgggcagtaaggaccaagcttaaactcactccaattccagctgcgtcccagttggacttgtccagctggttcgttgctggttacagcgggggagacatatatcacagcgtgtctcgtgcccgaccccgctggctcatgtggtgcctactcctactttccgtaggggtaggcatctacctgctccccaaccga

SEQ ID NO: 602 - DNA, 9359 bp, Hepatitis C Virus
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggtggtggtcagatcgttggtggagtttacctgttgccgcgcaggggccccaggttgggtgtgcgcgcgactaggaagacttccgagcggtcgcaacctcgtggaaggcgacaacctatccccaaggctcgccagcccgagggcagggcctgggctcagcccgggtacccttggcccctctatggcaatgagggcatggggtgggcaggatggctcctgtcaccccgcggctctcggcctagttggggccccacggacccccggcgtaggtcgcgtaatttgggtaaggtcatcgataccctcacatgcggcttcgccgacctcatggggtacattccgctcgtcggcgcccccctagggggcgctgccagggccctggcgcatggcgtccgggtcctggaggacggcgtgaactatgcaacagggaatttgcccggttgctctttctctatcttcctcttggctttgctgtcctgtttgaccatcccagcttccgccatcgaagtgcgcaacgtgtccggagtgtaccatgtcacgaacgactgctccaacgcaagcattgtgtatgaggcagcggacatgattatgcatacccccgggtgcgtgccctgcgttcgggagaacaactcctcccgctgctgggtagcgctcactcccacgctcgcggccaggaactccagcatccccactacgacaatacgacgtcacgtcgatttgctcgttggggcggctgctttctgctccgctatgtacgtgggagatctttgcggatctgttttccttgtctctcagctgttcaccttctcgcctcgccgacatgagacagtacaggactgcaattgctcaatctatcccggccacttatcgggtcaccgcatggcttgggacatgatgatgaactggtcacctgcaacagctctagtggtgtcgcagttactccggatcccacaagctgtcgtggacatggtggcgggagcccactggggagtcctggcgggcctcgcctactattccatggtggggaactgggctaaggtcttgattgtgatgctactttttgccggcgtcgacggggagactcacatcacaggggggacgcaggcccgtaccactcgcgggcttgcgaacctcttttcggctgggccgtcccaaaacatccagcttataaacaccaacggcagctggcacatcaacaggactgctctgaactgcaatgactccctcaacaccgggttccttgccgcgctgttctacgcccgcaacttcaacgcatccggatgcccgcagcgcatggccagctgccgccccatcgacaagttcgctcaggggtggggtcccatcacttacgctaggccgcccagcttggaccagaagccctattgctggcactacgcaccccaaccgtgtggtattgtacccgcggcgcaggtgtgcggtccagtgtactgtttcactccaagcccagttgtggtggggacgaccgatcggttcggcgtcccaacgtatagctggggggagaatgagacggacgtgctgcttctcaataacacgcggccaccgcgaggcaactggttcggctgcacatggatgaatagcactgggttcaccaagacgtgcgggggccccccgtgcaacatcgggggagtcggtaatgacaccttgatctgccccacggattgcttccggaagcaccccgaggccacttacaccaaatgcggttcggggccctggctgacacctaggtgcatggttgactacccatacaggctttggcactacccctgcactcttaatttttccatctttaaggttaggatgtatgtggggggtgtggagcacaggctcaacgccgcatgcaactggacccgaggagagcgttgtgacttggaggacagggatagatcagagcttagcccgctgctgctgtctacaacagagtggcagatattgccctgttccttcaccaccctaccggctctgtccaccggcttgatccatctccatcggaacatcgtggacgtgcaatacctgtacggtatagggtcagcggttgtctcctacgcaattaagtgggagtacgtcctgttgctcttccttttcctggcggacgcgcgcgtctgtgcctgtttgtggatgatgctgctaatagctcaggctgaggccgccttagagaacttggtggtcctcaatgcggcgtccgtagccggaacgcatggcatcttctctttccttgtgttcttctgtgctgcctggtacatcaagggcaggctggtccctggggcggcatatgctttctatggcgtatggccgctgctcctgctcctgctggcgttgccaccacgagcatacgccatggaccgggagatggctgcatcgtgcggaggcgcggtttttataggtctggcacttttgaccttgtcaccacactatagagcattcctcgccaggctcatatggtggttgcaatattttatcaccagagccgaggcgcacttgcaggtgtgggtcccccccctcaacgttcgggggggccgcgatgccatcatcctcctcacgtgcgcgatccacccagagctagtctttaccatcaccaaaatcttgctcgccatactcggcccgctcatggtgctccaggctgccataaccagggtgccgtactttgtgcgcgcccatgggctcattcgtgcatgcttgctggtgcggaaagtcgctgggggtcattatgtccaaatggctttcatgaagctggccgctctgacaggcacgtacgtttatgaccatcttactccactgcgggactgggcccacgagggcctacgggaccttgcagtagcagttgagcccgttgtcttctctgacatggagaccaagatcattacctggggggcagacaccgcggcgtgtggggacatcatcttaggcctgcccgtctccgcccgcagggggagggagatattcttgggaccggcagatagtcttgaggggcaggggtggcgactccttgcgcccatcacggcctacgcccaacagacgcggggcctacttggctgcatcgtcaccagcctcacaggccgggacaagaaccaggtcgagggggaggttcaagtggtttccaccgcaacacaatctttcctggcgacctgcgtcaacggcgtgtgttggactgtctaccacggcgccggcacaaagacccttgccggcaaaaatggcccaattacccaaatgtacaccaatgtagacctggacctcgtcggctggcaagcgccttccggggcgcgatccctgacaccgtgcacctgtggcagctcggacctttacttggtcacgaggcatgctgatgtcattccggtgcgccggcggggcgacagcagaggaagcctactctcccccaggcccgtctcctacttgaagggctcttcgggtggtccactgctctgcccctcggggcatgctgtgggcatcttccgggctgctgtgtgcacccggggggttgctaaggcggtggactttgtgcccgttgagtccatggaaacaactatgcggtccccggtcttcacggacaactcgtcccccccggccgtaccgcagacattccaagtggcccatctacacgctcccactggcagcggcaagagcactaaggtgccggctgcgtatgcagcccaagggtacaaggtactcgtactgaacccgtctgttgccgccaccctaggtttcggggcgtatatgtctaaggcacatggtgtcgaccccaacatcagaactggggtaaggaccatcaccacgggtgcccccattacgtactccacctatggcaagtttcttgccgacggtggttgctctgggggcgcctatgacatcataatatgtgatgagtgccactcaactgactcgacttccatcttgggcatcggcacagtcctggaccaagcggagacggctggagcgcgactcgtcgtactcgccaccgctacgcctccaggatcggtcaccgtgccacatcccaatatcgaggaggtggctctgtccaacattggagagatccccttctatggtaaagccatccccatcgagaccatcaagggggggaggcacctcatattttgccattccaagaagaaatgtgatgagctcgccgcaaagctgtcgggcctcgggcttaacgctgtagcgtattaccggggtctcgatgtgtccgtcataccgaccagcggagacgtcgttgtcgtggcaacagacgctctaatgacgggttacactggcgactttgactcagtgatcgactgtaatacatgtgtcacccaaacagtcgacttcagcttggaccctaccttcaccatcgagacgacgaccgtgccccaagacgcggtgtcgcgctcgcagcggcgaggcaggactggtaggggcaggacaggcatctacaggtttgtgactccaggagaacggccctcgggcatgttcgattcctcggtcctgtgtgagtgctatgacgcgggctgtgcttggtatgagctcacgcccgccgagacctcagttaggttgcgggcttacctgaatacaccagggttgcccgtctgccaggaccatctggagttctgggaaggcgtcttcacaggcctcacccacatagatgcccacttcctgtcccagactaagcaggcaggagacaactttccctacttggtagcataccaggctacggtgtgcgccagggctcaggctccacccccatcgtgggaccaaatgtggaaatgtctcatacggctaaagcccacgctgcacgggccaacacccctgctgtataggctaggagccgtccaaaatgaggtcaccctcacacaccccataaccaaattcatcatggcatgcatgtcggctgacctggaggtcgccacgagcacctgggtgctagtaggcggggtcctcgcagctctggccgcgtattgtctaacaacaggcagcgtggtcattgtaggcaggatcatcttgtccggaaagccggctattgtacctgacagggaagtcctctaccaggagttcgatgagatggaagagtgcgctacacacctcccttacattgaacaaggaatgcagctcgccgaacaattcaagcagaaggcactcgggttgctacagacagccaccaagcaagcagaggctgctgctcccgtggtggagtccaagtggcgagcccttgagagcttctgggcgaagcatatgtggaatttcatcagcgggatacagtacttagcaggcttgtccactctgcctggaaaccccgcaatagcatcactgatggcattcacagcctccatcaccagcccgctcaccacccaacataccctcctgttcaacatcttggggggatgggtggccgcccaactcgccccccccagcgctgcttctgctttcgtaggcgctggcatcgccggcgcggccgttggcagcataggccttgggaaggtgctagtggacatcttggctggttatggagcgggggtggcaggcgccctcgtggcctttaaggtcatgagtggtgagatgccttccactgaggacttggtcaacttgctccctgccatcctctcccctggtgccctagtcgtcggggtagtgtgcgcagcaatactgcgtcggcacgtgggtccaggggagggggctgtgcagtggatgaaccggctgatagcgttcgcttcgcggggtaaccacgtctcccccacgcactatgtgcccgagagcgacgctgcagcgcgtgtcactcagatcctctctagccttaccatcactcagctgctgaagagactccatcagtggatcaacgaggactgctccacgccatgctccggctcgtggctgagggacgtttgggactggatatgcacggtgttaactgattttaagacctggctccagtccaagctcctgccgcggttaccgggagtccccttcctctcatgccaacgagggtacaagggcatctggcggggagacggcatcatgcaaaccacctgcccatgtggagcgcagatcaccggacatgtcaaaaacggttccatgaggatcgttgggcctaggacctgcagcaacacgtggcatggaacattccccatcaacgcatacaccacgggcccctgcacgccctccccggcgcccaattattccagggcgctgtggagggtggctgctgaggagtacgtggaggttacgcgggtgggggatttccactacgtgacgggcatgaccactgacaacgtaaagtgcccatgccaggttccggcccccgaattcttcacggaggtggatggggtgcggctgcacaggtacgctccgccgtgcagacctctcctacgggaggaggtcacattccaggtcgggctcaaccaatacctggtcgggtcacagctcccatgtgagcccgaaccggatgtagcggtgctcacttccatgctcaccgacccctcccacatcacagcagagacggctaagcgtaggctggccagggggtcccccccctccttggccagctcttcagctagccagttgtctgcgccttccttgaaggcgacatgcactacccgtcatgactccccagatgctgacctcatcgaggccaatctcctgtggcggcaggagatgggcgggaacatcacccgcgtggagtcagagaacaaggtggtgattctggactctttcgagccgcttcgagcggaggaagatgagagggaagtatccgttccggcggaaatcctgcggagatccaggaagtttccccgggcgatgcccgtatgggctaggccggattacaaccctccactggtagagtcctggaaggacccggactacgtccctccggtggtacatgggtgcccattgccgcctactaaggcccctccaataccacctccacggaggaaaaggacggttgtcctgacagaatccaccgtgtcttctgccttggctgagctcgccacaaagaccttcggcagctccgaatcgtcggccgtcgacagcggcacggcgaccgcccctcctgaccagccctccgacgacggcgacgcagggtccgatgttgagtcgtactcctccatgcccccccttgagggggagccgggggatcccgatctcagcgacgggtcttggtctaccgtgagcgaggaagctggtgaggacgtcgtctgctgctcgatgtcctacacatggacaggcgccctgatcacaccatgctccgcggaggaaagcaagctgcccatcaacgcgttgagcaactctttgctgcgtcaccacaacatggtctatgccacaacatctcgcagcgcaagccagcggcagaagaaggtcacctttgacagactgcaggtcctggacgaccattaccgggacgtgctcaaggagatgaaggcgaaggcgtccacagttaaggctaaactcctatccgtagaagaagcctgcatgctgacgcccccacactcggccaaatccaaatttggctatggggcaaaggacgtccggaacctatccagcaaggccattaaccacatccgctccgtgtggaaggacttgctggaagacactgagacaccaattgacaccaccatcatggcaaaaaatgaggttttctgcgtccaaccagagaaaggaggccgcaagccagctcgccttatcgtattcccagacttgggggttcgtgtgtgcgagaaaatggccctttatgatgtggtctccacccttcctcaggccgtgatgggctcctcatacgggttccagtactctcctggacagcgggtcgagttcctggtgaatgcctggaaaaaaaagaagaaccctatgggcttcgcatatgacacccgctgttttgactcaacggtcaccgagagtgacatccgtgttgaggagtcaatctaccaatgttgtgacttggcccccgaagccagacaggccataaggtcgctcacagagcggctttatatcgggggtcccctgactaactcaaaagggcagaactgcggttatcgccggtgccgcgcgagcggtgtgctgacgactagctgcggtaataccctcacatgttacttgaaggcctctgcagcctgtcgagctgccaagctccaggactgcacgatgctcgtgtgtggagacgaccttgtcgttatctgtgaaagcgcgggtacccaggaggacgaggcgagcctacgagtcttcacggaggctatgactaggtactctgccccccccggggacccgcccaaaccagaatacgacttggagctgataacatcatgctcctccaacgtgtcggtcgcgcacgatgcatctggcaaaagggtgtactacctcacccgtgaccccaccaccccacttgcacgggctgcgtgggagacagctaaacacactccagtcaattcctggctaggcaacatcatcatgtatgcgcccaccttatgggtaaggatggtcctgatgactcacttcttctccatccttctagctcaggaacaacttgaaaaggccctagactgtcagatctacggggcctgttactccattgagccacttgacctacctcagatcattcagcgactccatggtcttagcgcattttcactccatagttactctccaggtgaaatcaatagggtggctgcatgcctcagaaaacttggggtaccacccttgcgagtctggagacatcgggccagaagtgtccgcgctaagctactgtcccagggggggagggctgccacctgtggcaaatacctcttcaactgggcagtaaggaccaagctcaaactcactccaattcctgctgcgtcccagttggacttgtccagctggttcgttgctggttacagcgggggagacatatatcacagcgtgtctcgtgcccgaccccgctggctcatgtggtgcctactcctactttccgtaggggtaggcatctacctgctccccaaccga

SEQ ID NO: 603 - DNA, 9359 bp, Hepatitis C Virus
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaagccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaacctccgcccacaggacgtcaagttcccgggtggtggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggcaggacctgggctcagcccgggtacccttggcccctctatggcaatgagggcatggggtgggcaggatggctcctgtcaccccgcggctctcggcctagttggggccccacggacccccggcgtaggtcgcgcaatttgggtaaggtcatcgataccctcacatgcggcttcgccgatctcatggggtacattccgctcgtcggcgcccccctagggggcgctgccagggccctggcgcatggcgtccgggtcctggaggacggcgtgaactacgcaacagggaatttgcccggttgctctttctctatcttcctcttggctttgctgtcctgtttgaccatcccagcttccgctattgaagtgcgcaacgtgtccggagtgtaccatgtcacgaacgactgctccaacgcaagcattgtgtatgaggcagcggacatgattatgcatacccccgggtgcgtgccctgcgttcgggagggcaactcctcccactgctgggtagcgctcactcccacgctcgcggccaggaacttcagcatccccactacgacaatacggcgtcatgtcgatttgctcgttgggacggctgctttctgttccgctatgtacgtgggagatctttgcggatctgttttccttgtctctcagctgttcaccttctcgcctcgccggcatgtgacagtacaggactgcaattgctcaatctatcccggccacgtatcgggtcaccgcatggcttgggacatgatgatgaactggtcacctacaacagctctagtggtgtcgcagttactccggattccacaagctgtcgtggacatggtggcgggagcccactggggagtcctggcgggcatcgcctactattccatggtggggaactgggctaaggtcttgattgtgatgctacttttttccggcgtcgacgggactacccacacgacgggggggacagcggcttttactatcaacaggtttacgagcatattcgcggctgggccggcccaaaagatccagctcataaacaccaacggcagctggcacatcaacaggaccgccctgaactgcaatgactccctcaacactgggttcatcgccgcgctgttctacgcccgcagtttcaactcgtccggatgcccggagcgcatggccagctgccgccccgttgacaagttcgctcaagggtggggtcccatcacttatgttaggccgcccaagctggaccagaggccctactgctggcactacgcaccccaaccgtgcggtattgtgcccgcatcgcaggtgtgcggtccagtgtactgtttcactccaagccctgttgtggtggggacgaccgatcgtttcggcgtccctacgtatagctggggggagaatgagacggacgtgctgcttctcaacaacacgcggccgccgcaaggcaactggttcggttgcacgtggatgaatagcactgggttcaccaagacgtgcgggggccccccgtgcaacatcgggggggccggtaatgacaccttaatctgccccacggattgcttccggaagcaccccgaggccacttacaccaaatgcggttcgggaccctggctgacacctaggtgcatggttgactacccatacaggctttggcactacccctgcactgtcaacttttccatcttcaaggttaggatgtatgtggggggtgtggagcacaggctcaacgccgcatgcaactggacccgaggagagcgttgtgatttggaggacagagataggtcagagcttagcccgctgctgctgtctacaacagagtggcaggtactgccctgttccttcaccactctaccagccctgtccaccggcttgatccatctccatcggaacaccgtggacgtgcaatacctgtacggtatagggtcagcggttgtctcctatgcaattaagtgggagtacgtcctgttgctcttccttttcctggcggacgcgcgcgtctgtgcctgcttgtggatgatgctactagtagctcaggctgaggctgccttagagaacttggtggtcctcaatgcggcgtccgtagccggaacgcatggcattctctctttccttgtattcttctgtgctgcctggtacatcaagggcaggctggtccctggggcggcatatgctgtctatggtgtatggccgttgctcctgctcctgctggcgttgccaccacgggcatacgccatggaccgggagatggctgcatcgtgcggaggtgcggttcttataggtctagcacttttgaccttgtcaccacactataaggtgttcctcgccaggctcatatggtggttacaatactttatcaccagagccgaggcgcacttgcaggtgtggatcccccccctcaacgttcgggggggccgcgatgccatcatcctcctcatgtgcgcgatccacccagagctaatttttgccatcaccaaaaacttgctcgccatactcggcccgctcatggtgctccaggctggcataaccagggtgccgtactttgtgcgcgcccatgggcttattcgtgcatgcttgctggtgcggaaagtcgttgggggtcattatgtccaaatggctttcatgaggctggccgcgctgacaggcacgtacgtttatgaccatcttactccactgcgggactgggcccacgagggcctacgagaccttgcagtggcagttgagcccgtcgtcttctctgacatggagaccaagatcattacctggggggcagacaccgcggcgtgtggggacatcatctcaggcctgcctgtctccgcccgcagggggagggagatacttttgggaccggcagatagttttgaggggcaggggtggcggctccttgcgcccatcacggcctatgcccaacagacgcggggcctacttggctgcatcgtcaccagcctcacaggccgggacaagaaccaagtcgagggggaggttcaagtggtttccaccgcgacacaatccttcctggcgacctgcgtcaacggcgtgtgttggactgtctaccacggcgcgggcgcaaggactctcgccggccaaaagggcccaatcacccaaatgtacaccaatgtagaccaggacctcgtcggctggcaagcgcctcccggggcgcgatccttgacaccgtgcacctgtggcagctcggacctttacttggtcacgaggcatgctgatgtcattccggtgcgccggcggggcgacagcagaggaagcctactctcccccaggcccgtctcctacttgaagggctcttcgggtggtccactgctctgcccctcggggcatgctgtgggcatcttccgggctgctgtgtgcacccggggggttgcgaaggcggtggattttgtgcccgttgagtctatggaaacaactatgcggtccccggtcttcacggacaactcgtcccccccggccgtaccgcagacattccaggtggcccatctacacgctcccactggcagcggcaagagcactaaggtgccggctgcgtatgcagcccaagggtacaaggtgctcgtcctgaacccgtctgttgccgccaccctaggcttcggggcgtatatgtctaaggcacatggtgtcgaccctaacatcagaactggggtaaggaccatcaccacgggtgcccccattacgtactccacctatggcaagtttcttgccgacggtggttgctctgggggcgcctatgacatcataatatgtgatgagtgccactcaactgactcgactaccatcttgggcatcggcacagtcctggaccaagcggagacggctggagcgcgactcgtcgtactcgccaccgctacgcctccgggatcggtcaccgtgccacatcccaatatcgaggaggtggctctgtccaacagtggagagatccccttctatggtaaggccatccccatcgagaccatcaagggggggagacacctcatattttgccattccaagaaaaaatgtgatgagctcgccgcaaagctgtcgggtctcgggcttaacgctgtagcgtattaccggggtcttgacgtgtccgtcataccgaccagcggagacgtcgttgtcgtggcaacagacgctctaatgacgggtttcaccggcgactttgactcagtgatcgactgtaatacatgtgtcacccagacagtcgacttcagcttggaccctaccttcaccattgagacgacgaccgtgccccaagacgcggtgtcgcgctcgcagcggcgaggcaggactggtaggggcaggacaggcatctacaggtttgtgactccaggagaacggccctcgggcatgttcgattcctcggtcctgtgtgagtgctatgacgcgggctgtgcttggtacgagctcacgcccgccgagacctcagttaggttgcgggcttacctgaatacaccagggttgcccgtctgccaggaccatctggagttctgggagggcgtcttcacaggcctcacccacatagatgcccacttcctgtcccagactaagcaggcaggagacaacttcccctacttggtagcataccaagctacggtgtgcgccagagctcaggctccacccccatcgtgggaccaaatgtggaaatgtctcatacggctaaagcccacactgcacgggccaacacccctgctgtataggctaggagccgttcaaaatgaggtcaccctcacacaccccataaccaagttcatcatggcatgcatgtcggctgacctggaggtcgccacgagcacctgggtgctagtaggcggagtcctcgcagctctggccgcgtattgcctgacaacaggcagcgtggtcattgtaggcaggatcatcttgtccgggaagccggctattgtacccgacagggaagtcctctaccagcagttcgatgagatggaagagtgcgctacacacctcccttacatcgaacaaggaatgcagctcgccgaacaattcaagcagaaggcactcgggttgttacagacagccaccaagcaagcagaggctgctgctcccgtggtggagtccaagtggcgagcccttgagagcttctgggcgaagcatatgtggaatttcatcagcgggatacaatacttggcaggcttgtccactctgcctgggaaccccgcaatagcatcactgatggcattcacagcctccatcaccagcccgttcaccacccaacagaccctcctgttcaacattttggggggatgggtggccgcccaactcgccccccccagcgccgcttctgctttcgtaggcgccggcatcgccggcgcggccgttggtagcataggccttgggagggtgctagtggacatcttggcgggttatggagcgggggtggcaggcgccctcgtggcctttaaggtcatgagtggtgagatgccttccactgaggacttggtcaacttgctccctgccatcctctcccctggtgccctagtcgtcggggtagtgtgcgcagcaatactgcgtcggcatgtgggcccaggggaaggggctgtgcagtggatgaaccggctgatagcgttcgcttcgcggggtaaccacgtctcccccacgcactatgtgcccgagagcgacgctgcagcccgtgtcactcaggtcctctccagccttaccatcactcagctgctgaagaggctccatcagtggattaacgaggactgctccacgccatgctccggctcgtggctaagggatgtttgggactggatatgcacggtgttaactgattttaagacctggctccagtccaagctcctgccgcggttaccgggagtccccttcttctcatgccaacgtgggtacaagggcatctggcggggagacggcatcatgcaaaccacctgcccatgtggagcgcagatcaccggacatgtcaaaaacggttccatgaggatcgttgggcctaggacctgcagcaacacgtggcatggaacattccccatcaacgcatacaccacgggcccctgcacgccctctccggcgcccaattattctagggcgctgtggagggtggctgctgaggagtacgtggaggttacgagggtgggggatttccactacgtgacgggcatgaccactgacaacgtaaaatgcccatgccaggttccggcccccgaattcttcacggaggtggatggggtgcggctgcacaggtacgccccgccgtgcagacctctcctacgggatgaggtcgtattccaggtcgggctcaaccaatacccggtcgggtcacagctcccatgtgagcctgaaccggatgtggcggtgcttacttccatgctcaccgacccctcccacatcacagcagaggcggctaagcgtaggctggccagggggtctcccccctccttggccagctcttcggctagccagttgtctgcgccttccttgaaagcgacatgcactacccgtcatgactccccagatgctgacctcatcgaggccaatctcctgtggcggcaggagatgggcgggaacatcacccgcgtggagtcagagaacaaggtagtaattctggactctttcgagccgcttcgagcggaggaagatgagagggaagtatccgttccggcggaaatcctgcggagatccaggaaatttccccgagcgatgcccatatgggcaaggccggattacaaccctccactggtagagtcctggaaggacccggactacgtccctccggtggtacatgggtgcccattgccacctattaaggcccctccaataccacctccacggaggaagaggacggttgtcctgacagaatccaccgtgtcttctgccttggctgagctcgccacaaagaccttcggcagctccgaatcgtcggccgtcgacagcggcacggcgactgcccctcccgaccagccctccgacgacggcgacgcagggtccgatgttgagtcgtactcctccatgcccccccttgagggggagccgggggatcccgatctcagcgacgggtcttggtctaccgtgagcgaggaagctagtgaggatgtcgtctgttgctcgatgtcctacacgtggacgggcgccctgatcacaccatgctccgcggaggaaagcaagctgcccatcaacgcgttgagcaactctttgctgcgtcaccacaacatggtctatgccacaacatctcgcagcgcaagccagcggcagaagaaggtcacctttgacagactgcaggtcctggacgaccattaccgggacgtgctcaaggagatgaaggcgaaggcgtccacggttaaggctaagcttctatccgtagaagaagcctgcatgctgacgcccccacactcggccaaatccaaatttggctatggggcaaaggacgtccggagcctatccagcaaggccattaaccacatccactccgtgtggaaggacttgctggaagacactgagacaccaattgacaccaccatcatggcaaaaaatgaggttttctgcgtccaaccagagaaaggaggccgcaagccagctcgccttatcgtattcccagacttgggggttcgtgtgtgcgagaaaatggccctttatgacgtggtctccacccttcctcaggccgtgatgggctcctcatacgggttccaatactctcctggacagcgggtcgagttcctggtgaatgcctggaaaaaaaagaagaaccctatgggcttcgcatatgacacccgctgttttgactcaacagtcaccgagagtgacatccgtgttgaggagtcaatctaccaatgttgtgacttggcccccgaagccagacaggccataaggtcgctcacagagcggctttatatcgggggtcccttgactaactcaaaagggcagaactgcggttatcgccggtgccgcgcgagcggtgtgctgacgaccagctgcggtaataccctcacatgttacttgaaggcctctgcagcctgtcgagctgccaagctccaggactgcacgatgctcgtgtgcggagacgaccttgtcgttatctgtgaaagcgcgggaacccaggaggacgcggcgagcctacgagtcttcacggaggctatgactaggtactctgccccccccggggacccgcccaaaccagaatacgacttggagttgataacatcatgctcctccaatgtgtcggtcgcgcacgatgcatctggcaaaagggtgtactacctcacccgtgatcccaccaccccacttgcacgggctgcgtgggagacagctagacacactccagtcaactcctggctaggcaacatcatcatgtatgcgcccactctatgggcaaggatgatcctgatgactcacttcttctccatccttctagctcaggaacaacttgaaaaggctctagattgtcagatctacggggcctgttactccattgagccacttgacctacctcagatcattcagcgactccatggtcttagcgcattttcactccatagttactctccaggtgaaatcaatagggtggctgcatgcctcagaaaacttggggtaccacccttgcgagtctggagacatcgggccagaagtgtccgcgctaagctcctgtcccagggggggagggctgccaactgtggcaaatacctcttcaactgggcagtgaggaccaagcttaaactcactccaattccggctgcgtcccagttggacttgtccagctggttcgttgctggttacagcgggggagacatatatcacagcttgtctcgtacccgaccccgctggttcatgttgtgcctactcctactttccgtaggggtaggcatctacctgctccccaaccga

SEQ ID NO: 604 - DNA, 9359 bp, Hepatitis C Virus
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggcaggacctgggctcagcccgggtacccttggcccctctatggcaatgagggcatggggtgggcaggatggctcctgtcaccccgcggctctcggcctagttggggccccacggacccccggcgtaggtcgcgcaatttgggtaaggtcatcgataccctcacatgcggcttcgccgatctcatggggtacattccgctcgtcggcgcccccctagggggcgctgccagggccctggcgcatggcgtccgggtcctggaggacggcgtgaactacgcaacagggaatttgcccggttgctctttctctatcttcctcttggctttggtgtcctgtttgaccatcccagcttccgccattgaagtgcgcaacgtgtccgaagtgtaccatgtcacgaacgactgctccaacgcaagcattgtgtatgaggcagcggacatgattatgcatacccccgggtgcgtgccctgcgttcgggagggcaactcctcccactgctgggtagcgctcactcccacgctcgcggccaggaacttcagcatccccactacgacaatacggcgtcatgtcgatttgctcgttgggacggctgctttctgttccgctatgtacgtgggagatctttgcggatctgttttccttgtctctcagctgttcaccttctcgcctcgccggcatgtgacagtacaggactgcaattgctcaatctatcccggccacgtatcgggtcaccgcatggcttgggacatgatgatgaactggtcacctacaacagctctagtggtgtcgcagttactccggatcccacaagctgtcgtggacatggtggcgggagcccactggggagtcctggcgggcatcgcctactattccatggtggggaactgggctaaggtcttgattgtgatgctacttttttccggcgtcgacgggactactcacacgatgggggggacggcggcttttactatcagcaggtttacgagcttgttctcgcgtgggccggcccaaaagatccagcttataaacaccaacggcagctggcacatcaacaggaccgccctgaactgcaatgactccctcaacactgggttcatcgccgcgctgttctacgcccgcagtctcaactcgtccggatgcccggagcgcatggccagctgccgccccgttgacaagttcgctcaagggtggggtcccatcacttatgttaagccggccaagctggaccagaggccctactgctggcactacgcaccccaaccgtgtggtattgtgcccgcatcgcaggtgtgcggtccagtgtactgtttcactccaagccctgttgtggtggggacgaccgatcgtttcggcgtccctacgtatagctggggggagaacgagacggacgtgctgcttctcaacaacacgcggccgccgcaaggcaactggttcggctgcacgtggatgaatagcactgggttcaccaagacgtgcgggggccccccgtgcaacatcgggggggccggtaatgacaccttaatctgccccacggattgcttccggaagcaccccgaggccacttacaccaaatgcggttcgggaccctggctgacacctaggtgcatggttgactacccatacaggctttggcactacccctgcactgtcaactttaccatcttcaaggttaggatgtatgtggggggtgtggagcacaggctcaacgccgcatgcaactggacccgaggagagcgttgtgacttggaggacagagataggtcagagcttagcccgctgctgctgtctacaacagagtggcaggtactgccctgttccttcaccactctaccagccctgtccaccggcttgatccatctccatcggaacaccgtggacgtgcaatacctgtacggtatagggtcagcggttgtctcctatgcaattaagtgggagtacgtcctgttgctcttccttttcctggcggacgcgcgcgtctgtgcctgcttgtggatgatgctactaatagctcaggctgaggccgccttagagaacctggtggtcctcaatgcggcgtccgtagccggaacgcatggcattctctctttccttgtattcttctgtgctgcctggtacatcaagggcaggctggtccctggggcggcatatgctgtctatggtgtatggccgttgctcctgctcctgctggcgttgccaccacgggcatacgccatggaccgggagatggctgcatcgtgcggaggtgcggttcttataggtctagcacttttgaccttgtcaccacactataaggtgttcctcgccaggctcatatggtggttacaatactttatcaccagagccgaggcgcacttgcaggtgtggatcccccccctcaacgttcgggggggccgtgatgccatcatcctcctcatgtgcgcgatccacccagagctaatttttgccatcaccaaaaacttgctcgccatactcggcccgctcatggtgctccaggctggcataaccagggtgccgtactttgtgcgcgcccatgggcttattcgtgcatgcttgctggtgcggaaagtcgttgggggtcattatgtccaaatggctttcatgaggctggccgcgctgacaggcacgtacgtttatgaccatcttactccactgcgggactgggcccacgagggcctacgagaccttgcagtggcagttgagcccgtcgtcttctctgacatggagaccaagatcattacctggggggcagacaccgcggcgtgtggggacatcatctcaggcctgcctgtctccgcccgcagggggagggagatacttttgggaccggcagatagttttgaggggcaggggtggcggctccttgcgcccatcacggcctatgcccaacagacgcggggcctacttggctgcatcgtcaccagcctcacaggccgggacaagaaccaagtcgagggggaggttcaagtggtttccaccgcgacacaatccttcctggcgacctgcgtcaacggcgtgtgttggactgtctaccacggcgcgggcgcaaggactctcgccggccaaaagggcccaatcacccaaatgtacaccaatgtagaccaggacctcgtcggctggcaagcgcctcccggggcgcgatccttaacaccgtgcacctgtggcagctcggacctttacttggtcacgaggcatgctgatgtcattccggtgcgccggcggggcgacagcagaggaagcctactctcccccaggcccgtctcctacttgaagggctcttcgggtggtccactgctctgcccctcggggcatgctgtgggcatcttccgggctgctgtgtgcacccggggggttgcgaaggcggtggattttgtgcccgttgagtctatggaaacaactatgcggtccccggtcttcacggacaactcgtcccccccggccgtaccgcagacattccaggtggcccatctacacgctcccactggcagcggcaagagcactaaggtgccggctgcgtatgcagcccaagggtacaaggtgctcgtcctgaacccgtctgttgccgccaccctaggcttcggggcgtatatgtctaaggcacatggtgtcgaccctaacatcagaactggggtaaggaccatcaccacgggtgcccccattacgtactccacctatggcaagtttcttgccgacggtggttgctctgggggcgcctatgacatcataatatgtgatgagtgccactcaactgactcgactaccatcttgggcatcggcacagtcctggaccaagcggagacggctggagcgcgactcgtcgtactcgccaccgctacgcctccgggatcggtcaccgtgccacatcccaatatcgaggaggtggctctgtccaacagtggagagatccccttctatggtaaggccatccccatcgagaccatcaagggggggagacacctcatattttgccattccaagaaaaaatgtgatgagctcgccgcaaagctgtcggatctcgggcttaacgctgtagcgtattaccggggtcttgacgtgtccgtcataccgaccagcggagacgtcgttgtcgtggcaacagacgctctaatgacgggtttcaccggcgactttgactcagtgatcgactgtaatacatgtgtcacccagacagtcgacttcagcttggaccctaccttcaccattgagacgacgaccgtgccccaagacgcggtgtcacgctcgcagcggcgaggcaggactggtaggggcaggacaggcatctacaggtttgtgactccaggagaacggccctcgggcatgttcgattcctcggtcctgtgtgagtgctatgacgcgggctgtgcttggtacgagctcacgcccgccgagacctcagttaggttgcgggcttacctgaatacaccagggttgcccgtctgccaggaccatctggagttctgggagggcgtcttcacaggcctcacccacatagatgcccacttcctgtcccagactaaacaggcaggagacaacttcccctacttggtagcataccaagctacggtgtgcgccagagctcaggctccacccccatcgtgggaccaaatgtggaaatgtctcatacggctaaagcccacactgcacgggccaacacccctgctgtataggctaggagccgttcaaaatgaggtcaccctcacacaccccataaccaagttcatcatggcatgcatgtcggctgacctggaggtcgccacgagcacctgggtgctagtaggcggagtccttgcagctctggccgcgtattgcctgacaacaggcagcgtggtcattgtaggcaggatcatcttgtccgggaagccggctattgtacccgacagggaagtcctctaccagcagttcgatgagatggaagagtgcgctacacacctcccttacatcgaacaaggaatgcagctcgccgaacaattcaagcagaaggcactcgggttgttacagacagccaccaagcaagcagaggctgctgctcccgtggtggagtccaagtggcgagcccttgagagcttctgggcgaagcatatgtggaatttcatcagcgggatacaatacttggcaggcttgtccactctgcctgggaaccccgcaatagcatcacttatggcattcacagcctccatcaccagcccgttcaccacccaacataccctcctgttcaacatcttggggggatgggtggccgcccaactcgccccccccagcgccgcttctgctttcgtaggcgccggcatcgccggcgcggccgttggtagcataggccttgggagggtgctagtggacatcttggcgggttatggagcgggggtggcaggcgccctcgtggcctttaaggtcatgagtggtgagatgccttccactgaggacttggtcaacttgctccctgccatcctctcccctggtgccctagtcgtcggggtagtgtgcgcagcaatactgcgtcggcatgtgggcccaggggagggggctgtgcagtggatgaaccggctgatagcgttcgcttcgcggggtaaccacgtctcccccacgcactatgtgcccgagagcgacgctgcagcccgtgtcactcaggtcctctccagccttaccatcactcagctgctgaagaggctccatcagtggattaacgaggactgctccacgccatgctccggctcgtggctaagggatgtttgggactggatatgcacggtgttaactgattttaagacctggctccagtccaagctcctgccgcggttaccgggagtccccttcttctcatgccaacgtgggtacaagggcatctggcggggagacggcatcatgcaaaccacctgcccatgtggagcgcagatcaccggacatgtcaaaaacggttccatgaggatcgttgggcctaggacctgcagcaacacgtggcatggaacattccccatcaacgcatacaccacgggcccctgcacgccctctccggcgcccaattattctagggcgctgtggagggtggctgctgaggagtacgtggaggttacgagggtgggggatttccactacgtgacgggcatgaccactgacaacgtaaaatgcccatgccaggttccggcccccgaattcttcacggaggtggatggggtgcggctgcacaggtacgccccgccgtgcagacctctcctacgggatgaggtcgtattccaggtcgggctcaaccaatacccggtcgggtcacagctcccatgtgagcctgaaccggatgtggcggtgctcacttccatgctcaccgacccctcccacatcacagcagaggcggctaagcgtaggctggccagggggtctcccccctccttggccagctcttcggctagccagttgtctgcgccttccttgaaagcgacatgcactacccgtcatgactccccagatgctgacctcatcgaggccaatctcctgtggcggcaggagatgggcgggaacatcacccgcgtggagtcagagaacaaggtagtaattctggactctttcgagccgcttcgagcggaggaagatgagagggaagtatccgttccggcggaaatcctgcggagatccaggaaatttccccgagcgatgcccatatgggcaaggccggattacaaccctccactggtagagtcctggaaggacccggactacgtccctccggtggtacatgggtgcccattgccacctattaaggcccctccaataccacctccacggaggaagaggacggttgtcctgacagaatccaccgtgtcttctgccttggctgagctcgccacaaagaccttcggcagctccgaatcgtcggccgtcgacagcggcacggcgactgcccctcccgaccagccctccgacgacggcgacgcagggtccgatgttgagtcgtactcctccatgcccccccttgagggggagccgggggatcccgatctcagcgacgggtcttggtctaccgtgagcgaggaagctagtgaggatgtcgtctgttgctcgatgtcctacacgtggacgggcgccctgatcacaccatgctccgcggaggaaagcaagctgcccatcaacgcgttgagcaactctttgctgcgtcaccacaacatggtctatgccacaacatctcgcagcgcaagccagcggcagaagaaggtcacctttgacagactgcaggtcctggacgaccattaccgggacgtgctcaaggagatgaaggcgaaggcgtccacggttaaggctaggcttctatccgtagaagaagcctgcatgctgacgcccccacactcggccaaatccaaatttggctatggggcaaaggacgtccggagcctatccagcaaggccattaaccacatccactccgtgtggaaggacttgctggaagacactgagacaccaattgacaccaccatcatggcaaaaaatgaggttttctgcgtccaaccagagaaaggaggccgcaagccagctcgccttatcgtattcccagacttgggggttcgtgtgtgcgagaaaatggccctttatgacgtggtctccacccttcctcaggccgtgatgggctcctcatacgggttccaatactctcctggacagcgggtcgagttcctggtgaatgcctggaaaaaaaagaagaaccctatgggcttcgcatatgacactcgctgttttgactcaacagtcaccgagagtgacatccgtgttgaggagtcaatctaccaatgttgtgacttggcccccgaagccagacaggccataaggtcgctcacagagcggctttatatcgggggtcccttgactaactcaaaagggcagaactgcggctatcgccggtgccgcgcgagcggtgtgctgacgaccagctgcggtaacaccctcacatgttacttgaaggcctctgcagcctgtcgagctgccaagctccaggactgcacgatgctcgtgtgcggagacgaccttgtcgttatctgtgaaagcgcgggaacccaggaggacgcggcgagcctacgagtcttcacggaggctatgactaggtactctgccccccccggggacccgcccaaaccagaatacgacttggagttgataacatcatgctcctccaatgtgtcggtcgcgcacgatgcatctggcaaaagggtgtactacctcacccgtgatcccaccaccccacttgcacgggctgcgtgggagacagctagacacactccagtcaactcctggctaggcaacatcatcatgtatgcgcccactctatgggcaaggatgatcctgatgactcacttcttctccatccttctagctcaggaacaacttgaaaaggctctagattgtcagatctacggggcctgttactccattgagccacttgacctacctcagatcattcagcgactccatggtcttagcgcattttcactccatagttactctccaggtgaaatcaatagggtggctgcatgcctcagaaaacttggggtaccacccttgcgagtctggagacatcgggccagaagtgtccgcgctaagctcctgtcccagggggggagggctgccaactgtggcaaatacctcttcaactgggcagtgaggaccaagcttaaactcactccaattccggctgcgtcccagttggacttgtccagctggttcgttgctggttacagcgggggagacatatatcacagcgtgtctcgtacccgaccccgctggttcatgttgtgcctactcctactttccgtaggggtaggcatctacctgctccccaaccga

SEQ ID NO: 605 - DNA, 9359 bp, Hepatitis C Virus
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggtggcggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggcaggacctgggctcagcctgggtacccttggcccctctatggcaatgagggcatggggtgggcaggatggctcttgtcaccccgtggttctcggcctagttggggccccacggacccccggcgtaggtcgcgtaatttgggtaaggtcatcgataccctcacatgcggcttcgccgacctcatggggtacattccgctcgtcggcgcccccctagggggcgctgccagggccctggcgcatggcgtccgggtcctggaggacggcgtgaactatgcaacagggaatttgcccggttgctctttctctatcttcctcttggctttgctgtcctgtttgaccatcccagcttccgctatcgaagtgcgcaacgtgtccggagtgtaccatgtcacgaacgactgctccaacgcaagcattgtgtatgaggcagcggatatgattatgcatacccccgggtgcgtgccctgcgttcgggagaacaactcttcccgttgctgggtagcgctcactcccacgctcgcggccaggaactccagcattcccactacgtcaatacgacgtcacgtcgatttgctcgttgggacggctgctttctgctccgctatgtacgtgggagatctttgcggatctgttttccttgtctctcagctgttcaccttctcgccgcgccggcatgagacagtacaggactgcaattgttcaatctatcccggccacgtaacaggtcaccgcatggcttgggacatgatgatgaactggtcacctacaacagctctagtggtgtcacagttactccggatcccacaagctgtcttgaacgtggtagcgggagcccactggggagtcctggcgggcctcgcctactattccatggtggggaactgggctaaggtcttgattgtgatgctactttttgccggcgtcgacgggacgacttactcgacggggggggcacaggcccgtaatacctacaggcttgtgaacctcttttcgtctgggccgtcccaaaacgtccagcttataaacaccaacggcagctggcacatcaacaggactgccctgaactgcaatgacaccctcaagactgggtggcttgccgcgctgttctacacccacaaattcaacgcgtccggatgcacggagcgcatggccagctgccaccccattgacaagttcgctcaggggtggggtcccatcacttacgccaagccgcccagctcggaccagaagccctattgttggcactacgcaccccaaccgtgcggtattgtacccgcgtcgcaggtgtgcggtccagtgtactgtttcaccccaagccctgttgtggtggggacgaccgatcgtttcggcgttcctacgtatagatggggagagaatgagacggacgtgctgcttctcaacaacacgcggccgccgcgaggcaactggttcggctgcacatggatgaatagcactgggtttaccaagacgtgcgggggccccccgtgcgacatcggggggatcggtaataacaccttgacctgccccacggattgcttccggaagcaccccgaggccacttacaccaaatgcggttcggggccctggctgacacctaggtgcatggttgactacccatacaggctttggcactacccctgcactctcaatttttccatcttcaaggttaggatgtatgtggggggtgtggagcacaggctcgacgccgcgtgcaactggacccgaggagagcgttgtgacttggaggacagggatagatcagagcttagcccgctgctactgtctacaacagagtggcaggtattgccctgttccttcaccaccctaccggctctgtccactggcttgatccatctccatcagaacatcgtggacgtgcaatacctgtacggcatagggtcagcggttgtctcctacgcaattaagtgggagtacgtcctgttgctcttcctttacctggcggatgcgcgcgtctgtgcctgtttgtggatgatgctgctaatagctcaggctgaggccgccttagagaacttggtggtcctcaacgcggcgtccgtggccggaacgcacggcattcttcctttccttgtgttcttctgtgctgcctggtacatcaagggcaagctggtccctggggcagcatatgctttctatggcgtatggccgctgcttctgctcctgctgacgttgccgccacgagcatacgccatggaccgggagatggctgcgtcgtgcggaggcgcggtttttataggtctggcactcttgaccttgtcaccacactataaagtgttcctcgctaagctcatatggtggttacaatattttatcaccagagccgaggcgcacttgcaggtgtggatcccccccctcaacgttcgggggggccgcgatgccatcatcctcctcacgtgcgcgatccacccagagctagtctttgccatcaccaaaatcttgcttgccatacttggcccgctcatggtgctccaggctggcataaccagggtgccgtactttgtgcgcgcccatgggctcattcgtgcatgcttgctggtgcggaaggtcgctgggggtcattatgtccaaatggctttcatgaggctggccgcactgacaggcacgtacgtttataaccatcttactccactgcgggactgggcccatgagggcctacgggaccttgcagtggcagttgagcccgtcgtcttctctgacatggagaccaagattattacctggggggcagacaccgcggcgtgtggggacatcatcttaggcctgcccgtctccgcccgcagggggagggagatacttttgggaccggcagatagtcttgaggggcaggggtggcgactccttgcgcccatcacggcctatgcccaacagacgcggggcctacttggctgcatcatcaccagcctcacaggccgggacaagaaccaggtcgagggggaggttcaagtggtttccaccgcaacacaatctttcctggcgacctgcgtcaacggcgtgtgttggactgtctaccacggcgccggcacaaagaccctcgccggccaaaagggcccaatcacccaaatgtacaccaatgtagaccaggacctcgtcggctggcaagcgcctcccggggcgcgatccttgacgccgtgcacctgtggcagctcggacctttacttggtcacgaggcatgctgatgtcattccggtgcgccggcgaggcgacagcagaggaagcctactctcccccaggcccgtctcctacttgaagggctcttcgggtggtccactgctctgcccctcgggacatgctgtgggcatcttccgggctgctgtgtgcacccggggggttgcgaaggcggtggactttgtgcccgttgagtctatggaaacaactatgcggtccccggtcttcacggacaactcgtcccccccggccgtaccgcagacattccaagtggcccatctacacgcccctactggcagcggcaagagcactaaggtgccggctgcgtatgcagcccaagggtacaaggtacttgtcctgaacccgtctgttgccgccaccctgggtttcggggcgtatatgtctaaggcacatggtgtagaccctaacattagaaccggggtaaggaccatcaccacgggtgcccccattacgtactccacctatggcaagttccttgccgacggtggttgctctgggggcgcctatgacatcataatatgtgatgagtgccactcaactgactcgactaccatcttgggcatcggcacagtcctggaccaagcggagacggctggagcgcgactcgtcgtactcgccaccgctacgcctccgggatcagtcaccgtgccacatcccaatatcgaggaggtggctctgtccaacattggagagatccccttctatggcaaagccatccccatcgagaccatcaagggggggaggcacctcatattttgccattccaggaaaaaatgtgatgagctcgccgcaaagctgtcgggtctcgggcttaacgctgtagcgtattaccggggtcttgatgtgtccgtcataccgaccagcggagacgtcgttgtcgtggcaacagacgctctaatgacgggtttcactggcgactttgactcggtgatcgactgtaatacatgtgtcacccagacagtcgacttcagcttggaccctaccttcaccatcgagacgacaaccgtgccccaagacgcggtgtcgcgctcgcagcggcgaggcaggactggtaggggcagggcgggcatctacaggtttgtgactccaggagaacggccctcgggcatgttcgattcctcggtcctgtgtgagtgctatgacgcgggctgtgcttggtacgagctcacgcccgccgagacctcagttaggttgcgggcttacctgaatacaccagggttgcccgtttgccaggaccatctggagttctgggagggcgtcttcacaggcctcacccacatagatgcccactttttgtcccagactaagcaggcaggagacaacttcccctacttggtagcataccaggctacggtgtgcgccagagctcaggctccacccccatcgtgggaccaaatgtggaaatgtctcatacggctaaagcccacgctgcacgggccaacacccctgctgtataggctaggagccgtccaaaatgaggtcaccctcacacaccccataaccaaattcatcatggcatgcatgtcggctgacctggaggtcgccacgagcacctgggtgctagtaggcggagtcctcgcagctctggccgcgtattgcctgacaacaggcagcgtggtcattgtaggcaggatcatcttgtccggaaagccggctattgtacccgacagggaagtcctctaccaacagttcgatgagatggaagagtgcgctacacacctcccttacattgaacaaggaatgcagctcgccgaacaattcaagcagaaggcactcgggttgttacagacagccaccaagcaagcagaggctgctgctcccgtggtggagtccaagtggcgagcccttgagagcttctgggcgaagcatatgtggaatttcatcagcgggatacaatacttagcaggcttgtccactctgcctgggaaccccgcaatagcatcactgatggcattcacagcctctattaccagcccgctcaccaccaaccataccctcctgttcaacattttggggggatgggtggccgcccaactcgccccccccagcgctgcttctgctttcgtaggcgccggcatcgccggcgcggccgttggcagcataggccttgggaaggtgctagtggacattttggcgggttatggggcgggggtggcaggcgccctcgtggcctttaaggtcatgagtggtgagatgccttccactgaggacttggtcaacttgctccctgccatcctctcccctggtgccctagtcgtcggggtagtgtgcgcagcaatactgcgtcggcatgtgggcccaggggagggggctgtgcagtggatgaaccggctgatagcgttcgcttcgcggggtaaccacgtctcccccacgcactatgtgcccgagagcgacgctgcagcgcgtgtcactcagatcctctccagccttaccatcactcagctgctgaagaggctccatcagtggattaacgaggactgctccacgccatgctccggctcgtggttaagggacgtttgggactggatatgcacggtgttaactgattttaagacctggctccagtccaagctcctgccgcggttaccgggagtccccttcctctcatgccaacgtggatacaggggcatctggcggggagacggcatcatgcaaaccacctgcccatgtggagcgcagatcaccggacatgtcaaaaacggttccatgaggatcgttgggcctaggacctgcagcaacacgtggcatggaacattccccatcaacgcatacaccacgggcccctgcacgccctccccagcgcccaattattccagggcgttgtggagggtggctgctgaggagtacgtggaggttacgcgggtgggggatttccactacgtgacgggcatgaccactgacaacgtaaagtgcccatgccaggttccggcccccgaattcttcacggaggtggatggggtgcagctgcacaggtacgctccgccgtgcaaacctctcctacgggaggaggtcacattccaggtcgggctcaaccaatacctggtcgggtcacagctcccatgtgagcccgaaccggacgtagcggtgctcacttccatgctcaccgacccctcccacatcacagcagagacggctaagcgtaggctggccagggggtctcccccctccttagccagctcttcagctagccagttgtctgcgccttccttgaaggcgacatgcactacccgtcatgactccccagatgctgacctcatcgaggccaatctcctgtggcggcaggagatgggcgggaacatcacccgcgtggagtcagagaataaggtagtgattctggactccttcgagccgcttcgagcggaggaagatgagagggaagtatccgttcctgcggaaatcctgcggagatccaggaagtttccccgagcgatgcccatatgggcaaggccggattacaaccctccactgatagagtcctggaaggacccggactacgtccctccggtggtacatgggtgcccattgccacctactaaggcccctccaataccacctccacggaggaaaaggacggttgtcctgacagaatctaccgtgtcttctgccttggctgagctcgccacgaagaccttcggcagctccggatcgtcggccgtcgacagcggcacggcgaccggccctcctgaccagccctccgacgacggcgacgcggggtccgatgttgagtcgtactcctccatgcccccccttgagggggagccgggggatcccgatctcagcgacgggtcttggtctaccgtgagcgaggaagctagtgaggatgtcgtctgctgctcgatgtcctacacatggacaggcgccctgatcacgccatgctccgcggaggaaagcaagctgcccatcaacgcgttgagcaactccttgctgcgtcatcacaacatggtctatgccacaacatctcgcagcgcaagccagcggcagaagaaggtcacttttgacagactgcaagtcctggacgaccattaccgggacgtgctcaaggagatgaaggcgaaggcgtccacagttaaggctaaacttctatccgtagaagaagcctgcatgctgacgcccccacactcggccaaatccaaatttggctatggggcaaaggacgtccggaacctatccagcaaggccgttgaccacatcaactccgtgtggaaggacttgctggaagacactgagacaccaattgacaccaccatcatggcaaagaatgaggttttctgcgtccaaccagagaaaggaggccgcaagccagctcgccttatcgtattcccagatttgggggttcgtgtgtgcgagaaaatggccctttatgacgtggtctccacccttcctcaggccgtgatgggctcctcatacgggttccagtactctcctggacagcgggtcgagttcctggtgaatgcctggaaaaagaagaaaaaccctatgggcttttcatatgacacccgctgttttgactcaacggtcaccgagagtgacatccgtgttgaggagtcaatctaccaatgttgtgacttggcccccgaagccagacaggccataaggtcgctcacagaacggctttatatcgggggtcccctgactaactcaaaagggcagaactgcggttatcgccggtgccgcgcgagcggtgtgctgacgactagctgcggtaataccctcacatgttacttgaaggcctctgcagcctgtcgagctgccaagctccaggactgcacgatgctcgtgtgcggagacgaccttgtcgttatctgtgaaagcgcgggaacccaggaggacgcggcgagcctacgagtcttcacggaggctatgactaggtactctgctccccccggggacccgcccagaccagaatacgacttggagttgataacatcatgctcctccaatgtgtcggtcgcgcacgatgcagctggcaaaagggtgtactacctcacccgtgaccccaccaccccacttgcacgcgctgcgtgggagacagctagacacactccagtcaactcctggctaggcaacatcatcatgtatgcgcccactttatgggtaaggatggtcatgatgactcacttcttctccatccttctagcccaggaacaacttgaaaaggctctagattgtcagatttacggggccagttactccattgagccacttgacctacctcagatcattcagagactccatggtcttagcgcattttcactccatagttactctccaggtgaaatcaatagggtggctgcatgcctcagaaaacttggggtaccacccttgcgagtctggagacatcgggccagaagtgtccgcgctaagctcctgtcccagggggggagggctgccaactgtggcaaatacctcttcaactgggcagtaaggaccaagcttaagctcactccaattccggctgcgtccaagttggacttgtccagctggttcgttgctggttacagcgggggagacgtatatcacagcccgtctcgtgcccgaccccgctggctcatgttatgcctactcctactttccgtaggggtaggcatctacctgctccccaaccga

SEQ ID NO: 606 - DNA, 9359 bp, Hepatitis C Virus
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggtggcggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggcaggacctgggctcagcctgggtacccttggcccctctatggcaatgagggcatggggtgggcaggatggctcttgtcaccccgtggttctcggcctagttggggccccacggacccccggcgtaggtcgcgtaatttgggtaaggtcatcgataccctcacatgcggcttcgccgacctcatggggtacattccgctcgtcggcgcccccctagggggcgctgccagggccctggcgcatggcgtccgggtcctggaggacggcgtgaactatgcaacagggaatttgcccggttgctctttctctatcttcctcttggctttgctgtcctgtttgaccatcccagcttccgctatcgaagtgcgcaacgtgtccggagtgtaccatgtcacgaacgactgctccaacgcaagcattgtgtatgaggcagcggatatgattatgcatacccccgggtgcgtgccctgcgttcgggagaacaactcttcccgttgctgggtagcgctcactcccacgctcgcggccaggaactccagcattcccactacgtcaatacgacgtcacgtcgatttgctcgttgggacggctgccttctgctccgctatgtacgtgggagatctttgcggatctgttttccttgtctctcagttgttcaccttctcgccgcgccggcatgagacagtacaggactgcaattgttcaatctatcccggccacgtaacaggtcaccgcatggcttgggacatgatgatgaactggtcacctacaacagctctagtggtgtcacagttactccggatcccacaagctgtcttggacgtggtagcgggagcccactggggagtcctggcgggcctcgcctactattccatggtggggaactgggctaaggtcttgattgtgatgctactttttgccggcgtcgacggggacacttacacgacaggggcggcacaggcccgtaatgtccacaggtttgtgggcctcttttcgcctgggccgtcccaaaagatccagcttgtaaacaccaacggcagctggcacatcaacaggactgccctgaactgcaatgactccctcaacactgggtggcttgctgcgctgttctacacccgcaagttcaacgcgtccggatgcacggagcgcatggccagctgccgccccattgacaagttcgatcaggggtggggtcccatcacttacgccaagccgtccagctcggaccagaagccctattgttggcactacgcaccccaaccgtgcggtattgtacccgcgtcgcaggtgtgcggtccagtgtactgtttcaccccaagccctgttgtggtggggacgaccgatcgtttcggcgttcctacgtatagatggggagagaatgagacggacgtgctgcttctcaacaacacgcggccgccgcgaggcaactggttcggctgcacatggatgaatagcactgggtttaccaagacgtgcgggggccccccgtgcaacatcggggggattggtaatgacaccttgacctgccccacggattgcttccggaagcaccccgaggccacttacaccaaatgcggttcggggccctggctgacacctaggtgcatggttgactacccatacaggctttggcactacccctgcactctcaatttttccatcttcaaggttaggatgtatgtggggggtgtggagcacaggctcgacgccgcgtgcaactggacccgaggagagcgttgtgacttggaggacagggatagatcagagcttagcccgctgctactgtctacaacagagtggcaggtattgccctgttccttcaccaccctaccggctctgtccactggcttgatccatctccatcagaacatcgtggacgtgcaatacctgtacggcatagggtcagcggttgtctcctacgcaattaagtgggagtacgtcctgttgctcttcctttacctggcggatgcgcgcgtctgtgcctgtttgtggatgatgctgctaatagctcaggctgaggccgccttagagaacttggtggtcctcaacgcggcgtccgtggccggaacgcacggcattcttcctttccttgtgttcttctgtgctgcctggtacatcaagggcaagctggtccctggggcagcatatgctttctatggcgtatggccgctgcttctgctcctgctgacgttgccgccacgagcatacgccatggaccgggagatggctgcgtcgtgcggaggcgcggtttttataggtctggcactcttgaccttgtcaccacactataaagtgttcctcgctaagctcatatggtggttacaatattttatcaccagagccgaggcgcacttgcaggtgtggatcccccccctcaacgttcgggggggccgcgatgccatcatcctcctcacgtgcgcgatccacccagagctagtctttgccatcaccaaaatcttgcttgccatacttggcccgcttatggtgctccaggctggcataaccagggtgccgtactttgtgcgcgcccatgggctcattcgtgcatgcttgctggtgcggaaggtcgctgggggtcattatgtccaaatggctttcatgaggctggccgcactgacaggcacgtacgtttataaccatcttactccactgcgggactgggcccacgagggcctacgggaccttgcagtggcagttgagcccgtcgtcttctctgacatggagaccaagattattacctggggggcagacaccgcggcgtgtggggacatcatcttaggcctgcccgtctccgcccgcagggggagggagatactcttgggaccggcagatagtcttgaggggcaggggtggcgactccttgcgcccatcacggcctatgcccaacagacgcggggcctacttggctgcatcatcaccagcctcacaggccgggacaagaaccaggtcgagggggaggttcaagtggtttccaccgcaacacaatctttcctggcgacctgcgtcaacggcgtgtgttggactgtctaccacggcgccggcacaaagaccctcgccggccaaaagggcccaatcacccaaatgtacaccaatgtagaccaggacctcgtcggctggcaagcgcctcccggggcgcgatccttgacgccgtgcacctgtggcagctcggacctttacttggtcacgaggcatgctgatgtcattccggtgcgccggcgaggcgacagcagaggaagcctactctcccccaggcccgtctcctacttgaagggctcttcgggtggtccactgctctgcccctcgggacatgctgtgggcattttccgggctgctgtgtgcacccggggggttgcgaaggcggtggacttcgtgcccgttgagtctatggaaacaactatgcggtctccggtcttcacggacaactcgtcccccccggccgtaccgcagacattccaagtggcccatctacacgcccctactggtagcggcaagagcactaaggtgccggctgcgtatgcagcccaagggtacaaggtacttgtcctgaacccgtctgttgccgccaccctgggtttcggggcgtacatgtctaaggcacatggtgtagaccctaacatcagaaccggggtaaggaccatcaccacgggtgcccccattacgtactccacctatggcaagttccttgccgacggtggttgctctgggggcgcctatgacatcataatatgtgatgagtgccactcaactgactcgactaccatcttaggcatcggcacagtcctggaccaagcggagacggctggagcgcgactcgtcgtgctcgccaccgctacgcctccgggatcagtcaccgtgccacatcccaatatcgaggaggtggctctgtccaacattggagagatccccttctatggtaaagccatccccatcgagaccatcaagggggggaggcacctcatattttgccattccaggaaaaaatgtgatgagctcgccgcaaagctgtcgggtctcggccttaacgctgtagcgtattaccggggtctcgatgtgtccgtcataccgaccagcggagacgtcgttgtcgtggcaacagacgctctaatgacgggtttcactggcgactttgactcggtgatcgactgtaatacatgtgtcacccagacagtcgacttcagcttggaccctaccttcaccatcgagacgacaaccgtgccccaagacgcggtgtcgcgctcgcagcggcgaggcaggactggtaggggcagggcgggcatctacaggtttgtgactccaggagaacggccctcgggcatgttcgattcctcggtcctgtgtgagtgctatgacgcgggctgtgcttggtacgagctcacgcccgccgagacctcagttaggttgcgggcttacctgaatacaccagggttgcccgtctgtcaggaccatctggagttctgggagggcgtcttcacaggcctcacccacatagatgcccactttttgtcccagactaagcaggcaggagacaacttcccctacttggtagcataccaggctacggtgtgcgccagagctcaggctccacccccatcgtgggaccaaatgtggaaatgtctcatacggctaaagcccacgctgcacgggccaacacccctgctgtataggctaggagccgtccagaatgaggtcaccctcacacaccccataaccaaattcatcatggcatgcatgtcggctgacctggaggtcgccaccagcacctgggtgctggtaggcggagtcctcgcagctctggccgcgtattgcctgacaacaggcagcgtggtcattgtaggcaggatcatcttgtccggaaagccggctattgtacccgacagggaagtcctctaccaacagttcgatgagatggaagagtgcgctacacacctcccttacattgaacaaggaatgcagctcgccgaacaattcaagcagaaggcactcgggttgctacagacggccaccaagcaagcagaggctgctgctcccgtggtggagtccaagtggcgagcccttgagagcttctgggcgaagcatatgtggaatttcatcagcgggatacaatacttagcaggcttgtccactctgcctgggaaccccgcaatagcatcactgatggcattcacagcctctattaccagcccgctcaccaccaaccataccctcctgttcaacatcttggggggatgggtggccgcccaactcgccccccccagcgctgcttctgctttcgtaggcgccggcatcgccggcgcggccgttggcagcataggccttgggaaggtgctagtggacatcttggcgggttatggggcgggggtggcaggcgccctcgtggcctttaaggtcatgagtggtgagatgccttccactgaggacatggtcaacttgctccctgccatcctctcccctggtgccctagtcgtcggggtagtgtgcgcagcaatactgcgtcggcatgtgggcccaggggagggggctgtgcagtggatgaaccggctgatagcgttcgcttcgcggggtaaccacgtctcccccacgcactatgtgcccgagagcgacgctgcagcgcgtgtcactcagatcctctccagccttaccatcactcagctgctgaagaggctccatcagtggattaacgaggactgctccacgccatgctccggctcgtggttaagggacgtttgggactggatatgcacggtgttaactgattttaagacctggctccagtccaagctcctgccgcggttaccgggagtccccttcctctcatgccaacgtggatacaggggcatttggcggggagacggcatcatgcacaccacctgcccatgtggagcgcagatcaccggacatgtcaaaaacggttccatgaggatcgttgggcctaggacctgcagcaacacgtggcatggaacattccccatcaacgcatacaccacgggcccctgcacgccctccccagcgcccaattattccagggcgttgtggagggtggctgctgaggagtatgtggaggttacgcgggtgggggatttccactacgtgacgggcatgaccactgacaacgtaaagtgcccatgccaggttccggcccccgaattcttcacggaggtggatggggtgcagctgcacaggtacgctccgccgtgcaaacctctcctacgggaggaggtcacattccaggtcgggctcaaccaatacctggtcgggtcacagctcccatgtgagcccgaaccggacgtagcggtgctcacttccatgctcaccgacccctcccacatcacagcagagacggctaagcgtaggctggccagggggtctcccccctccttagccagctcttcagctagccagttgtctgcgccttccttgaaggcgacatgcactacccgtcatgactccccagatgctgacctcatcgaggccaatctcctgtggcggcaggagatgggcgggaacatcacccgcgtggagtcagagaataaggtagtgatcctggactccttcgagccgcttcgagcggaggaagatgagagggaagtatccgttcctgcggaaatcctgcggagatccaggaagtttccccgagcgatgcccatatgggcaaggccggattacaaccctccactgatagagtcctggaaggacccggactacgtccctccggtggtacatgggtgcccattgccacctactaaggcccctccaataccacctccacggaggaaaaggacggttgtcctgacagaatctactgtgtcttctgccttggctgagctcgccacgaagaccttcggcagctccggatcgtcggccgtcgacagcggcacggcgaccggccctcctgaccagccctccgacgacggcgacgcggggtccgatgttgagtcgtactcctccatgcccccccttgagggggagccgggggatcccgatctcagcgacgggtcttggtctaccgtgagcgaggaagctagtgaggatgtcgtctgctgctcgatgtcctacacgtggacaggcgccctgatcacgccatgctccgcggaggaaagcaagctgcccatcaacgcgttgagcaactccttgctgcgtcatcacaacatggtctatgccacaacatctcgcagcgcaagccagcggcagaagaaggtcacttttgacagactgcaggtcctggatgaccattatcgggacgtgctcaaggagatgaaggcgaaggcgtccacagttaaggctaaacttctatccgtagaagaagcctgcatgctgacgcccccacactcggccaagtccaaatttggctatggggcaaaggacgtccggaacctatccagcaaggccgttgaccacatcaactccgtgtggaaggacttgctggaagacactgagacaccaattgacaccaccatcatggcaaagaatgaggttttctgcgtccaaccagagaaaggaggccgcaagccagctcgccttatcgtattcccagatttgggggttcgtgtgtgcgagaagatggccctttatgacgtggtctccacccttcctcaggccgtgatgggctcctcatacgggttccagtactctcctggacagcgggtcgagttcctggtgaatgcctggaaaaagaagaaaaaccctatgggcttttcatatgacacccgctgttttgactcaacggtcaccgagagtgacatccgtgttgaggagtcaatctaccaatgttgtgacttggcccccgaagccagacaggccataaggtcgctcacagaacggctttatatcgggggtcccctgactaactcaaaagggcagaactgcggttatcgccggtgccgcgcgagcggtgtgctgacgactagctgcggtaataccctcacatgttacttgaaggcctctgcagcctgtcgagctgccaagctccaggactgcacgatgctcgtgtgcggagacgaccttgtcgttatctgtgaaagcgcgggaacccaggaggacgcggcgagcctacgagtcttcacggaggctatgactaggtactctgctccccccggggacccgcccagaccagaatacgacttggagttgataacatcatgttcctccaatgtgtcggtcgcgcacgatgcagctggcaaaagggtgtactacctcacccgtgaccccaccaccccacttgcacgcgctgcgtgggagacagctagacacactccagtcaactcctggctaggcaacatcatcatgtatgcgcccactttatgggtaaggatggtcatgatgactcacttcttctccatccttctagcccaggaacaacttgaaaaggctctagactgtcagatttacggggccagttactccattgagccacttgacctacctcagatcattcagagactccatggtctcagcgcattttcactccatagttactctccaggtgaaatcaatagggtggctgcatgcctcagaaaacttggggtaccacccttgcgagtctggagacatcgggccagaagtgtccgcgctaagctcctgtcccagggggggagggctgccaactgtggcaaatacctcttcaactgggcagtaaggaccaagcttaagctcactccaattccggctgcgtccaagttggacttgtccagctggttcgttgctggttacagcgggggagacgtatatcacagcccgtctcgtgcccgaccccgctggctcatgttatgcctactcctactttccgtaggggtaggcatctacctgctccccaaccga

SEQ ID NO: 607 - DNA, 9359 bp, Hepatitis C Virus
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggtggtggtcagatcgttggtggagtttacctgttgccgcgcaggggccccaggttgggtgtgcgcgcgactaggaagacttccgagcggtcgcaacctcgtggaaggcgacaacctatccccaaggctcgccgacccgagggcaggacctgggctcagcccgggtacccatggcccctctatggcaatgagggcatggggtgggcaggatggctcctgtcaccccgcggctctcggcctagttggggccccacggacccccggcgtaggtcgcgtaatttgggtaaggtcatcgataccctcacatgcggcttcgccgacctcatggggtacattccgctcgtcggcgcccccctagggggcgctgccagggccctggcgcatggcgtccgggtcctggaggacggcgtgaactatgcaacagggaatttgcccggttgctctttctctatcttcctcttggctttgctgtcctgtttgaccatcccagcttccgctatcgaagtgcgtaacgtatccggagtgtaccatgtcacgaacgactgctccaacgcaagcattgtgtatgaggcagcggacatgattatgcatacccccgggtgcgtgccctgcgttcgggagaacaactcctcccgctgctgggtagcactcactcccacgctcgcggccaggaactccagcatccccactacgacaatacgacgtcacgtcgatttgctcgttgggacggctgctttctgctccgctatgtacgtgggagatctttgcggatctgttttccttgtctctcaactgttcaccttctcgcctcgtcggcatgagacagtacaggactgcaattgctcaatctatcccggccacgtatcgggtcaccgcatggcttgggacatgatgatgaactggtcacctacaacagctctagtggtgtcgcagttactccggatcccacaagctgtcgtggacgtggtggcgggagcccactggggagtcctggcgggcctcgcctactattccatggtggggaactgggctaaggtcttgattgtgatgctactttttgccggcgtcgacggggagactcacacgactggggcggcggcggcccgtactacccgcaggtttgcgtccctcttttcgcctgggcccacccaaaaactccagcttataaacaccaacggcagctggcacatcaacaggactgccctgaactgcaatgactctctcaacactgggttcattgccacgctgttctacgcccacaaattcaacgactccggatgcccggcgcgcatggccagctgccgccccattgacaagttcgctcaggggtggggtcccatcacttacgctgagccgcccagtttggaccagaggccctattgctggcactacgcaccccgaccgtgcggtattgtacccgcgtcgcaggtgtgcggtccagtgtactgtttcaccccaagccctgttgtggtggggacgaccgatcgtttcggcgtccctacgtacagctggggggagaatgagacggacgtgctgcttcttaacaacacgcggccgccgcgaggcaactggttcggctgcacgtggatgaatggcactgggttcaccaagacgtgcgggggccctccgtgcaccatcgggggggtcggtaatgacaccttgatctgccccacggattgcttccggaagcaccccgaggccacttacaccaaatgcggttcggggccctggctgacacctaggtgcattgttgactacccatacaggctttggcactacccctgcactgtcaattttaccatcttcaagattaggatgtatgtggggggtgtggagcacaggctcaacgccgcatgcaactggacccgaggagagcgttgtgacttggaggacagggatagatcagagcttagcccgctgctgctgtctacaacagagtggcaggtattgccctgttccttcaccaccttaccggctctgtccaccggcttgatccatctccatcagaacatcgtggacgtgcaatacctgtacggtatagggtcagtggttgtctcctacgcaatcaagtgggagtatgtcctgttgctcttcctttacctggcggacgcgcgcgtctgtgcctgcttgtggatgatgctgctaatagctcaggctgaggccgccttagagaacttggtggtcctcaatgcggcgtccgtggccggaacgcatggcatcctctccttccttgtgttcttctgtgctgcctggtacatcaagggcaggctggtccctggggcggcatatgctgtctacggcgtatggccgctgctcctgctcctgctggcgctgccaccacgagcatacgccatggaccgggagatggctgcatcgtgcggaggtgtggtctttataggtctggcacttttgaccttgtcaccatactataaagtgttcctcgccaggctcatatggtggttacaatattttatcaccagagccgaggcgcacttgcaggtgtgggtcccccccctcaacgttcgggggggccgcgatgccatcatcctcctcatgtgcgcgatccacccagagctaatctttaccatcaccaaaatcttgctcgccatactcggcccgctcatggtgctccaggcaggcatagccagggtgccgtactttgtgcgcgcccatgggctcatccgtgcatgcttgctggtgcggaaagtcgctgggggtcattatgtccaaatggctttcatgaggctggctgcactgacaggcacgtacgtttatgaccatcttagtccactgcgggactgggcccacgcgggcctgcgagaccttgcagtggcagttgagcccgtcgtcttctctgacatggagaccaagatcatcacctggggggcagacaccgcggcgtgtggggacatcatcctaggcctgcccgtctccgcccgcagggggagggagatacttttgggaccggcagatagtcttgaggggcaggggtggcgactcctcgcgcccatcacggcctatgcccaacagacgcggggtctacttggctgcatcgtcaccagcctcacaggccgggacaagaaccaggtcgagggggaggttcaagtggtttctaccgcaacacaatctttcctggcgacctgcgtcaacggcgtgtgttggactgtctaccacggcgccggcacaaagaccctcgccggcccaaagggcccaatcacccaaatgtacaccaatgtagaccaagacctcgtcggctggcaagcgcctcccggggcgcgatccttgacaccgtgcacctgtggcagctcggacctttacttggtcacgaggcatgctgatgtcattccggtgcgccggcggggcgacagcagaggaagcctactctctcccaggcccgtctcctacttgaagggctcttcgggtggtccactgctctgcccctcggggcatgctgcgggcatcttccgggctgctgtgtgcacccggggggttgcgaaggcggtggactttgtgcccgttgagtctatggaaacaactatgcggtccccggtcttcacggacaactcgtcccccccggccgtaccgcagacattccaagtggcccatctacacgctcccactggcagcggcaagagcactaaggtgccggctgcgtatgcagcccaagggtacaaggtgctcgtcctgaacccgtctgttgccgccaccctaggtttcggggcgtatatgtctaaggcacatggtatcgaccccaacatcagaactggggtaaggaccatcaccacgggtgcccccattacgtactccacctacggcaagttccttgccgacggtggttgctctgggggcgcctacgacatcataatatgtgatgagtgccactcaactgactcgactaccatcttgggcatcggcacagtcctggaccaagcggagacggctggagcgcgactcgtcgtactcgccaccgctacgcctccaggatcggtcaccgtgccacatcccaatattgaggaggtggctctgtccaacactggagagatccccttctatggcaaagccatccccatcgagaccatcaagggggggaggcacctcatattttgccattccaggaaaaaatgtgatgagctcgccgcaaagctgtcgggcctcgggcttaacgctgtagcatattaccggggtcttgatgtgtccgtcataccgaccagcggagacgtcgttgtcgtggcaacagacgctctaatgacgggtttcactggcgactttgactcggtgatcgactgtaatacatgtgtcacccagacagtcgacttcagcttggaccctaccttcaccattgagacgacgaccgtgccccaagacgcggtgtcgcgctcgcagcggcgaggcaggactggtaggggcaggacaggcatctacaggtttgtgactccaggagaacggccctcgggcatgttcgactcctcggtcctgtgtgagtgctatgacgcgggctgtgcttggtatgagctcacgcccgccgagaccacagttaggttgcgggcttacctgaatacaccagggttgcccgtctgccaggaccatctggagttctgggagggcgtcttcacaggcctcacccacatagatgcccacttcctgtcccagactaagcaggcaggagacaacttcccctacttggtagcataccaggctacggtgtgcgccagggctcaggctccacccccatcgtgggaccaaatgtggaaatgtctcatacggctaaagcccacactgcacgggccaacacccctgctgtataggctaggagccgtccaaaatgaggtcaccctcacacaccccataaccaaattcatcacggcatgcatgtcggctgacctggaggtcgccacgagcacctgggtgctagtaggcggggtcctcgcagctctggccgcgtattgcctgacaacaggcagcgtggtcattgtaggcaggatcatcttgtccggaaagccggctgttatacctgacagggaagtcctctaccagcagttcgatgagatggaggagtgcgccacacacctcccttacattgaacaaggaatgcagctcgccgaacaattcaagcagaaggcactcgggttgctacagacagccaccaagcaagcagaggctgctgctcccgtggtggagtccaagtggcgagcccttgagagcttctgggcgaagcatatgtggaatttcatcagcgggatacaatacttagcaggcttgtccaccctgcctgggaaccccgcaatagcatcactgatggcattcacagcctctatcaccagcccgctcaccacccaacataccctcctgttcaacatcttggggggatgggtggccgcccaacttgccccccccagcgccgcttctgctttcgtgggcgccggcatcgccggcgcggccgttggcagcataggccttgggaaggtgctagtggacatcttggcgggttatggagcgggggtggcaggcgccctcgtggcttttaaggtcatgagtggtgagatgccttccactgaggacttggtcaacttgctccctgccatcctctcccctggtgccctagtcgtcggggtagtgtgcgcagcaatactgcgtcggcacgtgggcccaggggagggggccgtgcagtggatgaaccggctgatagcgttcgcttcgcggggtaaccatgtctcccccacgcactatgtgcccgagagcgacgctgcagcgcgtgtcactcagatcctctccagccttaccatcacccagctgttgaagaggctccatcagtggattaacgaggactgctccacgccatgctccggctcgtggctaagggacgtttgggactggatatgcacggtgttagctgattttaagacctggctccagtccaagctcctgccgcggttaccgggagtccccttcctctcatgccaacgtggatacaggggcgtctggcggggagacggcatcatgcaaaccacctgcccatgtggagcgcagattaccggacatgtcaaaaacggttccatgaggatcgttgggcctaggacctgcagcaacacgtggcatggaacattccccatcaacgcatacaccacgggcccctgcacgccctccccggcgcccaattattccagggcgctgtggagggtgactgctgaggagtacgtggaggttacgcgggtgggggatttccactacgtgacgggcatgaccaccgacaacgtaaagtgcccatgccaggttccggcccccgaattcttcacggaggtggatggggtgcggctgcacaggtacgctccgccgtgcaaacctctcctacgggaggaggtcacattccaggtcgggctcaaccaatacctggtcgggtcacagctcccatgtgagcccgaaccggatgtagcggtgctcacttccatgctcaccgacccctcccacatcacagcagaggcggctaggcgtaggctggccagggggtctcccccctccttggccagctcttcagctagccagctgtctgcgccttccttgaaggcgacatgcactacccgtcatgactccccagatgctgacctcatcgaggccaatctcctgtggcggcaggagatgggcgggaacatcacccgcgtggagtcagagaacaaggtagtaattctggactctttcgagccgcttcgagcggaggaagatgagagggaagtatccgttccggcggaaatcctgcggagatccaggaagtttccccgagcgatgcccatatgggcaaggccggattacaaccctccactggtggagtcctggaaggacccggactacgtccctccggtggtacatgggtgcccattaccacctactaaggcccctccaataccacctccacggaggaaaaggacggttgtcctgacagaatccaccgtctcttccgccttggctgagctcgccacaaagaccttcggcagctccgaatcgtcggccgtcgacagcggcacggcgaccgcccctcctgaccaggcctccgacgacggcgacgcagggtccgatgttgagtcgtactcctccatgcccccccttgagggggagccgggggaccccgatctcagcgacgggtcttggtctaccgtgagcgaggaagctagtgaggacgtcgtctgttgttcgatgtcctacacatggacaggcgccctgatcacgccatgttccgcggaggaaagcaagctgcccatcaacgcgttgagcaactctttgctgcgtcaccacaacatggtctatgccacaacatctcgcagcgcaagccagcggcagaagaaggtcacctttgacagactgcaagtcctggacgaccattaccgggacgtgctcaaggagatgaaggcgaaggcgtccacggttaaggctaaacttctatccgtagaggaagcctgcatgctgacgcccccacattcggccaaatccaaatttggctatggggcaaaggacgtccggagcctatccagcaaggccattaaccacatccgctccgtgtggaaggacttgctggaagacactgagacaccaattgacaccaccatcatggcaaaaaacgaggttttctgtgtccaaccagagaaaggaggccgcaagccagctcgccttatcgtattcccagacttgggggttcgtgtgtgcgagaaaatggccctttatgacgtggtctccacccttcctcaggccgtgatgggctcctcatacgggttccagtactctcctggacagcgggtcgagttcctggtgaatgcctggaaaaaaaagaaaaaccctatgggcttcgcatatgacacccgctgttttgactcaacggtcaccgagagtgacatccgtgttgaggagtcaatctaccaatgttgtgacttggcccccgaagccagacaggccataaggtcgctcacagagcggctttacatcgggggtcccctgactaactcaaaagggcagaactgcggttatcgccggtgccgcgcgagcggtgtgctgacgaccagctgcggtaataccctcacatgttacttgaaggcctctgcagcctgtcgagctgccaagctccaggactgcacgatgctcgtgtgcggagacgaccttgtcgttatctgtgaaagcgcgggaacccaggaggacgcggcgagcctacgagtcttcacggaggctatgactaggtactctgccccccccggggacccgcccaaaccagaatacgacttggagttgataacatcatgctcctccaatgtgtcggtcgcgcacgatgcatctggcaaaagggtgtactacctcacccgtgaccccaccaccccacttgcacgggctgcgtgggagacagctagacacactccagtcaactcctggctaggcaacatcatcatgtatgcgcccaccttatgggcaaggatgatcctgatgactcacttcttctccatccttctagctcaggaacaacttgaaaaggctctagattgtcagatctacggggcctgttactccattgagccacttgacctacctcagatcattcagcgactccatggtcttagcgcgttttcactccatagttattctccaggtgaaatcaatagggtggctgcatgcctcagaaaacttggggtaccacccttgcgagtctggagacatcgggccagaagtgtccgcgctaaactcctgtcccagggggggagggctgccaactgtggcaaatacctcttcaactgggcagtaaggaccaagcttaaactcactccaattccggctgcgtcccagttggacttgtccagctggttcgtcgctggttacagcgggggagacatatatcacagcttgtctcgtgcccgaccccgctggttcatgttgtgcctactcctactctccgtaggggtaggcatctacctgctccccaaccga

SEQ ID NO: 608 - DNA, 9359 bp, Hepatitis C Virus
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggtggtggtcagatcgttggtggagtttacctgttgccgcgcaggggccccaggttgggtgtgcgcgcgactaggaagacttccgagcggtcgcaacctcgtggaaggcgacaacctatccccaaggctcgccgacccgagggcaggacctgggctcagcccgggtacccatggcccctctatggcaatgagggcatggggtgggcaggatggctcctgtcaccccgcggctctcggcctagttggggccccacggacccccggcgtaggtcgcgtaatttgggtaaggtcatcgataccctcacatgcggcttcgccgacctcatggggtacattccgctcgtcggcgcccccctagggggcgctgccagggccctggcgcatggcgtccgggtcctggaggacggcgtgaactatgcaacagggaatttgcccggttgctctttctctatcttcctcttggctttgctgtcctgtttgaccatcccagcttccgctatcgaagtgcgtaacgtatccggagtgtaccatgtcacgaacgactgctccaacgcaagcattgtgtatgaggcagcggacatgattatgcatacccccgggtgcgtgccctgcgttcgggagaacaactcctcccgctgctgggtagcactcactcccacgctcgcggccaggaactccagcatccccactacgacaatacgacgtcacgtcgatttgctcgttgggacggctgctttctgctccgctatgtacgtgggagatctttgcggatctgttttccttgtctctcaactgttcaccttctcgcctcgtcggcatgagacagtacaggactgcaattgctcaatctatcccggccacgtatcgggtcaccgcatggcttgggacatgatgatgaactggtcacctacaacagctctagtggtgtcgcagttactccggatcccacaagctgtcgtggacgtggtggcgggagcccactggggagtcctggcgggcctcgcctactattccatggtggggaactgggctaaggtcttgattgtgatgctactttttgccggcgtcgacggggagactcacacgactgggggggcggtggcccgtaatacccacgggtttacgtccctcttttcgcgtgggtccgcccaaaagctccagcttataaacaccaacggcagctggcacatcaacaggactgccctgaactgcaatgactccctcaacactgggttccttgccgcgctgttctacgtccacaaattcaacgactccggatgcccggcgcgcatggccagctgccgccccattgacaagttcgctcaggggtggggtcccatcacttacgctgagccgcccagtttggaccagaggccctattgctggcactacgcaccccgaccgtgcggtattgtacccgcgtcgcaggtgtgcggtccagtgtactgtttcaccccaagccctgttgtggtggggacgaccgatcgtttcggcgtccctacgtacagctggggggagaatgagacggacgtgctgcttcttaacaacacgcggccgccgcgaggcaactggttcggctgcacgtggatgaatggcactgggttcaccaagacgtgcgggggccccccgtgcaccatcgggggggtcggtaatgacaccttgatctgccccacggattgcttccggaagcaccccgaggccacttacaccaaatgcggttcggggccctggctgacacctaggtgcattgttgactacccatacaggctttggcactacccctgcactgtcaattttaccatcttcaagattaggatgtatgtggggggtgtggagcacaggctcaacgccgcatgcaactggacccgaggagagcgttgtgacttggaggacagggatagatcagagcttagcccgctgctgctgtctacaacagagtggcaggtattgccctgttccttcaccaccttaccggctctgtccaccggcttgatccatctccatcagaacatcgtggacgtgcaatacctgtacggtatagggtcagtggttgtctcctacgcaatcaagtgggagtatgtcctgttgctcttcctttacctggcggacgcgcgcgtctgtgcctgcttgtggatgatgctgctaatagctcaggctgaggccgccttagagaacttggtggtcctcaatgcggcgtccgtggccggaacgcatggcatcctctccttccttgtgttcttctgtgctgcctggtacatcaagggcaggctggtccctggggcggcatatgctgtctacggcgtatggccgctgctcctgctcctgctggcgctgccaccacgagcatacgccatggaccgggagatggctgcatcgtgcggaggtgtggtctttataggtctggcacttttgaccttgtcaccatactataaagtgttcctcgccaggctcatatggtggttacaatattttatcaccagagccgaggcgcacttgcaggtgtgggtcccccccctcaacgttcgggggggccgtgacgccatcatcctcctcatgtgcgcgatccacccagagctaatctttaccatcaccaaaatcttgctcgccatactcggcccgctcatggtgctccaggcaggcatagccagggtgccgtactttgtgcgcgcccatgggctcatccgtgcatgcttgctggtgcggaaagtcgctgggggtcattatgtccaaatggctttcatgaggctggctgcactgacaggcacgtacgtttatgaccatcttagtccactgcgggactgggcccacgcgggcctgcgagaccttgcagtggcagttgagcccgtcgtcttctctgacatggagaccaagatcatcacctggggggcagacaccgcggcgtgtggggacatcatcctaggcctgcccgtctccgcccgcagggggagggagatacttttgggaccggcagatagtcttgaggggcaggggtggcgactcctcgcgcccatcacggcctatgcccaacagacgcggggtctacttggctgcatcgtcaccagcctcacaggccgggacaagaaccaggtcgagggggaggttcaagtggtttctaccgcaacacaatctttcctggcgacctgcgtcaacggcgtgtgttggactgtctaccacggcgccggcacaaagaccctcgccggcccaaagggcccaatcacccaaatgtacaccaatgtagaccaagacctcgtcggctggcaagcgcctcccggggcgcgatccttgacaccgtgcacctgtggcagctcggacctttacttggtcacgaggcatgctgatgtcattccggtgcgccggcggggcgacagcagaggaagcctactctctcccaggcccgtctcctacttgaagggctcttcgggtggtccactgctctgcccctcggggcatgctgcgggcatcttccgggctgctgtgtgcacccggggggttgcgaaggcggtggactttgtgcccgttgagtctatggaaacaactatgcggtccccggtcttcacggacaactcgtcccccccggccgtaccgcagacattccaagtggcccatctacacgctcccactggcagcggcaagagcactaaggtgccggctgcgtatgcagcccaagggtacaaggtgctcgtcctgaacccgtctgttgccgccaccctaggtttcggggcgtatatgtctaaggcacatggtatcgaccccaacatcagaactggggtaaggaccatcaccacgggtgcccccattacgtactccacctacggcaagttccttgccgacggtggttgctctgggggcgcctacgacatcataatatgtgatgagtgccactcaactgactcgactaccatcttgggcatcggcacagtcctggaccaagcggagacggctggagcgcgactcgtcgtactcgccaccgctacgcctccgggatcggtcaccgtgccacatcccaatattgaggaggtggctctgtccaacactggagagatccccttctatggcaaagccatccccatcgagaccatcaagggggggaggcacctcatattttgccattccaggaaaaaatgtgatgagctcgccgcaaagctgtcgggcctcgggcttaacgctgtagcatattaccggggtcttgatgtgtccgtcataccgaccagcggagacgtcgttgtcgtggcaacagacgctctaatgacgggtttcactggcgactttgactcggtgatcgactgtaatacatgtgtcacccagacagtcgacttcagcttggaccctaccttcaccattgagacgacgaccgtgccccaagacgcggtgtcgcgctcgcagcggcgaggcaggactggtaggggcaggacaggcatctacaggtttgtgactccaggagaacggccctcgggcatgttcgactcctcggtcctgtgtgagtgctatgacgcgggctgtgcttggtatgagctcacgcccgccgagaccacagttaggttgcgggcttacctgaatacaccagggttgcccgtctgccaggaccatctggagttctgggagggcgtcttcacaggcctcacccacatagatgcccacttcctgtcccagactaagcaggcaggagacaacttcccctacttggtagcataccaggctacggtgtgcgccagggctcaggctccacccccatcgtgggaccaaatgtggaaatgtctcatacggctaaagcccacactgcacgggccaacacccctgctgtataggctaggagccgtccaaaatgaggtcaccctcacacaccccataaccaaattcatcacggcatgcatgtcggctgacctggaggtcgccacgagcacctgggtgctagtaggcggggtcctcgcagctctggccgcgtattgcctgacaacaggcagcgtggtcattgtaggcaggatcatcttgtccggaaagccggctgttatacctgacagggaagtcctctaccagcagttcgatgagatggaggagtgcgccacacacctcccttacattgaacaaggaatgcagctcgccgaacaattcaagcagaaggcactcgggttgctacagacagccaccaagcaagcagaggctgctgctcctgtggtggagtccaagtggcgagcccttgagagcttctgggcgaagcatatgtggaatttcatcagcgggatacaatacttagcaggcttgtccaccctgcctgggaaccccgcaatagcatcactgatggcattcacagcctccatcaccagcccgctcaccacccaacataccctcctgttcaacatcttggggggatgggtggccgcccaacttgccccccccagcgccgcttctgctttcgtgggcgccggcatcgccggcgcggccgttggcagcataggccttgggaaggtgctagtggacatcttggcgggttatggagcgggggtggcaggcgccctcgtggcttttaaggtcatgagtggtgagatgccttccactgaggacttggtcaacttgctccctgccatcctctcccctggtgccctagtcgtcggggtagtgtgcgcagcaatactgcgtcggcacgtgggcccaggggagggggccgtgcagtggatgaaccggctgatagcgttcgcttcgcggggtaaccatgtctcccccacgcactatgtgcccgagagcgacgctgcagcgcgtgtcactcagatcctctccagccttaccatcacccagctgttgaagaggctccatcagtggattaacgaggactgctccacgccatgctccggctcgtggctaagggacgtttgggactggatatgcacggtgttagctgattttaagacctggctccagtccaagctcctgccgcggttaccgggagtccccttcctctcatgccaacgtggatacaggggcgtctggcggggagacggcatcatgcaaaccacctgcccatgtggagcgcagattaccggacatgtcaaaaacggttccatgaggatcgttgggcctaggacctgcagcaacacgtggcatggaacattccccatcaacgcatacaccacgggcccctgcacgccctccccggcgcccaattattccagggcgctgtggagggtgactgctgaggagtacgtggaggttacgcgggtgggggatttccactacgtgacgggcatgaccaccgacaacgtaaagtgcccatgccaggttccggcccccgaattcttcacggaggtggatggggtgcggctgcacaggtacgctccgccgtgcaaacccctcctacgggaggaggtcacattccaggtcgggctcaaccaatacctggtcgggtcacagctcccatgtgagcccgaaccggatgtagcggtgctcacttccatgctcaccgacccctcccacatcacagcagaggcggctaggcgtaggctggccagggggtctcccccctccttggccagctcttccgctagccagctgtctgcgccttccttgaaggcgacatgcactacccgtcatgactccccagatgctgacctcatcgaggccaatctcctgtggcggcaggagatgggcgggaacatcacccgcgtggagtcagagaacaaggtagtaattttggactctttcgagccgcttcgagcggaggaagatgagagggaagtatccgttccggcggaaatcctgcggagatccaggaaatttccccgagcgatgcccatatgggcaaggccggattacaaccctccactggtggagtcctggaaggacccggactacgtccctccggtggtacatgggtgcccattaccacctactaaggcccctccaataccacctccacggaggaaaaggacggttgtcctgacagaatccaccgtctcttccgccttggctgagctcgccacaaagaccttcggcagctccgaatcgtcggccgtcgacagcggcacggcgaccgcccctcctgaccaggcctccgacgacggcgacacagggtccgatgttgagtcgtactcctccatgcccccccttgagggggagccgggggaccccgatctcagcgacgggtcttggtctaccgtgagcgaggaagctagtgaggacgtcgtctgttgttcgatgtcctacacatggacaggcgccctgatcacgccatgttccgcggaggaaagcaagctgcccatcaacgcgttgagcaactctttgctgcgtcaccacaacatggtctatgccacaacatctcgcagcgcaagccagcggcagaagaaggtcacctttgacagactgcaggtcctggacgaccattaccgggacgtgctcaaggagatgaaggcgaaggcgtccacggttaaggctaaacttctatccgtagaggaagcctgcatgctgacgcccccacattcggccaaatccaaatttggctatggggcaaaggacgtccggagcctatccagcaaggccattaaccacatccgctccgtgtggaaggacttgctggaagacactgagacaccaattgacaccaccatcatggcaaaaaacgaggttttctgtgtccaaccagagaaaggaggccgcaagccagctcgccttatcgtattcccagacttgggggttcgtgtgtgcgagaaaatggccctttatgacgtggtctccacccttcctcaggccgtgatgggctcctcatacgggttccagtactctcctggacagcgggtcgagttcctggtgaatgcctggaaaaaaaagaaaaaccctatgggcttcgcatatgacacccgctgttttgactcaacggtcaccgagagtgacatccgtgttgaggagtcaatctaccaatgttgtgacttggcccccgaagccagacaggccataaggtcgctcacagagcggctttacatcgggggtcccctgactaactcaaaagggcagaactgcggttatcgccggtgccgcgcgagcggtgtgctgacgaccagctgcggtaataccctcacatgttacttgaaggcctctgcagcctgtcgagctgccaagctccaggactgcacgatgctcgtgtgcggagacgaccttgtcgttatctgtgaaagcgcgggaacccaggaggacgcggcgagcctacgagtcttcacggaggctatgactaggtactctgccccccccggggacccgcccaaaccagaatacgacttggagttgataacatcatgctcctccaatgtgtcggtcgcgcacgatgcatctggcaaaagggtgtactacctcacccgtgaccccaccaccccacttgcacgggctgcgtgggagacagctagacacactccagtcaactcctggctaggcaacatcatcatgtatgcgcccaccttatgggcaaggatgatcctgatgactcacttcttctccatccttctagctcaggaacaacttgaaaaggctctagattgtcagatctacggggcctgttactccattgagccacttgacctacctcagatcattcagcgactccatggtcttagcgcgttttcactccatagttattctccaggtgaaatcaatagggtggctgcatgcctcagaaaacttggggtaccacccttgcgagtctggagacatcgggccagaagtgtccgcgctaaactcctgtcccagggggggagggctgccaactgtggcaaatacctcttcaactgggcagtaaggaccaagcttaaactcactccaattccggctgcgtcccagttggacttgtccagctggttcgtcgctggttacagcgggggagacatatatcacagcttgtctcgtgcccgaccccgctggttcatgttgtgcctactcctactctccgtaggggtaggcatctacctgctccccaaccga

SEQ ID NO: 609 - DNA, 9359 bp, Hepatitis C Virus
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggatgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaagttgggtgtgcgcgcgactaggaagacttccgagcggtcgcaacctcgtggaaggcgacaacctatccccaaggctcgccggcccgagggcaggacctgggctcagcccgggtacccttggcccctctatggcaatgagggcatggggtgggcaggatggctcctgtcaccccgtggctctcggcctagttggggccccacggacccccggcgtaggtcgcgtaatttgggtaaggtcatcgataccctcacatgcggcttcgccgatctcatggggtacattccgctcgtcggcgcccccctagggggcgctgccagggccctggcgcatggcgtccgggtcctggaggacggcgtgaactatgcaacagggaatttgcccggttgctctttctctatcttcctcttggctttgctgtcttgtttgaccatcccagcttccgctatcgaagtgcgcaacgtgtccggagtgtaccatgtcacgaacgactgctccaacgcaagcattgtgtatgaggcagcggacatgattttgcatacccccgggtgcgtgccctgcgttcgggagaacaactcctcccgctgctgggtagcgctcactcccacgctcgcggccaggaactccagcatccccactacgacaatacgacgtcacgtcgatttgctcgttgggacggctgctttctgctccgctatgtacgtgggagatctttgcggatctgttttccttgtctctcagctgttcaccttctcgcctcgccggcatgagacagtacaggactgcaattgctcaatctatcccggccacgtaacgggtcatcgcatggcttgggacatgatgatgaactggtcacccacaacagctctagtggtgtcgcaattactccggatcccacaagctgtcttggacatggtggcgggagcccactggggagtcctggcgggcctcgcctactattccatggtggcgaactgggctaaggtcttgattgtgatactactttttgccggcgtcgacggggagactcatgtgacggggggggtgaatgcccgtactacccacagcctcacgtccttcttttcaactgggccggcccaaaacatccagcttataaacaccaacggcagctggcacatcaacaggactgccctgaactgcaatgattccctcaacactgggtttcttgccgcgctgttctactttcgcagattcaactcgtccggatgcccggagcgcatggccagttgccgccccattgacaagttcgctcaggggtggggtcccatcacttacattaagccgcccgtcttggaccagaagccctattgctggcactacgcaccccaaccgtgcggtattgtacccgcgtcacaggtgtgtggtccagtgtactgtttcaccccaagccctgttgtggtggggacgaccgatcggttcggcgtccctacgtataactggggggagaatgagacggacgtgctgcttctcaacaacacgcggccgccgcgaggcaactggttcggctgcacgtggatgaatggcactgggttcaccaagacgtgcgggggccccccgtgcaacatcgggggggtcggtaatgacaccttgacctgccccacggattgcttccggaagcaccccgaggccacttacaccaaatgcggttcggggccctggctcacacctaggtgcatggttgactacccatataggctttggcactacccctgcactgtcaattttaccatttttaaggttaggatgtacgtggggggtgtggagcacaggttcaacgccgcatgcaactggacccgaggagaacgttgtgacttggaggacagggatagatcagagcttagcccgctgctgctgtctacaacagagtggcagatattgccctgttccttcaccaccctaccggctctgtccaccggcttgatccatctccatcgaaacaccgtggacgtgcaatacctgtacggtatagggtcagcggttgtctcctacgcgattaagtgggagtacgtcctgttgctcttccttttcctggcggacgcgcgcgtctgtgcctgcttgtggatgatgctgctaatagctcaggctgaggccctcttagagaacttggtggtcctcaatgcagcgtccgtggccggaatgcatggtattctctctttccttgtgttcttctgtgctgcctggtacatcaagggcaggctggtccctggggcggcatatgctatctatggcgtatggccgctgctcctgctcctgctggcgttgccaccacgagcatacgccatggaccgggagatggctgcgtcgtgcggaggcgcggttttcataggtctggtacttttgaccttatcaccatactacaaagtgttcctcgccaggctcatatggtggttacaatactttatcaccagagccgaggcgcacttgcaggtgtggatcccccccctcaacgttcgggggggccgcgatgccatcatcctcctcatgtgcgcgatccacccagagctaatctttgccatcaccaaaattttgctcgccatactcggcccgctcatggtgctccaggctggcataaccagggtgccgtactttgtgcgcgcccatgggcttattcgtgcatgcttgctggtgcggaaggtcgctgggggccattatgtccaaatggctctcatgaggctggccgcactgacgggcacgtacgtttatacccatcttgctccactgcgggactgggcccacgagggcctacgagaccttgcagtggcagttgagcccgttgtcttctctgacatggagaccaagatcatcacctggggggcagacaccgcggcgtgtggggacatcatcttaggcctgcccgtctccgcccgcagggggagggagatacttttgggaccggcagatagtcttgaggggcaggggtggcgactccttgcgcccatcacggcttatgcccaacagacgcggggcctgtttggctgcatcgtcaccagcctcacaggccgggacaagaaccaggtcgagggggaggttcaagtggtttccaccgcaacacaatctttcctggcgacctgcatcaacggcgtgtgttggactgtctaccacggtgctggcacaaagaccctcgccggccaaaagggcccaatcactcaaatgtacaccaatgtagaccaggacctcgtcggctggcaagcgcctcccggggcgcggtccttgacaccgtgcacctgtggcagctcggacctttacttggtcacgaggcatgctgatgtcattccggtgcgccggcgaggcgacagcagaggaagcctactctcccccaggcccgtctcctacttgaagggctcttcgggtggtccactgctctgcccctcggggcatgctgtgggcatcttccgggctgctgtgtgcacccggggggttgcgaaggcagtggactttgtgcccgttgagtctatggaaacaactatgcggtctccggtcttcacggacaactcgtcccctccggccgtaccgcagacatttcaagtggcccatctacacgctcccactggcagcggcaagagcactaaggtgccggctgcgtatgcagcccaagggtacaaggtactcgtcctgaacccgtctgtagccgccaccctaggtttcggggcgtatatgtctaaggcacatggtatcgaccctagcatcagaactggggtaaggaccatcaccacaggtgcccccattacgtactccacctatggcaagtttcttgccgacggtggctgctctgggggcgcctatgacatcataatatgtgatgagtgccactcaactgactcaactaccatcttgggcatcggcacagtcttggaccaagcggagacggctggagcgcgactcgtcgtactcgccaccgctacgcctccgggatcggtcaccgtgccacatcccaatatcgaggaggtggccctgtccaacactggagagatccccttctatggtaaagccattcccatcgagactatcaagggggggaggcacctcatattctgccattccaagaaaaaatgtgatgagctcgccgaaaagctgtcgagtctcgggcttaacgctgtagcgtattaccggggtcttgatgtgtccgtcataccgaccagcggagacgtcgttgtcgtggcaacagacgctctaatgacgggtttcactggcgactttgactcagtgatcgactgtaatacatgtgtcacccagacagtcgacttcagcttagaccctaccttcaccattgagacgacgaccgtgccccaagacgcggtgtcgcgctcgcagcggcgaggtaggactggtaggggcaggacaggcatctacaggtttgtgactccaggagaacggccctcgggcatgttcgattcttcggtcctgtgtgagtgctatgacgcgggctgtgcttggtacgagctcacgcccgccgagacctcagttaggttgcgggcttacctgaatacaccagggttgcccgtctgccaggaccatctggagttctgggagggcgtcttcacaggcctcacccacatagatgcccacttcctgtcccagactaagcaggcaggagacaacttcccctacttggtagcataccaggctacggtgtgcgccagggctcaggctccacccccatcgtgggaccaaatgtggaaatgtctcatacggctgaagcccacgctgcacgggccaacacccctgctgtataggctaggagccgtccagaatgaggtcaccctcacacaccccgtaaccaaattcatcacggcatgcatgtcggctgacctggaggtcgccacgagcacctgggtgctagtaggcggagtcctcgcagccctggccgcgtattgcctgacaacaggcagcgtggtcattgtaggcagggtcatcttgtccggaaggccggctattgtacccgacagggaagtcctctaccagcagttcgatgagatggaagagtgtgccacacacctcccttacattgaacaaggaatgcagctcgccgaacaattcaagcagaaggcactcgggttgttacagacagccaccaagcaagcagaggctgctgctcccgtggtggagtccaagtggcgagcccttgagagcttctgggcgaagcatatgtggaatttcatcagcgggatacaatacttagcaggcttgtccactctgcctgggaaccccgcgatagcatcactgatggcatttacagcctctatcaccagcccgctcaccacccaacataccctcctgttcaacattttggggggatgggtggccgcccaactggctccccccagcgctgcttctgctttcgtaggcgccggcatcgccggcgcggccgttggcagcataggccttgggaaggtgctagtggacatcttggcaggttatggagcgggggtggcaggcgctctcgtggcctttaaggtcatgagtggtgagatgccttccactgaggacttggtcaacttgctccccgccatcctctcccctggtgccctagtcgtcggggtagtgtgcgcagcaatactgcgtcggcatgtgggcccaggggagggggctgtgcagtggatgaaccggctgatagcgttcgcttcgcggggtaaccatgtctcccccacgcactatgtgcccgagagcgacgctgcagcgcgtgtcactcagatcctctccagcctcaccatcactcagctgctgaagaggctccatcagtggattaacgaggactgctccacgccatgctccggctcgtggctaagggacgtttgggactggatatgcacggtgttaaccgattttaagacctggctccagtccaagctcctgccgcggttaccgggagtccccttcctctcatgccaacgtgggtacaagggcatctggcggggagacggcatcatgcaaaccacctgcccgtgtggagcgcagatcaccggacatgtcaaaaacggttccatgaggatcgtcgggcctaggacctgcagcaacacgtggcatggaacattccccatcaacgcatacaccacgggcccctgcacgccctccccggcgccaaactattcaagggcgctgtggagggtagctgctgaggagtacgtagaggttacgcgggtgggagatttccactacgtgacgggcatgaccactgacaacgtaaagtgcccatgccaggttccggcccccgaattcttcacggaggtggatggggtgcgtctgcacaggtacgctccgccgtgcagacctctcctacgggaggaggtcacgttccaggtcgggctcaaccaatacctggtcgggtcacagctcccatgcgagcccgaaccggatgtagcggtgctcacttccatgctcaccgacccctcccacatcacagcagaggcggctaagcgtaggctggccagggggtctcccccctccttagccagctcttcagctagccaattgtctgcgccttccttgaaggcgacatgcactacccgtcatgactccccagatgctgacctcatcgaggccaatctcctgtggcggcaggagatgggcgggaacatcacccgcgtggagtcagagaacaaggtagtaattctggactctttcgagccgcttcgagcggaggaagatgagagggaagtatccgttccggcggaaatcctgcggagatccaggaaatttccccgggcgatgcccatatgggcaaggccggattacaaccctccactggtagagtcctggaaggacccggactatgtccctccggtggtacatgggtgcccattgccacctactaaggcccctccaataccacctccacggaggaaaaggacggttgtcctgacagaatccaccgtgtcttctgccttggctgagctcgccacaaagaccttcggcagctccgagtcgtcggccgtcgacagcggcacggcgagcgcctctcctgaccagccctctgacgacggcgacgcagggtccgatgctgagtcgtactcctccatgcccccccttgagggggagccgggggatcccgatctcagtgacgggtcttggtctaccgtgagcgaggaagctagcgaggacgtcgtctgctgctcgatgtcctacacatggacaggcgccttgatcacgccatgctccgcggaggaaagcaagctgcctatcaacgcgctgagcaactctttgctgcgccaccacaacatggtctatgccacaacatctcgcagcgcatgccaacggcagaagaaggtcacctttgacagactgcaggtcctggacgaccattaccgggacgtgctcaaggagatgaaggcgaaggcgtccacggttaaggctaaacttctatccgtagaagaagcctgcatgctgacgcccccacactcggccaaatccaaatttggctatggggcaaaggacgtccggagcctatccagcaaggccattaaccacattcgctccgtgtggaaggacttgctggaagacactgagacaccaattgacaccaccatcatggcaaaaaatgaggttttctgcgtccaaccagagaaaggaggccgcaagccagcccgccttatcgtattcccagacctgggggttcgtgtgtgcgagaaaatggccctttatgatgtggtctccacccttcctcaggccgtgatgggctcctcatacgggttccagtactctcctggacagcgggtcgagttcctggtgaatgcctggaaaaaaaagaagaaccctatgggcttcgcgtatgacacccgctgctttgactcaacggtcacggagagtgacattcgtgttgaggagtcaatctatcaatgttgtgacttggcccctgaagccagacaggccataaggtcgctcacagagcggctttatatcgggggtcccctgactaactcaaaggggcagaactgcggctatcgccggtgccgcgcgaccggtgtgctgacgaccagctgcggtaataccctcacatgttacttgaaggcctctgcagcctgtcgagctgccaagctccaggactgcacaatgctcgtgtgcggagacgaccttgtcgtcatctgtgagagcgcgggaacccaggaggacgcggcgagcctacgagtcttcacggaggctatgactaggtactctgccccccccggggacccgcccaaaccagaatacgacttggagttgataacatcatgctcctccaatgtgtcggtcgcgcacgatgcatctggcaaaagggtgtactacctcacccgtgaccccaccaccccacttgcacgagctgcgtgggagacagctagacacactccagtcaactcctggctaggcaacatcatcatgtatgcgcccaccttatgggcaaggatgatcctgatgactcacttcttctccatccttctagctcaggaacagcttgaaaaggctctagattgtcaaatctacggggcctgttactccattgagccacttgacctacctcagatcattcagcgactccatggtcttagcgcattctcactccatagttactctccaggtgaaatcaatagggtggctgcatgcctcagaaaacttggggtaccacccttgcgagtctggagacatcgggccagaagtgtccgcgctaagctcctgtcccagggggggagggctgccaactgtggtaaatacctcttcaactgggcagtaaggaccaagctcaaactcactccaattccggctgcgtcccagttggacttgtccagctggttcgttgctggttacagcgggggagacatatatcacagcctgtctcgtgcccgaccccgctggttcatgttgtgcctactcctactttccgtaggggtaggcatctacctgctccccaaccga

SEQ ID NO: 610 - DNA, 9359 bp, Hepatitis C Virus
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggatgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaagttgggtgtgcgcgcgactaggaagacttccgagcggtcgcaacctcgtggaaggcgacaacctatccccaaggctcgccggcccgagggcaggacctgggctcagcccgggtacccttggcccctctatggcaatgagggcatggggtgggcaggatggctcctgtcaccccgtggctctcggcctagttggggccccacggacccccggcgtaggtcgcgtaatttgggtaaggtcatcgataccctcacatgcggcttcgccgatctcatggggtacattccgctcgtcggcgcccccctagggggcgctgccagggccctggcgcatggcgtccgggtcctggaggacggcgtgaactatgcaacagggaatttgcccggttgctctttctctatcttcctcttggctttgctgtcttgtttgaccattccagtttccgctatcgaagtgcgcaacgtgtccggagtgtatcatgtcacgaacgactgctccaacgcaagcattgtgtttgaggcagcggacatgattatgcatacccccgggtgcgtgccctgcgttcgggagaacaactcctcccgctgctgggtagcgctcactcccacgctcgcggccaggaactccagcatccccactacgacaatacgacgtcacgtcgatttgctcgttgggacggctgctttctgctccgctatgtacgtgggagatctttgcggatctgttttcctcgtctctcagctgttcaccttctcgcctcgccggcatgagacagtacaggactgcaattgctcaatctatcccggccacgtaacgggtcatcgcatggcttgggatatgatgatgaactggtcacccacaacagctctagtggtgtcgcagctactccggatcccacaagctgtcttggacatggtggcgggagcccactggggagtcctggcgggcctcgcctactattccatggtggcgaactgggctaaggtcttgattgtgatgctactttttgccggcgtcgacggggagactcatgtgacggggggggtgagtgcccgtactacctacaggctcacgaccttcttatcaactgggccggcccaaaacatccagcttataaacaccaacggcagctggcacatcaacaggactgccctgaactgcaatgattccctcaacactgggtttcttgctgcactgttctactttaacagattcaactcgcccggatgcccggagcgcatggccagctgccgacacattgacaagttcgctcaggggtgggggcccatcacttacatcaagccgcccgtcttggaccagaagccctattgctggcactacgcaccccaaccgtgcggtattgtacccgcgtcacaggtgtgcggtccagtgtactgttttaccccaagccctgttgtggtggggacgaccgatcgtctcggcgtccctacgtatagctggggggagaatgagacggacgtgctgcttctcaacaacacgcggccgccgcgaggcaactggttcggctgcacatggatgaatggcactgggttcaccaagacgtgcgggggccccccgtgcaacatcgggggggtcggtaatgacaccttgacctgccccacggattgcttccggaagcaccccgaggccacttacaccaaatgtggttcggggccctggctgacacctaggtgcatggttgactacccatataggctttggcactacccctgcactgtcaattttaccatctttaaggtcaggatgtacgtggggggtgtggagcacaggttcaacgccgcatgcaactggacccgaggagaacgttgtgacttggaggacagggacagaacagagcttagcccgctgctgctgtctacaacagagtggcagatattgccctgttccttcaccaccctaccggctctgtccaccggcctgatccatctccatcgaaacaccgtggacgtgcaatacctgtacggtatagggtcagcggttgtctcctacgcgattaagtgggagtacgtcctgttgctcttccttttcctggcggacgcgcgcgtctgtgcctgcttgtggatgatgctgctgatagctcaggctgaggccgtcttagagaacttggtggtcctcaatgcggcgtccgtggccggaacgcatggtgttctctctttccttgtgttcttctgtgctgcctggtacatcaagggcaggctggtccctggggcggcatatgctatctatggcgtatggccgctgctcctgctcctgctggcgttgccaccacgagcatacgccatggaccgggagatggctgcatcgtgcggaggcgcggttttcataggtctggtacttctgaccttatcaccatactataaagtgttcctcgccaggctcatatggtggttacaatactttatcaccagagccgaggcgcacttgcatgtgtggatcccccccctcaacgttcgggggggccgcgacgccatcatcctcctcatgtgcgcgatccacccagagctaatctttgccatcaccaaaattttgctcgccatactcggcccgctcatggtgctccaggctggcataaccagggtgccgtactttgtgcgcgcccatgggcttattcgtgcatgcttgctggtgcggaaggtcgctgggggccattatgttcaaatggctctcatgaggctagccgcactgacgggcacgtacgtttataaccaccttgctccactgcgggactgggcccacgagggcctacgagaccttgcagtggcagttgagcccgttgtcttctctgacatggagaccaagatcattacctggggggcagacaccgcggcgtgtggggacatcatcttaggcctgcccgtctccgcccgcagggggagggagatacttttgggaccggcagatagtcttgaggggcaggggtggcgactccttgcgcccatcacggcttatgcccaacagacgcggggcctgtttggctgcattgtcaccagcctcacaggccgggacaagaaccaggtcgagggggaggttcaagtggtttccaccgcaacacaatctttcctggcgacctgcatcaacggcgtgtgttggactgtctaccatggtgccggcacaaagaccctcgccggccaaaagggcccaatcactcaaatgtacaccaatgtagaccaggacctcgtcggctggcaagcgcctcccggggcgcggtccttgacaccgtgcacctgtggcagctcggacctttacttggtcacgagatatgctgatgtcattccggtgcgccggcgaggtgacagcagagggagcctgctctcccccaggcccgtctcctacttgaagggctcctcgggtggtccactgctctgcccctcggggcatgctgtgggcatcttccgggctgccgtgtgcacccggggggttgcgaaggcagtggactttgtgcctgttgagtctatggaaacaactatgcggtctccggtcttcacggacaattcgtcccccccggccgtaccgcagacatttcaagtggcccatctacacgctcccactggcagcggcaagagcactaaggtgccggctgcgtatgcagcccaagggtacaaggtactcgtcctgaacccgtctgtagccgctaccctaggtttcggggcgtatatgtctaaggcacatggtattgaccctaacattagaactggggtaaggaccatcaccacgggtgcccccattacgtactccacctatggcaagtttcttgccgacggtggttgctctgggggcgcctatgacatcataatatgtgatgagtgccactcaactgactcgactaccatcttgggcattggcacagtcttggaccaagcggagacggctggagcgcgactcgtcgtactcgccaccgctacgcctccgggatcggtcaccgtgccacatcccaatatcgaggaggtggctctgtccaacactggagagatccccttctatggtaaagccattcccatcgagactatcaagggggggaggcacctcatattctgccattccaagaaaaaatgtgatgagctcgccgtaaagctgtcgagtctcgggcttaacgctgtagcgtactaccggggtcttgatgtgtccgtcataccgaccagcggagacgtcgttgtcgtggcaacagacgctctaatgacgggtttcaccggcgactttgactcagtgatcgactgtaatacatgtgtcacccagacagtcgacttcagcttagaccctaccttcaccattgagacgacgaccgtgccccaagacgcggtgtcacgctcgcagctgcgaggtaggactggtagtggcacgacaggcatgtacaggtttgtgactccaggagaacggacctcgggcatgttcgattcctcggtcctgtgtgagtgctatgacgcgggctgtacttggtacgagcttacgcccgccgagacctcagttaggttgcgggcttacctgaatgcaccagggttgcctgtctgccaggaccatctggagttctgggagggcgtcttcacaggcctcaccaagatagatgcccacttcatgtctcagactaagcaggcaggagacaacttcccctacttggtagcataccaggctacggtgtgcgccagggctcaggctccacccccatcgtgggaccaaatgtggaaatgtctcatacggctaaagcccacgctgcacgggccaacacccctgctgtataggttaggagccgtccagaatgaggtcaccctcacacaccccataaccaaattcatcatggcatgcatgtcggctgacctggaggtcgccacgagcacctgggtgctagtaggcggagtcctcgcagccttggccgcgtattgcctgacaacaggcagcgtggtcattgtaggcagggtcatcttgtccggaaggccggctattgtacccgacagggaagtcctctaccagcagttcgatgagatggaagagtgtgccacacacctcccttatattgaacaaggaatgcagctcgccgaacagtttaagcagaaggcactcgggttgttacagacagccaccaagcaagcagaggctgctgctcccgtggtggagtccaagtggcgagcccttgagagcttctgggcgaagcatatgtggaatttcatcagcgggatacaatacttagcaggcttgtccactctgcctgggaaccccgcaatagcatcactgatggcatttacagcctctatcaccagcccgctcaccacccaacatactctcctgttcaacattttggggggatgggtggccgcccaactggctccccccagcgctgcttctgctttcgtaggcgccggcatcgccggcgcggccgttggcagcataggccttgggaaggtgctagtggacatcttggcaggttatggagcgggggtggcaggcgctctcgtggcctttaaggtcatgagtggtgagatgccttccactgaggacttggtcaacttgctccccgccatcctctcccctggtgccctagtcgtcggggtagtgtgcgcagcaatactgcgtcggcatgtgggcccaggggagggggctgtgcagtggatgaaccggctgatagcgttcgcttcgcggggtaaccatgtctcccccacgcactacgtgcccgagagcgacgctgcagcgcgtgtcactcagatcctctccagcctcaccatcactcagctgctgaagaggctccatcagtggattaacgaggactgctccacgccatgctccggctcgtggctaagggacgtttgggactggatatgcacggtgttaactgattttaagacctggctccagtccaagctcctgccgcggttaccgggagtccccttcctctcatgtcaacgtgggtacaagggcatctggcggggagacggcatcatgcaaaccacctgcccatgtggagcgcagatcaccggacatgtcaaaaatggttccatgaggatcgttgggcctaggacctgcagcaacacgtggcatggaacatttcccatcaacgcatacaccacgggcccttgcacgccctccccggcgccaaactattctagggcgctgtggagggtagctgctgaggagtacgtggaggttacgcgggtgggagatttccactacgtgacgggcatgactactgacaacgtaaagtgcccatgtcaggttccggcccccgaattcttcacggaggtggatggggtgcgtctgcacaggtacgctccaccgtgcagacctctcatacgggaggaggtcacattccaggtcggactcaaccaatacctggtcgggtcacagctcccatgtgagcccgaaccggatgtggcggtgctcacttccatgctcaccgacccctcccacatcacagcagaggcggctaagcgtaggctggccagggggtctcccccctccttagccagctcttcggctagccaattgtctgcgccttccctgaaggcgacatgcactacccgtcatgactccccagatgctgacctcatcgaggccaatctcctgtggcggcaggagatgggcgggaacatcacccgcgtggagtcagagaataaggtagtaattctggactctttcgagccgcttcgagcggaggaagatgagagggaagtatccgtcccagcggaaatcctgcggagatccaggaagtttcccctggcgatgcccgtatgggcaaggccggattacaaccctccactggtagagtcctggaaggacccggactatgttcctccggtggtacatgggtgcccattgccacctactacggcccctccaataccacctccacggaggaaaaggacggttgtcctgacagaatccaccgtgtcttctgccttggctgagctcgccacaaagaccttcggcagctccgagtcgtcggccgccgacagcggcacggcgagcgcccctcctgaccagccctccgacgacggcgacgcagggtccgatgctgagtcgtactcctccatgcccccccttgagggggagccgggggatcccgatctcagtgacgggtcttggtctaccgtgagcgaggaagctagcgaggacgtcgtctgctgctcgatgtcctacacatggacaggtgccttgatcacgccatgttccgcggaggaaagcaagctgcccatcaacgcgctgagcaactctttgctgcgccaccacaacatggtctatgccacaacatctcgcagcgcatgccaacggcagaagaaggtcacctttgacagactgcaggtcctggacgaccattaccgggacgtgctcaaggagatgaaggcgaaggcgtccacggttaaggctaaacttctatccgtagaagaagcctgtatgctgacgcccccacactcggccaaatccaaatttggctacggggcaaaggacgtccggagcctatccagcaaggccgttaaccacattcgctccgtgtggaaggacttgctggaagacactgagacaccaattgacaccaccatcatggcaaaaaatgaggttttctgcgtccaaccagagaaaggaggccgcaagccagctcgccttatcgtattcccagacctgggggttcgtgtatgcgagaaaatggccctttatgatgtggtctccacccttcctcaggccgtgatgggctcctcatacgggttccagtactctcctggacagcgggtcgagttcctggtgaatgcctggaaaaaaaagaagaaccctatgggcttcgcatatgacacccgctgttttgactcaacggtcacagagagtgacatccgtgttgaggagtcaatctatcaatgttgtgacttggcccccgaagccagacaggccataaggtcgctcacagagcggctttatatcgggggtcccctaactaactcaaaggggcagaactgcggttatcgccggtgccgcgcgagcggtgtgctgacgaccagctgcggtaataccctcacatgttacttgaaggcctctgcagcctgtcgagctgccaagctccaggactgcacaatgctcgtgtgcggagacgaccttgtcgtcatctgtgagagcgcggggacccaggaggacgcggcgagcctacgagtcttcacggaggctatgactaggtactctgccccccccggggacccgcccaaaccagaatacgacttggagttgattacatcatgctcctccaatgtgtcggtcgcgcacgatgcatctggcaaaagggtgtactatctcacccgtgatcccaccaccccgcttgcacgagctgcgtgggagacagctagacacactccagtcaactcctggctaggcaacatcatcatgtatgcgcccaccttatgggcaaggatgatcctgatgactcacttcttctccatcctcctagctcaggaacagcttgaaaaggctctagattgtcaaatctacggggcctgttactccattgagccacttgacctacctcagatcattcagcgactccatggtcttagcgcattctcactccatagttactctccaggtgaaatcaatagggtggctgcatgcctcagaaaacttggggtaccacccttgcgagtctggagacatcgggccagaagtgtccgcgctaagctcctgtcccagggggggagggctgccaactgtggtaaatacctcttcaactgggcagtaaggaccaagcttaagctcactccaattccggctgcgtcccagttggacttgtccagctggttcgttgctggttacagcgggggagacatatatcacagcctgtctcgtgcccgaccccgctggttcatgctgtgcctactcctactttccgtaggggtaggcatctacctgctccccaaccga

SEQ ID NO: 611 - DNA, 9359 bp, Hepatitis C Virus
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccctaggttgggtgtgcgcgcgactaggaagacttccgagcggtcgcaacctcgtggaaggcgacaacctatccccaaggctcgccggcccgagggcaggacctgggctcagcccgggtacccttggcccctctatggcaatgagggcatggggtgggcaggatggctcctgtcaccccgcggctctcggcctagttggggccccacggacccccggcgtaggtcgcgtaatttgggtaaggtcatcgataccctcacatgcggcttcgccgacctcatggggtacattccgctcgtcggcgcccccctagggggcgctgccagggccctggcgcatggcgtccgggtcctggaggacggcgtgaactatgcaacagggaatttgcccggttgctctttctctatcttcctcttggctttgctgtcctgtttgaccatcccagcttccgctatcgaagtgcgcaacgtgtccggagtgtaccatgtcacgaacgactgctccaacgcaagtattgtgtatgaggcagcggacatgattatgcatacccccgggtgcgtgccctgcgttcgggaggacaactcctcccgctgctgggtagcgctcactcccacgctcgcggccaggaactccagcatccccactacgacaatacgacgtcacgtcgacttgctcgttgggacggctgctttctgctccgctatgtacgtgggagatctttgcggatctgttttccttgtctctcagctgttcaccttctcgcctcgccggcatgagacagtgcaggactgcaattgctcaatctatcccggccacgtatcgggtcaccgcatggcttgggacatgatgatgaactggtcacctacaacagctctagtggtgtcgcagttactccggatcccacaagctgtcgtggacatggtggcgggagcccactggggagtcctggcgggcctcgcctactattccatggtggggaactgggctaaggtcttgattgtgatgctactttttgccggcgtcgacgggaggacttacacgacggggggggcggcggcccataccacccatgggcttacgtccttctttacgcttgggccgtcccaaaacatccagcttataaacaccaacggcagctggcacatcaacaggactgccctgaactgcaatgactccctcaacactgggttccttgccgcgctgttctacgcccacagattcaactcgtccggatgcccggagcgcatggccagctgtcgccccattgacaagttcgttcaggggtggggtcccatcacttacggtaagccgcccagcttggaccagaggccctattgttggcactacgcaccccaaccgtgcggtattgtacccgcgtcgcaggtgtgcggtccagtgtactgtttcaccccaagccctgttgtggtggggacgaccgatcgtttcggcgtccctacgtatagctggggggagaatgagacggacgtgctgcttctcaacaacacgcggccgccgcgaggcaactggttcggctgcacatggatgaatggcactgggttcaccaagacgtgcgggggccccccgtgcaacatcgggggggccggtaacgacaccttgatctgccccacggattgcttccggaagcaccctgaggccacttacaccaaatgcggttcggggccctggctgacacctaggtgcatggttgactacccatacaggctttggcactacccctgcactgtcaattttaccatcttcaaggttaggatgtatgtggggggtgtggagcacaggctcaacgccgcatgcaactggacccgaggagagcgttgtgacttggaggacagggatagatcagagcttagcccgctgctgctgtctacaacagagtggcaggtattgccctgttccttcaccaccctaccggctctgtccaccggcttgatccatctccatcggaacatcgtggacgtgcaatacctgtacggtatagggtcagcggttgtctcctacgcaattaagtgggagtatgtcctgttgctcttccttttcctggcggacgcgcgcgtctgtgcctgcttgtggatgatgctgctaatagctcaggctgaggccgccttagagaacttggtggtcctcaatgcggcgtccgtggccggaacgcatggcattctctctttccttgtgttcttctgtgctgcctggtacatcaagggcaggctggtccctggggcggcatatgctttctatagcgtatggccgctgctcctgctcctgctggcgttgccaccacgagcatacgccatggaccgggagatggctgcatcgtgcggaggcgcggtttttataggtctggcactcttgaccttgtcaccacactataaagtgttcctcgccaagctcatatggtggttacaatattttatcaccagagccgaggcgcacttgcaggtgtggatcccccccctcaacgttcgggggggccgcgatgccatcatcctcctcatgtgcgcgatccacccagagctaatctttaccatcaccaaaatcttgctcgccatactcggcccgctcatggtgctccaagctggcataaccagggtgccgtactttgtgcgcgcccatgggctcattcgtgcatgcttgctggtgcggaaagtcgctgggggtcattatgtccaaatggctttcatgaggctggccgcactgacaggcacgtacgtttataaccatcttactccactgcgggactgggcccacgagggcctacgagaccttgcagtggcagttgagcccgtcatcttctctgacatggagaccaagatcattacctggggggcagacaccgcggcgtgtggggacatcatctcaggcctgcccgtctccgcccgcagggggagggagatacttttgggaccggcagatagtcttgaggggcaggggtggcgactccttgcgcccatcacggcctatgcccaacagacgcggggcctacttggctgcatcgtcaccagcctcacaggccgggacaagaaccaggtcgagggggaggttcaagtggtttccaccgcaacacaatccttcctggcgacctgcatcaacggcgtgtgttggactgtctaccacggcgccggcacaaagaccctcgccggccaaaagggcccaatcacccaaatgtacaccaatgtagaccaggacctcgtcggctggctagcgcctcccggggcgcgatccttgacaccgtgcacctgtggcagctcggacctttacttggtcacgaggcatgctgatgtcattccggtgcgccggcggggcgacagcagagggagcctactctcccccaggcccgtctcctacttgaagggctcttcgggtggtccactgctctgcccctcggggcatgctgtaggcatcttccgggctgctgtgtgcacccggggggttgcgaaggcggtggactttgtgcccgttgagtctatggaaacaactatgcggtccccggtcttcacggacaactcgtcccccccggctgtaccgcagacattccaagtggcccatctacacgctcccactggcagcggcaagagcactaaggtgccggctgcgtatgcagcccaagggtacaaggtactcgtcctgaacccgtctgttgccgccaccctaggtttcggggcgtatatgtctaaggcacatggtgtcgaccctagcatcagaactggggtaaggaccatcaccacgggtgcccccattacgtactccacttatggcaagtttcttgccgacggtggttgctctgggggcgcctatgacatcataatatgcgatgagtgccactcaactgactcgactaccatcttgggcatcggcacagtcctggaccaagcggagacggctggagcgcgactcgtcgtactcgccaccgctacgcctccgggatcggtcaccgtgccacatcccaatatcgaggaagtggctctgtccaacactggagagatccccttctatggtaaagccatccccatcgagaccatcaagggggggaggcacctcatattttgccattccaggaaaaaatgtgatgagctcgccgcaaagctgtcgagtctcgggcttaacgctgtagcgtattaccggggtctcgatgtgtccgtcataccgaccagcggagacgtcgttgtcgtggcaacggacgctctaatgacgggtttcactggcgactttgactcagtgatcgactgtaatacatgtgtcacccagacagtcgacttcagcttggaccctaccttcaccattgagacgacgaccgtgccccaagacgcggtgtcgcgctcgcagcggcgaggcaggactggtaggggcaggatgggcatctacaggtttgtgactccaggagaacggccctcgggcatgttcgattcctcggtcctgtgtgagtgctatgacgcgggctgtgcttggtacgagctcacgcccgccgagacctcagttaggttgcgggcttacctgaatacaccagggttgcccgtttgccaggaccatctggagttctgggagggcgtcttcacaggcctcacccacatagatgcccacttcctgtcccagactaagcaggcaggagacaacttcccctacttggtagcatatcaggctacggtgtgcgccagggctcaggctccacccccatcgtgggaccaaatgtggaaatgtctcatacggctaaagcccacgctgcacgggccaacacccctgctgtataggctaggagccgtccaaaatgaggtcaccctcacacaccccataaccaaattcatcatggcatgcatgtcggctgacctggaggtcgccacgagcacctgggtgctagtaggcggagtcctcgcagctctggccgcgtattgcctgacaacaggcagcgtggtcattgtaggcaggatcatcttgtccggaaagccggctgttctacctgacagggaagtcctctaccagcagttcgatgagatggaagagtgcgctacacaccttccttacattgaacaaggaatgcagctcgccgaacaattcaagcagaaggcactcgggttgttacagacagccaccaagcaagcggaggctgctgctcccgtggtggagtccaagtggcgagcccttgagagcttctgggcgaagcatatgtggaatttcatcagcgggatacaatacttagcaggcttgtccactctgcctgggaaccccgcaatagcatcactgatggcattcacagcctctatcaccagcccgctcaccacccaacataccctcctgttcaacattttggggggatgggtggccgcccaactcgccccccccagcgccgcttctgctttcgtaggcgccggcatcgccggcgcggccgttggcagcataggccttgggaaggtgctagtggacatcttggcgggttatggagcgggggtggcgggcgccctcgtggcctttaaggtcatgagtggtgagatgccttccactgaggacttggtcaacttgctccctgctatcctctcccctggtgccctagtcgtcggggtagtgtgcgcagcaatactgcgtcggcatgtgggcccaggggagggggctgtgcagtggatgaaccggctgatagcgttcgcttcgcggggtaaccacgtctcccccacgcactatgtgcccgagagcgacgctgcagcgcgtgtcactcagatcctctccagcctcaccatcactcagctgctgaagaggctccatcagtggattaacgaggactgctccacgccatgctccggctcgtggctgagggacgtttgggactggatatgcacggtgttaactgattttaagacctggctccagtccaagctcctgccgcggttgccgggagtccccttcctctcatgccagcgtgggtacaagggcgtctggcggggagacggcatcatgcaaaccacctgcccatgtggagcgcagatcaccggacatgtcaaaaacggttccatgaggatcgttgggcctaggacctgcagcaacacgtggcatggaacattccccatcaacgcacacactacgggcccctgcacgccctccccggcgcccaattattccagggcgctgtggagggtggctgctgaggagtacgtggaggttacgcgggtgggggatttccactacgtgacgggcatgaccactgacaacgtaaagtgcccatgccaggttccggcccccgaatttttcacggaggtggatggggtgcggctgcacaggtacgctccgccatgcaaacctctcctacgggaggaggtcacattcatggtcgggctcaaccaatacctggtcgggtcacagctcccatgtgagcccgaaccggatgtagcggtgctcacttccatgctcaccgacccctcccacatcacagcagagacggctaagcgtaggctggccagggggtctcccccctccttagccagctcttcagctagccagttgtctgcgccttccttgaaggcgacatgcactacccgtcatgactccccagatgctgacctcatcgaggccaatctcctgtggcgacaggagatgggcgggaacatcacccgcgtggagtcagagaacaaggtagtaattctggactctttcgagccgcttagagcggaggaagatgagagggaagtatccgttccggcggaaatcctgcggagatccaggaaatttcccccagcgatgcccatatgggcaaggccggattacaaccctccactggtggagccctggaaggacccagactacgtccctccagtggtacatgggtgcccattgccacctactaaggcccctccaataccacctccacggaggaaaaggacggttgtcctgacagaatccaccgtgtcttctgccttggctgagctcgccacaaagaccttcggcagctccgaatcgtcggccgtcgacagcggcacggcgaccgcccctcctgaccagctctccgacgacggcgacgcagggtccgatgttgagtcgtactcctccatgcccccccttgagggggaaccgggggatcccgatctcagcgacgggtcttggtctaccgtgagcgaggaagctggtgaggacgtcgtctgctgctcgatgtcctacacatggacaggcgccttgatcacgccatgctccgcggaggaaagcaagctgcccatcaacgcgttgagcaactcattgctgcgtcaccacaacatggtctatgccacaacatctcgcagcgcaagccagcggcaaaagaaggtcacttttgacagactgcaggtcctggacgaccattaccgggacgtgctcaaggagatgaaggcgaaggcgtccacggttaaggctaaacttctatccgtagaagaagcctgcaagctgacgcccccacactcggccaaatccaaatttggctatggggcaaaggacgtccggaacctatccagcaaggccattaaccacatccgctccgtgtggaaggacttgctggaagacactgagacaccaattgacaccaccatcatggcaaaaaatgaggttttctgcgtccaaccggagaaaggaggccgcaagccagctcgccttatcgtattcccagacttgggggttcgtgtgtgcgagaaaatggccctttatgacgtggtctccactcttcctcaggccgtgatgggctcctcatacgggttccagtactctcctggacagcgggtcgagttcctggtgaatgcctggaaaaaaaagaagaaccctatgggcttcgcatatgacacccgctgttttgactcaacggtcaccgagagtgacatccgtgttgaggagtcaatctaccaatgttgtgacttggcccccgaagccagacaggcaataaggtcgctcacagagcggctttatatcgggggtcccctgactaactcaaaagggcagaactgcggttatcgccggtgccgcgcgagcggtgtgctgacgaccagctgcggtaacaccctcacatgttacttgaaggcctctgcagcctgtcgagctgccaagctccaggactgcacgatgctcgtgtgcggagacgaccttgtcgttatctgtgaaagcgcgggaacccaggaggacgcggcgagcctacgagtcttcacggaggctatgactaggtactctgccccccccggggacccgcccaaaccagaatacgacttggagttgataacatcatgctcctccaatgtgtcggtcgcgcacgatgcatctggcaaaagggtgtactacctcacccgtgaccccaccaccccacttgcacgggctgcgtgggagacagctaggcacactccagtcaactcctggctaggcaacatcatcatgtatgcgcccaccttatgggcaaggatgatcctgatgactcacttcttctccatccttctagctcaggaacaacttgaaaaggctctagattgtcagatctacggggcctgttactccattgagccacttgacctacctcagatcattcagcgactccatggtcttagcgcattttcactccatagttactctccaggtgaaatcaatagggtggctgcatgcctcagaaaacttggggtaccacccttgcgagtctggagacatcgggccagaagtgtccgcgctaagctcctgtcccagggggggagggctgccaactgtggcaaatacctcttcaactgggcagtaaggaccaagcttaaactcactccaattccggctgcgtcccagttggacttgtccaactggttcgttgctggttacagcgggggagacatatatcacagcctgtctcgtgcccgaccccgctggttcatgttgtgcctactcctactttccgtaggggtaggcatctacctgctccccaaccga

SEQ ID NO: 612 - DNA, 9359 bp, Hepatitis C Virus
ttgggggcgacactccaccatagatcactcccctgtgagtaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggtggtggtcagatcgttggtggagtttacctgttgccgcgcaggggccctaggttgggtgtgcgcgcgactaggaagacttccgagcggtcgcaacctcgtggaaggcgacaacctatccccaaggctcgccggcccgagggcaggacctgggctcagcccgggtacccttggcccctctatggcaatgagggcatggggtgggcaggatggctcctgtcaccccgtggctctcggcctagttggggccccacagacccccggcgtaggtcgcgtaatttgggtaaggtcatcgataccctcacatgcggcttcgccgacctcatggggtacattccgctcgtcggcgcccccctagggggcgctgccagggccctggcgcatggcgtccgggtcctggaggacggcgtgaattatgcaacagggaatttgcccggttgctctttctctatcttcctcttggctttgctgtcctgtttgaccatcccagcttccgctatcgaagtgcgcaacgtgtccggagtgtaccatgtcacgaacgactgctccaacgcaagtattgtgtatgaggcagcggacatgattatgcatacccccggatgcgtgccctgcgttcgggaggacaactcctcccgctgctgggtagcgctcactcccacgctcgcggccaggaactccagcatccccactacgacaatacgacgtcacgtcgacttgctcgttggggcggctgctttctgctccgctatgtacgtgggagatctttgcggatctgttttccttgtctctcagctgttcaccttctcgcctcgccggcatgagacagtacaggactgcaattgctcaatctatcccggccacgtatcgggtcaccgcatggcatgggacatgatgatgaactggtcacctacaacagctctagtggtgtcgcagttactccggatcccacaagctgtcgtggacatggtggcgggagcccactggggagtcctggcgggcctcgcctactattccatggtggggaactgggctaaggtcttgattgtgatgctactttttgccggcgtcgacgggatgactcacacgacggggggggcggcggcccgtactacccatgggtttacgtccctctttacgcctgggccgtcccaaaacatccagcttgtaaacaccaacggcagctggcacatcaacaggactgccctgaactgcaatgactccctcaacactgggttccttgccgcgctgttctacacccacagattcaactcgtccggatgcccggagcgcatggccagctgtcgccccattgacaagttcgttcaggggtggggtcccatcacttacgataagtcgcccagcttggaccagaggccttattgttggcactacgcaccccaaccgtgcggcattgtacccgcgtcgcaggtgtgcggtccagtgtactgtttcaccccaagccctgttgtggtggggacgaccgatcgtttcggcgtccctacgtatagctggggggagaatgagacggacgtgctgcttctcaacaacacgcggccgccgcgaggcaactggttcggatgcacatggatgaatggcactgggttcaccaagacgtgcgggggccccccgtgtaacatcgggggggccggtaacgacaccttgatctgccccacggattgcttccggaagcaccccgaggccacttacaccaaatgcggttcggggccctggctgacacctaggtgcatggttgactacccatacaggctttggcactacccctgcactgtcaattttaccatcttcaaggttaggatgtatgtggggggtgtggagcacaggctcaacgccgcatgcaactggacccgaggagagcgttgtgatttggaggacagggatagatcagagcttagcccgctgctgctgtccacaacagagtggcaggtattgccctgttccttcaccaccctaccggctctgtccaccggcttgatccatctccatcggaatatcgtggacgtgcaatacctgtacggtatagggtcagcggttgtctcctacgcaattaagtgggagtatgtcctgttgctcttccttttcctggcggacgcgcgcgtctgtgcctgcttgtggatgatgctgctaatagctcaggctgaggccgccttagagaacttggtggtcctcaatgcggcgtccgtggccggaacgcatggcattctctctttccttgtgttcttctgtgctgcctggtacatcaagggcaggctggtccctggggcggcatatgcttactatagcgtatggccgctgctcctgctcctgctggcattgccaccacgagcatacgccatggaccgggagatggctgcatcgtgcggaggcgcggtttttataggtctggcactcttgaccttgtcaccacactataaagtgttcctcgctaagctcatatggtggttacaatattttatcaccagagccgaggcgcacttgcaggtgtggatcccccccctcaacgttcgggggggccgcgatgccatcatcctcctcatgtgcgcgatccacccagagctaatctttaccatcaccaaaatcttgctcgccatactcggcccgctcatggtgctccaagctggcataaccagggtgccgtactttgtgcgcgcccatgggctcattcgtgcatgcttgctggtgcggaaagtccttgggggtcattatgtccaaatggctttcatgaggctggccgcactgacaggcacgtacgtttataaccatcttactccactgcgggactgggcccacgagggcctacgagaccttgcagtggcagttgagcccgtcatcttctctgacatggagaccaagatcattacctggggggcagacaccgcggcgtgtggggacatcatctcaggcctgcccgtctctgcccgcagggggagggagatacttttgggaccggcagatagtcttgaggggcaggggtggcgactccttgcgcccatcacggcctatgcccaacagacgcggggcctacttggctgcatcgtcaccagcctcacaggccgggacaagaaccaggtcgagggggaggttcaagtggtttccaccgcaacacaatccttcctggcgacctgcatcaacggcgtgtgttggactgtctaccacggcgccggcacaaagaccctcgccggccaaaagggcccaatcacccaaatgtacaccaatgtagaccaggacctcgtcggctggcaagcgcctcccggggcgcgatccttgacaccgtgcacctgtggcagctcggacctttacttggtcacgaggcatgctgatgtcattccggtgcgccggcggggcgacagcagagggagcctactctcccccaggcctgtctcctacttgaagggctcttcgggtggtccactgctctgcccctcggggcatgctgtgggcatcttccgggctgctgtgtgcacccggggggttgcgaaagcggtggactttgtgcccgttgagtctatggaaacaactatgcggtccccggtcttcacggacaactcgtcccccccggctgtaccgcagacattccaagtggcccatctacacgctcccactggcagcggcaagagcactaaggtgcctgctgcgtatgcagcccaagggtacaaggtactcgtcctgaacccgtctgttgccgccaccctaggtttcggggcgtatatgtctaaggcacatggtgtcgaccctagcatcagaactggggtaaggaccatcaccacgggtgctcccattacgtactccacttatggcaagtttcttgccgacggtggttgctctgggggcgcttatgacatcataatatgcgatgagtgccactcaactgactcgactaccatcttgggcatcggcacagtcctggaccaagcggaaacggctggagcgcgactcgtcgtactcgccaccgctacgcctccgggatcggtcaccgtgccacatcccaatattgaggaagtggctctgtccaacactggagagatccccttctatggtaaagccatccccatcgagaccatcaagggggggaggcacctcatattttgccattccaggaaaaaatgtgatgagctcgccgcaaagctgtcgagtctcgggcttaacgctgtagcgtattaccggggtctcgatgtgtccgtcataccgaccagcggagacgtcgttgtcgtggcaacggacgctctaatgacgggtttcactggcgactttgactcagtgatcgactgtaatacatgtgtcacccagacagtcgacttcagcttggaccctaccttcaccattgagacgacgaccgtgccccaagacgcggtgtcgcgctcgcagcggcgaggcaggactggtaggggcaggatgggcatctacaggtttgtgactccaggagaacggccctcgggcatgttcgattcctcggtcctgtgtgagtgctatgacgcgggctgtgcttggtacgagctcacgcccgctgagacctcagttaggttgcgggcttacctgaatacaccagggttgcccgtttgccaggaccatctggagttctgggagggcgtcttcacaggcctcacccacatagatgcccacttcctgtcccagactaagcaggcaggagacaacttcccctacttggtagcatatcaggctacggtgtgcgccagggctcaggctccacccccatcgtgggaccaaatgtggaaatgtctcatacggctaaagcccacgctgcacgggccaacacccctgctgtataggctaggagccgtccaaaatgaggtcaccctcacacaccccataaccaaattcatcatggcatgcatgtcggctgacctggaggtcgccacgagcacctgggtgctagtaggcggagtcctcgcagctctggccgcgtattgcctgacaacaggcagcgtggtcattgtaggcaggatcatcttgtccggaaagccggctgtcctacctgacagggaagtcctctaccagcagttcgatgagatggaagagtgcgctacacaccttccttacattgaacaaggaatgcacctcgccgaacaattcaagcagaaggcactcgggttgttacagacagccaccaagcaagcggaggctgctgctcccgtggtggagtccaagtggcgagcccttgagagcttctgggcgaagcatatgtggaatttcatcagcgggatacaatacttagcaggcttgtccactctgcctgggaaccccgcaatagcatcactgatggcattcacagcctctgtcaccagcccgctcaccacccaacataccctcctgttcaacattttggggggatgggtggccgcccaactcgccccccccagcgccgcttctgctttcgtaggtgccggcatcgccggcgcggccgttggcagcataggccttgggaaggtgctagtggacatcttggcgggttatggagcgggggtggcgggcgccctcgtggcctttaaggtcatgagtggtgagatgccttccactgaggacttggtcaacttgctccctgctatcctctcccctggtgccctagtcgtcggggtagtgtgcgcagcaatactgcgtcggcatgtgggcccaggggagggggctgtgcagtggatgaaccggctgatagcgttcgcctcgcggggcaaccacgtctcccccacgcactatgtgcccgagagcgacgctgcagcgcgtgtcactcagatcctctccagcctcaccatcactcaactgctgaagaggctccatcagtggattaatgaggactgctccacgccatgctccggctcgtggctgagggacgtttgggactggatatgcacggtgttagctgattttaagacctggctccagtccaagctcctgccgcggttgccgggagttcccttcctctcatgccagcgtgggtacaagggcgtctggcggggggacggcatcatgcaaaccacctgcccatgtggagcgcagatcaccggacacgtcaaaaacggttccatgaggatcgttgggtctaggacctgcagtaacacgtggcatggaacattccccatcaacgcacacactacgggcccttgcacgccctccccggcgcccaattactccagggcgctgtggagggtggctgctgaggagtacgtggaggttacgcgggtgggggatttccactacgtgacgggcatgaccactgacaacgtaaagtgcccatgccaggtcccggcccccgaatttttcacggaggtggatggggtgcggctgcacaggtacgctccgccatgcaaacctctcctacgggaggaggtcacattcatggtcgggctcaaccaatacctggtcgggtcacagctcccatgcgagcccgaaccggatgtagcggtgctcacttccatgctcaccgacccctcccacatcacagcagagacggctaagcgtaggctggccagggggtctcccccctccttggccagctcttcagctagccagttgtctgcgccttccttgaaggcgacatgcactacccgtcatgactccccagatgctgacctcatcgaggccaatctcctgtggcgacaggagatgggcgggaacatcacccgcgtggagtcagagaacaaggtagtaattctggactctttcgagccgcttagagcggaggaagatgagagggaagtatccgttccggcggaaatcctgcggagatccaggaaatttcccccagcgttgcccatatgggcaaggccggattacaaccctccactggtggagccctggaaggacccagactacgtccctccagtggtacatgggtgcccattgccacctactaaggcccctccaataccacctccacggaggaaaaggacggttgtcctgacagaatccaccgtgtcttctgccttggctgagctcgccacaaagaccttcggcagctccgaatcgtcggccgtcgacagcggcacggcgaccgcccctcctgaccagctctccgacgacggcgacgcagggtccgatgttgagtcgtactcctccatgcccccccttgagggggaaccgggggatcccgatctcagcgacgggtcttggtctaccgtgagcgaggaagctggtgaggacgtcgtctgctgctcgatgtcctacacatggacaggcgccttgatcacgccatgctccgcggaggaaagcaagctgcccatcaacgcgttgagcaactcgttgctgcgtcaccacaacatggtctatgccacaacatctcgcagcgcaagccagcggcaaaagaaggtcacttttgacagactgcaggtcctggacgaccattaccgggacgtgctcaaggagatgaaggcgaaggcgtccacggttaaggctaaacttctatccgtagaagaagcctgcaagctgacgcccccacactcggccaaatccaaatttggctatggggcaaaggacgtccggagcctatccagcaaggccattaaccacatccgctccgtgtggaaggacttgctggaagacactgagacaccaattgacaccaccatcatggcaaaaaatgaggttttctgcgtccaaccggagaaaggaggccgcaagccagctcgccttatcgtattcccagacttgggggttcgtgtgtgcgagaaaatggccctttatgacgtggtctccactcttcctcaggccgtgatgggctcctcatacggattccagtactctcctggacagcgggtcgagttcctggtgaatgcctggaaaaagaagaagaaccctatgggcttcgcatatgacacccgctgttttgactcaacggtcaccgagagtgacatccgtgttgaggagtcaatctaccaatgttgtgacttggcccccgaagccagacaggcaataaggtcgctcacagagcggctttatatcgggggtcccctgaccaactcaaaagggcagaactgcggttatcgccggtgccgcgcgagcggtgtgctgacgaccagctgcggtaacaccctcacatgttacttgaaggcctctgcagcctgtcgagctgccaagctccaggactgcacgatgctcgtgtgcggagacgaccttgtcgttatctgtgaaagcgcgggaacccaggaggacgcggcgagcctacgagtcttcacggaggctatgactaggtactctgccccccccggggacccgcccaaaccagaatacgacttggagttgataacatcatgctcctccaatgtgtcggtcgcgcacgatgcatctggcaaaagggtgtactacctcacccgtgaccccaccaccccacttgcacgggctgcgtgggagacagctaggcacactccagtcaactcctggctaggcaacatcatcatgtatgcgcccaccttatgggcaaggatgattctgatgactcacttcttctccatccttctagctcaggaacaacttgaaaaggctctagattgtcagatctacggggcctgttactccattgagccacttgacctacctcagatcattcagcgactccatggtcttagcgcattttcactccatagttactctccaggtgaaatcaacagggtggctgcatgcctcagaaaacttggggtaccacccttgcgagcctggagacatcgggccagaagtgtccgcgctaagctcctgtcccagggggggagggctgccacttgtggcaaatacctcttcaactgggcagtaaggaccaagcttaaactcactccaattccggctgcgtcccagttggacttgtccaactggttcgttgctggttacagcgggggagacatatatcacagcctgtctcgtgcccgaccccgctggttcatgttgtgcctactcctgctttccgtaggggtaggcatctacctgctccccaaccga

SEQ ID NO: 613 - DNA, 9359 bp, Hepatitis C Virus
ttgggggcgacactccaccatagatcactcccctgtgaggaactactgtcttcacgcagaaagcgtctagccatggcgttagtatgagtgttgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggtggtggtcagatcgttggtggagtttacctgttgccgcgcaggggccccaggttgggtgtgcgcgcgactaggaagacttccgagcggtcgcaacctcgtggaaggcgacaacctatccccaaggctcgccggctcgagggcaggacctgggctcagcccgggtacccttggcccctctatggcaatgagggcatggggtgggcaggatggctcctgtcaccccgcggctctcggcctagttggggccccacggacccccggcgtaggtcgcgtaatttgggtaaggtcatcgataccctcacatgcggcttcgccgacctcatggggtacattccgctcgtcggcgcccccctagggggcgctgccagggccctggcgcatggcgtccgggtcctggaggacggcgtgaactatgcaacagggaatttgcccggttgctctttctctatcttcctcttggcattgctgtcttgcttgaccatcccagcttccgctatcgaagtgcgcaacgtgtccggagtgtaccatgtcacgaacgactgctccaacgcaagcattgtgtatgaggcagcggacatgattatgcacacccccgggtgcgtgccctgcgttcgggagggcaattcctcccgctgctgggtagcgctcactcccacgctcgcggccaggaattccagcatccccactacgacaatacgacgtcacgtcgatttgctcgttgggacggccgctttctgctccgctatgtacgtgggagatctttgcggatctgtttttcttgtctctcagctgttcaccttctcgcctcgccggcacgggacagtacaggactgcaattgctcaatctatcccggccacgtatcgggtcaccgcatggcttgggacatgatgatgaactggtcacctacaacagctctagtggtgtcgcagttactccggatcccgcaagctgtcgtggacatggtggcgggagcccactggggagtcctggcgggcctcgcctactattccatggtggggaactgggctaaggtcttgattgtgatgctactttttgccggcgtcgacgggcacacttacacgacggggggggtgcatggccatactctcgccgggttaacgggcctctttgtgcgagggccgtcccaaaaactccagcttataaacaccaacggcagctggcacatcaacaggactgccctgaactgcaatgactctctcaacactgggttcattgccgcgctgttctacgcccacagattcaacgcgtccggatgcccggagcgcatggccagctgccgccccattgacaagttcgctcaggggtggggtcccatcacttacgctgagccgcccgatttggaccagaagccctattgttggcactacgcaccccgaccatgcgatattgtgcccgcgttgaacgtgtgcggcccagtgtattgtttcaccccaagccccgttgtggtggggacgaccgatcgtttcggcgcccctacgtataactggggggagaatgagacggacgtgctgcttctcaacagcatgcggccgccgcaaggcagctggttcggctgcacgtggatgaatggcactgggttcaccaagacgtgtggaggccccccgtgcaacattgggggggtcggtaataacaccttgatctgccccacggattgcttccggaagcaccccgaggccacttacaccaaatgcggttcggggccctggctgacacctaggtgcatggttgactacccatacaggctttggcactacccctgcactgtcaattttaccatcttcaaggttaggatgtatgtggggggtgtggagcacaggcttaacgccgcttgcaactggacccgaggagagcgttgtgacttggaggacagggatagatcagagcttagcccgctgctgctgtctacaacagagtggcaggtattgccctgttccttcaccaccctaccggctctgtccaccggtttgatccatctccaccggaacatcgtggacgtgcaatacctgtacggtatagggtcagcggttgtctcctacgcaattaagtgggagtatgtcctgttgctattccttttcctggcagacgcgcgcgtctgtgcctgcttgtggatgatgctgctaatagctcaggctgaggccgccttagagaacttggtggtcctcaatgcggcgtccgtggccggagcgcatggcattctctctttcctcgtgttcttctgtgctgcttggtacatcaagggcaggctggtccctggggcggcatatgctttctatggcgtatggccgctgctcctgctcctgctggcgttgccaccacgagcatacgccatggaccgggagatggccgcatcgtgcggaggcgcggtttttataggtctggcacttttgaccttatcaccacactacaaagtgttcctcgccaggctcatatggtggttacaatattttatcaccagagccgaggcgcacttgcaggtgtggatcccccccctcaacgttcgggggggccgcgatgccatcatcctcctcatgtgcgcgatccacccagagctaatctttgccatcaccaaaatcttgctcgccatactcggcccgctcatggtgctccaggctggcataaccagggtgccgtacttcgtgcgcgcccatgggctcattcgtgcatgcatgctggtgcggcaagtcgctgggggtcattatgtccaaatggctttcatgaggctggccgcactgacaggcacgtacgtttatgaccatcttaccccactgcaggactgggctcacgagggcctacgagaccttgcagtggcagttgagcccgtcgtcttctctgacatggagaccaagatcattacctggggggcagacaccgcggcgtgtggggacatcatcttaggcctgccagtctccgcccgcagggggagggagatatttttaggaccggcagatagtcttgaggggcaggggtggcgactcctcgcgcccatcacggcctatgcccaacagacgcgcggcctacttggctgcatcgtcaccagcctcacaggccgggacaagaaccaggtcgagggggaggtgcaggtggtttccaccgcaacacaatctttcctggcgacctgcatcaacggcgtgtgttggactgtctaccacggcgccggcacaaagacccttgccggccaaaagggcccaatcacccaaatgtacaccaatgtagaccaggacctcgtcggctggcaagcgcctcccggggcgcgatccttgataccgtgcacctgtggcagctcggacctttacttggtcacgaggcatgctgatgtcattccggtgcgccggcggggcgacagcagaggtagcctactctcccccaggcccgtctcctacttgaagggctcttcgggtggtccactgctctgcccctcggggcacgctgtgggcatcttccgggctgctgtgtgcacccggggggttgcgaaggcggtggactttgtgcccgttgagtctatggaaacaactatgcggtccccggtcttcacggacaactcgtcccctccggccgtaccgcagacattccaagtggcccatctacacgctcccactggcagcggcaagagcactaaggtgcccgctgcgtatgcagcccaagggtacaaagtactcgtcttgaacccgtctgttgccgccaccctaggtttcggggcgtatatgtctaaggcacatggtgtcgaccctaacatcagaactggggtaaggaccatcaccacgggtgcccccattacgtactccacctatggcaagtttcttgccgacggtggttgctctggaggcgcctatgacatcataatatgtgatgagtgccactcaactgactcgaccaccatcttgggcatcggcacagtcctggaccaagcggagacggctggagcgcgactcgtcgtactcgccaccgctacgcctccgggatcggtcaccgtgccacatcccaatatcgaggaagtggctctgtccaacactggagagatccccttctatggtaaagccatccccatcgagaccatcaagggggggaggcacctcatattttgccattccaagaaaaaatgtgatgagctcgccgcaaagctgtcgagtctcgggcttaacgctgtagcgtattaccggggtcttgatgtgtccgtcataccgaccagcggagacgtcgttgtcgtggcaacagacgctctaatgacgggctttactggcgactttgactcagtgatcgactgtaatacatgtgtcacccagacagtcgacttaagcttggaccctaccttcaccattgagacgacgaccgtgcctcaagacgcggtgtcacgctcgcagcggcgaggcaggactggtaggggcaggacaggcatctacaggtttgtgactccaggagaacggccctcgggcatgttcgattcctcggtcctgtgtgagtgctatgacgcgggctgtgcttggtatgagctcacgcccgccgagacctcagttaggttgcgggcttacctgaatacaccagggttgcccgtctgccaggaccatctggagttctgggagggcgtcttcacaggcctcacccacatagatgcccacttcctgtcccagactaagcaggcaggagacaatttcccctacttgatagcataccaggctacggtgtgcgccagggctcaggctccacccccatcgtgggaccaaatgtggaaatgtctcatacggctaaagcccacgctgcacgggccaacacccctgctgtataggctaggagccgtccaaaatgaggtcaccctcacacatcccataaccaaattcatcatggcatgcatgtcggctgacctggaggtcgccacgagcacctgggtgctagtgggcggagtcctcgcagctctggccgcgtactgcctgacagcaggcagcgtggtcattgtaggcaggatcatcttgtctggaaagccggctattgtacccgacagggaagtcctctaccagcagttcgatgagatggaagagtgcgccacacacctcccttacattgaacaaggaatgcagctcgccgaacaattcaaacagaaggcactcgggttgttacagacagccaccaagcaagcagaagctgctgctcccgtggtggagtccaagtggcgagcccttgagagcttctgggcgaagcacatgtggaatttcattagcgggatacaatacttagcaggcttgtccactctgcctgggaaccccgctatagcatcactgatggcattcacagcctctatcaccagcccgctcaccacccaacataccctcctgttcaacattttggggggatgggtggccgcccaactcgccccccccagcgccgcttctgctttcgtaggcgccggcatcgccggcgcggccgttggcagcataggccttgggaaggtgctagtggacatcttggcgggttatggagcgggggtggcaggcgccctcgtggcctttaaggtcatgagtggtgagatgccttccaccgaggacttggtcaacttgctccctgccatcctctcccctggtgccctagtcgtcggggtagtgtgcgcagcaatactgcgtcggcatgtaggcccaggggagggggctgtgcagtggatgaaccggctgatagcgttcgcttcgcggggtaaccacgtctcccccacgcactatgtgcccgagagcgacgctgcagcgcgtgtcactcaaatcctctccagccttaccatcactcagctgctgaggaggctccatcagtggattaacgaggactgctccacgccatgctccggctcgtggctaagggacgtttgggactggatatgcacggtgttaactgattttaaaacctggctccagtccaagctcctgccgcggttaccgggagtccccttcctctcatgccaacgtgggtacaagggcatctggcggggagacggcatcatgcaaaccacctgcccatgtggagcgcagatcaccggacatgtcaaaaacggttccatgaggatcgttgggcctaggacctgcagcaacacgtggcatggaacattccccatcaacgcatacaccacgggcccttgcacgccctccccggcgcccaattattccagggcgctgtggagggtgactgctgaggagtacgtggaggttacgcgggtgggggacttccactacgtgacgggcatgaccactgacaacgtaaagtgcccatgccaggttccggcccccgaattcttcacggaggtggatggggtgcggctgcacaggtacgctccgccgtgcaaacccctcctacgggaggaggtcacattccaggtcgggctcaaccaatacctggtcgggtcacagctcccatgtgagcctgaaccggatgtagcggtgctcacttccatgctcaccgacccctcccatatcacagcagaggcggctaagcgtaggctggccagggggtctcccccctccttggccagctcttcagctagccagttgtctgcgccttccttgaaggcgacatgcactacccgtcatgactccccagatgctgacctcatcgaggccaatctcctgtggcggcaggagatgggcgggaacatcacccgcgtggagtcagagaacaaggtagtaattttggactctttcgagccgcttcgagcggaggaagatgagagggaagtatccgttccggcggaaatcctgcggagatccagaaaatttccccgagcgatgcccatatgggcaaggccggattacaaccctccactggtagagtcctggaaggacccggactatgtccctccggtggtacatgggtgcccgttgccacctaccaaggcccctccaataccacctccacggaggaaaaggacggttgtcctgacagaatccaccgtgtcttctgccttggctgagctcgccacgaagaccttcggcagctccgaatcgtcggccgttgacagcggcacggcgaccgcctcccctgaccagccctccgacgacggcgacgcagggtccgatgttgagtcgtactcctccatgccccccctagagggggagccgggggatcccgatctcagcgacgggtcttggtctaccgtaagcgaggaagctagtgaggacgtcgtctgctgctcgatgtcctacacatggacaggcgccctgatcacgccatgctccgcggaggaaagcaagctgcccatcaacgcgttgagcaactctttgctgcgtcaccacaacatggtctatgccacaacatctcgcagcgcaagccagcggcagaagaaggtcacctttgacagactgcaggtcctggacgaccattaccgggacgtgctcaaggagatgaaggcgaaggcgtccacggttaaggctaaacttctatccgtagaagaagcctgcatgctgacgcccccacactcggccaaatccaaatttggctatggggcaaaggacgtccggaacctatcccgcaaggccactgaccacatccgctccgtgtggaaggacttgctggaagacactgagacaccaattgacaccaccatcatggcaaaaaatgaggttttctgtgttcaaccagagaaaggaggccgcaagccagctcgccttatcgtattcccagatttgggggttcgtgtgtgcgagaaaatggccctttatgacgtggtctccacccttcctcaggccgtgatgggctcctcatacgggttccagtactctcctggacagcgggtcgagttcctggtgaatgcctggaaaaaaaagaaaaaccctatgggcttcgcatatgacacccgctgttttgactcaacggtcaccgagagtgacatccgtgttgaggagtcaatctaccaatgttgtgacctggcccccgaagccagacaggccataaggtcgctcacagagcggctttatatcgggggtcccctgaccaactcaaaagggcagaactgcggttatcgccggtgccgcgcgagcggtgtgctgacgaccagctgcggtaataccctcacatgctacttgaaggcctctgcagcctgtcgagctgccaagctccaggactgcacgatgctcgtgtgcggagatgaccttgtcgttatctgtgaaagcgcaggaacccaggaggacgcggcgagcctacgagtcttcacggaggctatgactaggtactctgccccccccggggacccgcccaaaccagaatacgacttggagttgataacatcatgctcctccaatgtgtcggtcgcgcacgatgcatctggcaaaagggtgtactacctcacccgcgaccccaccaccccacttgcacgagctgcgtgggagacagctagacacactccagtcaactcctggctaggcaacatcatcatgtatgcgcccaccttatgggcaaggatgatcctgatgactcacttcttctccatccttctagctcaggaacaacttgaaaaggctctagattgtcagatctacggggcctgttactccattgagccacttgacctacctcagatcattcagcgactccatggtcttagcgcattttcactccatagttactctccaggtgaaatcaatagggtggctacatgcctcaggaaacttggggtaccacccttgcgagtctggagacatcgggccagaagtgtccgcgctaagctcctgtcccagggggggagggccgccaactgcggcaaatacctcttcaactgggcagtaaggaccaagctcaaactcactccaattccggctgcgtcccagttggacttgtccagctggttcgttgctggttacagcgggggagacatatatcacagcctgtctcgtgcccgaccccgctggttcatgttgtgcctactcctactttccgtaggggtaggcatctacctgctccccaaccga

SEQ ID NO: 614 - DNA, 9359 bp, Hepatitis C Virus
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggtggtggtcagatcgttggtggagtttacctgttgccgcgcaggggccccaggttgggtgtgcgcgcgactaggaagacttccgagcggtcgcaacctcgtggaaggcgacaacctatccccaaggctcgccggctcgagggcaggacctgggctcagcccgggtacccttggcccctctatggcaatgagggcatggggtgggcaggatggctcctgtcaccccgcggctctcggcctagttggggccccacggacccccggcgtaggtcgcgtaatttgggtaaggtcatcgataccctcacatgcggcttcgccgacctcatggggtacattccgctcgtcggcgcccccctagggggcgctgccagggccctggcgcatggcgtccgggtcctggaggacggcgtgaactatgcaacagggaatttgcccggttgctctttctctatcttcctcttggctttgctgtcctgcttgaccatcccagcttccgctatcgaagtgcgcaacgtgtccggagtgtaccatgtcacgaacgactgctccaacgcaagcattgtgtatgaggcagcggacatgatcatgcacacccccgggtgcgtgccctgcgttcgggagggcaactcctcccgctgctgggtagcgctcactcccacgctcgcggccaggaattccagcatccccactacgacgatacgacgtcacgtcgatctgctcgttgggacggctgctttctgctccgctatgtacgtgggagatctctgcggatctgtttttcttgtctcacagctgttcaccttctcgcctcgtcggcatgggacagtacaggactgcaattgctcaatctatcccggccacatatcaggtcaccgcatggcttgggacatgatgatgaactggtcacctacaacagctctagtggtgtcgcagttactccggatcccgcaagctgtcgtggacatggtggcgggagcccactggggagtcctggcgggcctcgcctactattccatggtggggaactgggctaaggtcttgattgtgatgctactttttgccggcgtcgacgggcacactcacacgatggggggggtgcagggctataccgtccgcaggtttacgagcatctttatgcctgggccgtcccaaaatatccagcttataaacaccaacggcagctggcacatcaacaggaccgccctgaactgcaatgactccctcaacactgggttcatcgccgcgctgttctacacccacagattcaacgcgtccggatgcccggagcgcatggccagctgccgccccattgacaagttcgctcaggggtggggtcccatcacttacgctgagccgcccgacttggaccagaagccctattgttggcactacgcaccccgaccgtgcaatattgtgcccgcgttgaacgtgtgcggcccagtgtactgtttcaccccaagccccgttgtggtggggacgaccgatcgtttcggcgctcctacgtatagctggggggagaatgagacggacgtgctgcttctcaacagcatgcggccgcctcaaggcagctggttcggctgcacatggatgaatagcactgggttcaccaagacgtgcgggggccccccgtgcaacatcgggggggtcggtaataacaccttgatctgccccacggattgcttccggaagcaccccgaggccacttacaccaaatgcggttcggggccctggctgacacctaggtgcatggttgactacccatacaggctttggcactacccctgcactgtcaattttaccatcttcaaggttaggatgtatgtggggggtgtggagcacaggctcaacgccgcgtgcaactggacccgaggagagcgttgtgacttggaggacagggatagatcagagcttagcccgctgctgctgtctacaacagagtggcaggtattgccctgttccttcaccaccctaccggctctgtccaccggcttgatccatctccatcggaacatcgtggacgtgcaatacctgtacggtatagggtcagcggttgtctcctacgcaattaagtgggagtatgtcctgttgctattccttttcctggcagacgcacgcgtctgtgcctgcttgtggatgatgctgctaatagctcaggctgaggccgccttagagaacttggtggtcctcaatgcggcgtccgtggccggaacgcatggcattctctctttcctcgtgttcttttgtgctgcctggtacatcaagggcaggctggtccctggggcggcatatgctttctatggcgtatggccgctgctcctgctcctgctggcgttgccaccacgagcatacgctatggaccgggagatggccgcatcgtgcggaggcgcggtttttataggtctggcacttttgaccttgtcaccacactataaagtgttcctcgccaggctcatatggtggttacaatattttatcaccagagccgaggcgcacttgcaggtgtggatcccccccctcaacgttcgggggggccgcgatgccatcatcctcctcatgtgcgcgatccacccagagctaatctttgccatcaccaaaatcttgctcgccatactcggcccgctcatggtgctccaggctggcataaccagggtgccgtacttcgtgcgcgcccatgggctcattcgtgcatgcatgctggtgcggcaagtcgctgggggtcattatgtccaaatggctttcatgaggctggccgcattgacaggcacgtacgtttatgaccatcttactccactgcgggactgggcccacgagggcctacgagaccttgcagtggcagttgagcccgtcgtcttttctgacatggagaccaagatcatcacctggggggcagacaccgcggcgtgtggggacatcatcttaggcctgcccgtctccgcccgcagggggagggagatacttttaggaccggcagatagtcttgaggggcaggggtggcgactccttgcgcccatcacggcctatgcccaacagacgcggggcctacttggctgcatcgtcaccagcctcacaggccgggacaagaaccaggtcgagggggaggttcaggtggtttccaccgcaacacaatctttcctggcgacctgcatcaacggcgtgtgttggactgtctaccacggcgccggcacaaagacccttgccggccaaaagggcccaatcacccaaatgtacaccaatgtagaccaggacctcgtcggctggcaagcgcctcccggggcgcgatccttgataccgtgcacctgtggcagctcggacctttatttggtcacgaggcatgctgatgtcattccggtgcgccggcggggcgacagcagaggtagcctactctcccccaggcccgtctcctacttgaagggctcttcgggtggtccactgctctgcccctcggggcacgctgtgggcatcttccgggctgctgtgtgcacccggggggttgcgaaggcggtggactttgtgcccgttgagtctatggaaacaactatgcggtccccggtcttcacggacaactcgtcccccccggccgtaccgcagacattccaagtggcccatctacacgctcccactggcagcggcaagagcactaaggtgccggctgcgtatgcagcccaagggtacaaagtactcgtcctgaacccgtctgttgccgccaccctagggttcggagcgtatatgtctaaggcacatggtgtcgaccctaacatcagaactggggtaaggaccatcaccacgggtgcccccattacgtactccacctatggcaagtttcttgccgacggtggttgctctgggggcgcctatgacatcataatatgtgatgagtgccactcaactgactcgaccaccatcttgggcatcggcacagtcctggaccaagcggagacggctggagcgcgactcgtcgtactcgccaccgctacgcctccgggatcggtcaccgtgccacatcccaatatcgaggaggtggctctgtccaacattggagagatccccttctatggtaaagccatccccatcgagaccatcaagggggggaggcacctcatattttgccattccaagaaaaaatgtgatgagctcgccgcaaagctgtcgagtctcgggcttaacgctgtagcgtattaccggggtcttgatgtgtccgtcataccgaccagcggagacgtcgttgtcgtagcaacagacgctctaatgacgggtttcactggcgactttgactcagtgatcgactgtaatacatgtgtcacccagacagtcgactttagcttggaccctaccttcaccattgagacgacaaccgtgccccaagacgcggtgtcgcgctcgcagcggcgaggcaggactggcaggggcaggacaggcatctacaggtttgtgactccaggagaacggccctcgggcatgttcgattcctcggtcctgtgtgagtgctatgacgcgggctgtgcttggtacgagctcacgcccgccgagacctcagttaggttgcgggcttacctgaatacaccagggttgcccgtctgccaggaccatctggagttctgggagggcgtcttcacaggcctcacccacatagatgcccacttcctgtcccagactaagcaggcaggagacaatttcccctacttgatagcataccaggctacggtgtgcgccagggctcaggctccacccccatcgtgggaccaaatgtggaaatgtctcatacggctaaagcccacgctgcacgggccaacacccctgctgtataggctaggagccgtccaaaatgaggtcaccctcacacaccccataaccaagttcatcatggcatgcatgtcggctgacctggaggtcgccacgagcacctgggtgctagtaggcggagtcctcgcagctctggccgcgtactgcctgacagcaggcagcgtggtcattgtaggcaggatcatcttgtccggaaagccggctattgtacccgacagggaagtcctctaccagcagttcgatgagatggaagagtgcgccacacacctcccttacattgaacaaggaatgcagctcgccgaacaattcaaacagaaggcactcgggttgttacagacagccaccaagcaagcagaagctgctgctcccgtggtggaatccaagtggcgagcccttgagagcttctgggcgaagcatatgtggaatttcattagcgggatacaatacttagcaggcttgtccactctgcctgggaaccccgcaatagcatcactgatggcattcacagcctctatcaccagcccgctcaccacccaacataccctcctgttcaacatcttggggggatgggtggctgctcagctcgcccctcccagcgctgcttctgctttcgtaggcgccggcattgccggcgcggccgttggcagcataggccttgggaaggtgttagtggacatcttggcgggttatggagcgggggtggcaggtgccctcgtggcctttaaggtcatgagtggtgagatgccttccaccgaggacttggtcaacttgctccctgccatcctctcccctggtgccctagtcgtcggggtagtgtgcgcagcaatactgcgtcggcacgtgggcccaggggagggggctgtgcagtggatgaaccggctgatagcgttcgcttcgcggggtaaccacgtctcccccacgcactatgtgcccgagagcgacgctgcagcgcgtgtcactcaaatcctctccagccttaccatcactcagctgctgaggaggctccaccagtggattaacgaggactgctccacgccatgctccggttcgtggctaagggacgtttgggactggatatgcacggtgttaaccgattttaagacctggctccagtctaagctcctgccgcggttaccgggagtcccctttctctcgtgccagcgtggatacaagggcatctggcggggagacggcatcatgcaaaccacctgcccatgtggagcgcagatcaccggacatgtcaaaaacggttccatgaggatcgtcgggcctaggacttgcagcaacacgtggcatggaacattccccatcaacgcatacaccacgggcccttgcacgccctccccggcgcccaattattccagggcgctgtggagagtgactgctgaggagtacgtggaggttacgcgggtgggggacttccactacgtgacgggcatgactactgacaacgtaaagtgcccatgtcaggttccggcccccgaattcttcacagaggtggatggggtgcggctgcacaggtacgctccgccgtgcaaacctctcctacgggaggaggtcacattccaggtcgggctcaaccaatacctggtcgggtcacagctcccatgcgagcccgaaccggatgtaacggtgctcacttccatgctcaccgacccctcccacatcacagcagaagcggctaagcgcagattggccagggggtctcccccctccttggccagctcttcagctagccagttgtctgcgccttccttgaaggcgacatgcactacccgtcatgactccccagatgctgacctcatcgaggccaatctcctgtggcgacaggagatgggcgggaacatcacccgcgtggagtcagagaacaaggtagtaattctggactctttcgaaccgcttcaagcggaggaagatgagagggaagtatccgttccggcggagatcctgcggagatccaggaaatttccccgagcgatgcccatatgggcaaggccggattacaaccctccactggtggagtcctggaaggacccggactatgtccctccggtggtacatgggtgcccgttgccacccactaaggcccctccaataccacctccacggaggaaaaggacggttgtcctgacagaatccaccgtgtcttctgccttggctgagctcgccacgaagaccttcggcagctccgaatcgtcggccgtcgacagcggcacggcgaccgcctcccatgaccagccctccgacgacggcgacgcagggtccgatgttgagtcgtactcctccatgccccccctagagggggagccgggggatcccgatctcagcgacgggtcttggtctaccgtgagcgaggaagctagtgaggacgtcgtctgctgctcgatgtcctacacatggacaggcgccctgatcacgccatgctccgcggaggaaagcaagctgcccatcaacgcgttgagcaactctttgctgcgtcaccacaacatggtctatgccacaacgtctcgcagcgcaagccagcggcagaagaaggtcacctttgacagactgcaggtcctggacgaccattaccgggacgtgcttaaggagatgaaggcgaaggcgtccacggttaaggctaaacttctatccgtagaagaagcctgcatgctgacgcccccacactcggccaaatccaagtttggctatggggcaaaggacgtccggaacctatcccgcaaggccactgaccacatccgctccgtgtggaaggacttgctggaagacactgagacaccaattgacaccaccatcatggcaaaaaatgaggttttctgcgttcaaccagagaagggaggccgcaagccagctcgccttatcgtattcccagatttgggggttcgtgtgtgcgagaaaatggccctttatgacgtggtctccacccttcctcaggccgtgatgggctcctcatacgggttccagtactctcctggacagcgggtcgagttcctagtgaatgcctggaaaaaaaagaaaaaccctatgggcttcgcgtatgacacccgctgtttcgactcaacggtcactgagagtgacatccgttttgaggagtcaatctaccaatgttgtgacttggcccccgaagccagacaggccataaggtcgctcacggagcggctttatatcgggggtcccctgactaactcaaaagggcagaactgcggttatcgccggtgccgcgcgagcggtgtgctgacgaccagctgcggtaataccctcacatgttacttgaaggcctctgcagcctgtcgagctgccaagctccaggactgcacgatgctcgtgtgcggagacgaccttgtcgttatctgtgaaagcgcgggaacccaggaggacgcggcgagcctacgagtcttcacggaggctatgactaggtactctgctccccccggggacccgcccaaaccagaatacgacttggagttgataacatcatgctcctccaatgtgtcggtcgcgcacgatgcatctggcaaaagggtgtactacctcacccgcgaccccaccaccccacttgcacgggctgcgtgggagacagctagacacactccagtcaactcctggctaggcaacatcatcatgtatgcgcccaccttatgggcaaggatgatcctgatgactcacttcttctccatccttctagctcaggaacaacttgaaaaggctctagattgtcagatctacggggcctgttactccattgagccacttgacctacctcagatcattcagcgactccatggtcttagcgcattttcactccatagttactctccaggtgaaatcaatagggtggctacatgcctcaggaaacttggggtaccacccttgcgagtctggagacatcgggccagaagtgtccgcgctaagctcctgtcccagggggggagggccgccaactgtggcaaatacctcttcaactgggcagtaaggaccaagcttaaactcactccaattccggctgcgtcccagttggacttgtccagctggttcgttgctggttacagcgggggagacatatatcacagcctgtctcgtgcccgaccccgctggttcatgttgtgcctactcctactttccgtaggggtaggcatctacctgctccccaaccga

SEQ ID NO: 615 - DNA, 9359 bp, Hepatitis C Virus
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggatgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgtcggcccgagggcaggacctgggctcagcccgggtacccttggcccctctatggcaatgagggcatggggtgggcaggatggctcctgtcaccccgcggctctcggcctagttggggccccacggacccccggcgtaggtcgcgtaatttgggtaaggtcatcgataccctcacatgcggcttcgccgacctcatggggtacattccgctcgtcggcgcccccctagggggcgctgccagggccctggcgcatggcgtccgggtcctggaggacggcgtgaactatgcaacagggaatttgcccggttgctctttctctatctttctcttggctttgctgtcctgtttgaccatcccagcttccgctatcgaagtgcgcaacgtgtccggagtgtaccatgtcacgaacgactgctccaactcaagcattgtgtttgaggcagcggacatgattatgcatacccccgggtgcgtgccctgcgttcgggaggacaactcctcccgctgctgggtagcgctcactcccacgctcgcggccaggaactccagcatccccactacgacaatacgacgtcacgtcgatttgctcgttgggacggctgctttctgctccgctatgtacgtgggagatctttgcggatctgtttttcttgtctctcagctgttcaccttctcgcctcgccggcatgagacagtacaggactgcaattgctcgatctatcccggccacgtatcgggtcaccgcatggcttgggacatgatgatgaactggtcacctacaacagctctagtggtgtcgcagttactccggatcccacaagctgtcgtggacatggtggcgggagcccactggggagtcctggcgggcctcgcctactattccatggtggggaactgggctaaggtcttgattgtgatgctactttttgctggcgtcgacgggaacacacacgtgacggggggggtgtcggcccgtgctacctccggctttgtgtccctctttacgcctgggccgtcccagaacatccagctcataaacaccaacggcagctggcacatcaacaggactgccctgaactgtaatgactccctccaaactgggttccttgccgcgctgttctacacccgcgggttcaactcatccggatgcccggagcgcatggccagctgccgccccattgacgagttcgctcaggggtggggtcccatcacttacgctaagccggccagcttggaccagaagccctattgttggcactacgcaccccaaccgtgcggtattgtacccgcgtcgcaggtgtgcggtccagtgtactgtttcaccccaagccctgttgtggtggggacgaccgatcgtttcggcgtccctacgtataactggggggacaatgagacggacgtgctgcttctcaacaacacgcggccgccgcgaggcaactggttcggctgcacatggatgaatggcactggattcaccaagacgtgcgggggccctccgtgcaacatcgggggggccggtaataacaccttgatctgccccacggattgcttccggaagcaccccgaggccacttacaccaaatgcggttcggggccctggctgacacctaggtgcatggttgactacccatacaggctttggcactacccctgcactgtcaattattccatcttcaaggttagaatgtatgtggggggtgtggagcacaggctcaacgccgcatgcaactggacccgaggagcgcgttgtgacttggaggacagggatagatcagagcttagcccgttgctgctgtctacaacagagtggcaggtactgccctgttccttcaccaccctaccggctctttccaccggcttgatccatctccatcagaacatcgtggacgtgcaatacctgtacggcatagggtcagcggttgtctcctacgctattaagtgggagtatgtcctgttgctcttccttttcctggcggacgcgcgcgtttgtgcttgcttgtggatgatgctgctaatagctcaggctgaggccgccttagaaaacttggtggtcctcaacgcggcgtccgtggccggaacgcatggcattctccctttccttgtgttcttctgtgctgcctggtacatcaagggcaggctggtccctggggcggcatatgctttctatggcatgtggccgctgctcctgctcctgctggcgttgccaccacgagcatacgccatggaccgggagatggctgcatcgtgcggaggcgcggtctttataggtctggcacttttgaccttgtcaccacactataaattgttcctcgccaggctcatatggtggttacaatactttatcaccagagccgaggcgcacttgcaggtgtggatcccccccctcaacgttcggggaggccgcgatgccatcatcctcctcatgtgcgcgatccacccagagctaatctttgccatcaccaaaatcttgctcgccatactcggcccgctcatggtgctccaggcggccataaccagggtgccgtactttgtgcgcgcccaagggctcattcgtgcatgcttgctggtgcgggaagtcgctgggggccattatgtccaaatggctttcatgaggctggccgcactgacaggcacgtacgtgtataaccatcttactccactgcgggactgggcccacgagggcctacaagaccttgcagtggcagttgagcccgtcgtcttctctgatatggagaccaagatcattacctggggggcagacaccgcggcgtgtggggacatcatcttaggcctgcccgtctccgcccgcaggggaagggagatacttttgggaccggcagatagtcttgaggggcaggggtggcgactccttgcgcccatcacggcctatgcccaacagacgcggggcctacttggctgcatcgtcaccagcctcacaggccgggacaagaaccaggtcgagggggaggttcaagtggtttccaccgcaacacaatccttcctggcgacctgtgtcaacggcgtgtgttggactgtctaccatggcgccggcacaaagaccctcgccagccaaaagggcccaatcacccaaatgtacaccaatgtagaccaggacctcgtcggctggcaagcgcctcccggggcgcgatccttgacaccgtgcacctgtggcagctcggacctttacttggtcacgaggcatgctgatgtcattccggtgcgccggcggggcgacaatagaggaagcctactctcccccaggcccatctcctacttgaagggttcttcgggtggtccactgctctgcccctcggggcatgctgtgggcatcttccgggctgctgtgtgcacccggggggttgcgaaggcggtggactttgtgcccgttgagtctatggaaacaaccatgcggtccccggtctttacggacaactcgtcccccccggccgtaccgcagacattccaagtggcccatctacacgctcccactggcagcggcaagagcactaaggtgccggctgcgtatgcagcccaagggtacaaggtactcgtcctgaacccgtctgttgccgccaccctaggcttcggggcgtatatgtctaaggcacatggtgtcgaacctaacatcagaactggggtaaggaccatcaccacgggtgcccccattacgtactccacctatggcaagtttcttgccgacggtggttgctctgggggcgcctatgacatcataatatgtgatgagtgccactcaactgactcgactaccatcttgggcatcggcacagtcctggaccaagcggagacggctggagcgcgactcgtcgtactcgccaccgctacgcctccgggatcggtcaccgtgccacatcccaatatcgaggaggtggctctgtccaacactggagagatccccttctatggtaaagccatccccatcgagaccatcaagggggggaggcatctcatattttgccattccaagaaaaaatgtgatgaggtcgccgcaaagctgtcaggtctcgggcttaacgctgtagcgtattaccggggtcttgatgtgtccgtcataccgaccagcggagacgtcgttgtcgtggcaacagacgctctaatgacgggtttcactggcgactttgactcagtgatcgactgtaatacatgtgtcacccagacagtcgacttcagcttggaccctaccttcaccattgagaccacgaccgtgccccaagacgcagtgtcgcgctcgcagcggcgaggcaggactggtaggggcaggacaggcatctacaggtttgtgactccaggagaacggccctcgggcatgttcgattcctcggtcttgtgtgagtgctatgacgcgggctgtgcttggtatgagctcacgcccgccgagaccacagttaggttgcgggcttacctgaatacaccagggttgcccgtctgccaagaccatctggagttctgggagggcgtcttcacaggcctcacccacatagatgcccacttcctgtcccagactaagcaggcaggagacaacttcccctacttggtagcataccaggctacggtgtgcgccagggctcaggctccacccccatcgtgggaccaaatgtggaaatgtctcacgcggctaaagcccgtgctgcatgggccaacacccctgctgtataggctgggagccgtccaaaatgaggtcatcttcacacaccccataaccaaatacatcatgacatgcatggcggctgacctggaggtcgccacgagcacttgggtgctagtaggcggagtcctcgcagctctggccgcgtattgcctgacaacaggcagcgtggtcattgtaggcaggatcatcttgtccggaaagccggctattgtacccgacagggaagtcctctaccagcagttcgatgagatggaagagtgcgccacacacctcccttacatcgaacaaggaatgcagctcgccgaacaattcaagcagaaggcactcgggttgctacagacagccaccaagcaagcagaggctgctgctcccgtggtggagtccaagtggcgagcccttgagagcttctgggcgaagcatatgtggaatttcatcagcgggatacaatacttagcaggcttgtccactctgcctgggaaccccgcaatagcatcactgatggcattcacagcctctatcaccagcccgctcaccacccaacataccctcctgtttaatatcttgggaggatgggtggccgcccaactcgccccccccagcgctgcttctgctttcgtaggcgccggcatcgccggcgcggccgttggcagtataggccttgggaaggtgctagtggacatcttggcgggttatggagcgggggtggcaggcgccctcgtggcctttaaggtcatgagtggtgagatgccttccactgaggacttggtcaacttgctccctgccatcctctcccctggcgccctagtcgtcggggtagtgtgcgcagcaatactgcgtcggcatgtgggcccaggggagggggctgtgcagtggatgaaccgactgatagcgttcgcttcgcggggtaaccacgtctcccccacgcactatgtgcccgagagcgacgctgcagcgcgtgtcactcagatcctctccagccttaccatcactcagctgctgaagaggctccatcagtggatcaatgaggactgctctacgccatgctccggctcgtggctaagggatgtttgggactggatatgcacggtgttaactgacttcaagacctggctccagtccaagctcctgccgcggttaccgggagtccccttcctctcatgccaacgtgggtacaagggcatctggcggggagacggcatcatgcacaccacctgcccatgtggagcgcagatcaccggacatgtcaaaaacggttccatgaggatcgttgggcctaggacctgcagcaacacgtggcatggaacattccccatcaacgcgtacaccacgggcccctgcacgccctccccggcgcccaattattctagggcgctgtggagggtggctgctgaggagtacgtggaggttacgcgggtgggggatttccactacgtgacgggcatgaccactgacaacgtaaagtgcccatgccaggttccggcccccgattttttcacggaggtggatggggtgcggctgcacaggttcgctccgccgtgcaaacctctcctacgggaggaggtcacattccaggtcgggctcaaccaatacctggtcgggtcacagctcccatgtgagcccgaaccggatgtagcggtgctcacttccatgctcaccgacccctcccacatcacagcagaggcggctaagcgtaggctggccagggggtctcccccctccttagccagctcttcagctagccagttgtctgcgccttccttgaaggcgacatgcactacccgtcatgactccccagatgctgacctcatcgaggccaatctcctgtggcggcaggagatgggcggaaacatcacccgcgtggagtcagagaacaaggtagtaattctggactctttcgagccgcttcaagcggaggaagatgagagggaagtatccgttccggcggaaatcctgcggagatccaggaaattcccccgagcgatgcccatatgggcaaggccggattacaaccctccactggtagagtcctggaaggacccggactacgtccctccggtggtacatgggtgcccattgccacctactaaggcccctccaataccacctccacggaggaaaaggacggttgtcctgacagaatccaccgtgtcttctgctttggctgagctcgccacgaagaccttcggcagctccgaatcgtcggccgtcgacagcggtacggcgaccgcccctcctgaccaggcctccgacgacggcgacgcagggtccgatgttgagtcgtactcctccatgcccccccttgagggggagccgggggatcccgatctcagcgacgggtcttggtctaccgtgagcgaggaagctagtgaggacgtcgtctgctgctcgatgtcctacacatggacaggcgccttgatcacgccatgctccgcggaggaaagcaagctgcccatcaacgcgttgagcaactctttgctgcgtcaccacaacatggtctatgccacaacatctcgcagcgcaagccagcggcagaagaaggtcacctttgacagactgcaggtcctggacgaccactaccgggacgtgctcaaggaggtgaaggcgaaggcgtccacagttaaggctagacttctatccgtagaagaagcctgcaagctgacgcccccacactcggccaaatccaaatttggctatggggcaaaggacgtccggaacctatccagcaaggccattaaccacatccgctccgtgtggaaggacttgctggaggacactgagacaccaattgacaccaccatcatggcaaaaaatgaggttttctgcgtccaaccagagaaaggaggccgcaagccagctcgcctcatcgtattcccagacttgggggttcgtgtgtgcgagaaaatggccctttatgacgtggtctccacccttcctcaggccgtgatgggctcctcatacgggtttcagtactctcctggacagcgagtcgagttcctggtgaatgcctggaaaaaaaagaaaaaccctatgggcttcgcatatgacactcgctgttttgactcaacggtcaccgagagtgacatccgtgttgaggagtcaatctaccaatgttgtgacttggcccccgaagctagacaggccataaggtcgctcacagagcggctctatatcgggggtcccctgactaactcaaaagggcagaactgcggttatcgccggtgccgcgcgagcggtgtgctgacgactagctgcggtaataccctcacatgttacttgaaggcctctgcagcctgtcgagctgccaagctccaggactgcacgatgctcgtgtgcggggacgaccttgtcgttatctgtgaaagcgcgggaacccaggaagacgcggcgagcctacgagtcttcacggaggctatgactaggtactctgccccccccggggacccgcccaaaccagaatacgacttggagttgataacatcatgctcctccaatgtgtcggtcgcgcacgatgcatctggcaaaagggtgtactacctcacccgtgaccccaccaccccacttgcacgggctgcgtgggagacagctagacacactccagttaactcctggctaggcaacatcattatgtatgcgcccaccttatgggcaaggatgatcctgatgactcatttcttctccatccttctagctcaggagcaacttgaaaaggccctagattgccaaatctacggggcctgttactccattgagccacttgacctacctcagatcattgagcgactccatggtcttagcgcattttcactccatagttactctccaggtgagatcaatagggtggctgcatgcctcaggaaacttggggtaccgcccttgcgagtctggagacatcgggccagaagtgtccgcgctaagctactgtcccagggggggagggctgccacttgcggcaaatacctcttcaactgggcagtaaagaccaagcttaaactcactccaattccggctgcgtcccagttggacttatccagctggttcgttgctggctacagcgggggagacatatatcacagcctgtctcgtgcccgaccccgctggttcatgctgtgcctactcctactttctgtaggggtaggcatctacttgctccccaatcga

SEQ ID NO: 616 - DNA, 9359 bp, Hepatitis C Virus
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggataaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggtggtggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggcaggacctgggctcagcccgggtacccttggcccctctatggcaatgagggcatggggtgggcaggatggctcctgtcaccccgcggctctcggcctagttggggccccacggacccccggcgcaggtcgcgtaatttgggtaaggtcatcgataccctcacatgcggcttcgccgacctcatggggtacattccgctcgtcggcgcccccctagggggcgctgccagggccctggcgcatggcgtccgggtcctggaggacggcgtgaactatgcaacagggaatttgcccggttgctctttctctatcttcctcttggctttgctgtcctgcttgaccatcccagcttccgctattgaagtgcgcaacgtgtccggagtgtaccatgtcacgaacgactgctccaactcaagcattgtgtttgaagcagcggacatgattatgcatacccccgggtgcgtgccctgcgttcgggaggacaattcctcccgatgctgggtagcgctcactcccacactcgcggccaggaattccagcatccccactacgacaatacgacgtcacgtcgatttgctcgttgggacggctgctttctgctccgctatgtacgtgggagatctttgcggatctgtttttcttgtctctcagctgttcaccttctcgcctcgccggcatgagacagtacaggactgcaattgttcgatctatcccggccacgtatcgggtcaccgcatggcttgggacatgatgatgaactggtcacctacaacagctctagtggtgtcgcagttactccggatcccacaagctgtcgtggacatggtggcgggagcccactggggagtcctggcgggcctcgcctactattccatggtggggaactgggctaaggtcttgattgtgatgctactttttgccggcgtcgatggggatacacacgtggtggggggggagacggcccgtagtgccttcagctttgcgcgcttctttagcgttgggccgtcgcagaaaatccagcttataaacaccaacggcagctggcatatcaacaggaccgccctgaactgtaatgactccctcagcaccgggttccttgccgcgctgttctacgcccacaggttcaactcgtccggatgcccggagcgcatggccagctgccgccccattgacaagttcgctcaggggtggggtcccatcacttacgctaagccggccagcttggaccagaggccctattgttggcactacgcaccccgaccgtgcggtattgtacccgcgtcgcaggtgtgcggtccagtgtactgcttcaccccaagccctgttgtggtggggacgaccgatcgtttcggcgtccctacgtataactggggggacaatgagacggacgtgctgcttctcaacaacacgcggccgccgcgaggcaactggttcggctgcacatggatgaatagcactgggttcaccaagacgtgcgggggccccccgtgcaacatcgggggggccggtaataacaccttgatctgccccacggattgcttccggaagcaccccgaggccacttacaccaaatgcggttcggggccctggttgacacctaggtgcatggttgactacccatacaggctttggcactacccctgcactgtcaattttaccatcttcaaggttaggatgtatgtggggggtgtggagcacaggctcaccgccgcatgcaactggactcgaggagagcgttgtgacttggaggacagggatagatcagagcttagcccgctgctgctgtctacaacagagtggcaggtattgccctgttccttcactaccctaccggctctttccaccggcttgatccatctccatcagaacaccgtggacgtgcaatacctgtacggcatagggtcagcggttgtctcctacgcaattaagtgggagtatgtcctgttgctcttccttttcctggcggacgcgcgcgtctgtgcctgcttgtggatgatgctgctaatagctcaggctgaggctgccttagagaacttggtggtcctcaacgcggcgtccgtggccggaacgcatggcatcctccctttccttgtgtttttctgtgctgcctggtacatcaagggcaggctggtccctggggcggcatatgctttctatggcatatggccgctgctcctgctcctgctggcgctgccgccacgagcatacgccatggaccgggagatggctgcatcgtgcggaggcgcggtttttataggtctggcacttttgaccttgtcaccacactataaattgttcctcgccaggctcatatggtggctacaatattttatcaccagagccgaggcgcacttgcaggtgtggatcccccccctcaacgttcgggggggccgcgatgccatcatcctcctcatgtgcgcgatccacccagagctaatctttgccatcaccaaaatcttgctcgccatactcggcccgctcatggtgctccaggcggccatcaccagggtgccgtactttgtgcgcgcccaagggctcattcgtgcatgcttgctggtgcgggaagtcgctgggggccattatgtccaaatggctttcatgaggctggccgcgctgacaggcacgtacgtgtatgatcatcttactccactacgggactgggcccacgggggcctgcgagatcttgcagtggcagttgagcccgtcgtcttctctgacatggagaccaagatcatcacctggggggcagacaccgcggcgtgtggggacatcatcttaggcctgcccgtctccgctcgcagggggagggagatacttttgggaccggcagatagttttgaggggcaggggtggcgactccttgcgcccatcacggcctatgctcaacagacgcggggtctacttggctgcatcgtcacgagcctcacgggccgggacaagaaccaggtcgagggggaggttcaggtggtttccaccgcaacacaatccttcctggcgacctgcgtcaacggcgtgtgttggactgtctaccacggcgccggcacaaagaccctcgccggccaaaagggcccaatcacccaaatgtacaccaatgtagaccaggacctcgtcggctggcaagcgcctcccggggcgcgatccctgacaccgtgcacctgtggcagctcggacctttacttggttacgaggcatgctgatgtcattccggtgcgccggcggggcgacagtagaggaagcctactctcccctaggcccgtctcctacttgaaaggttcttcgggtggtccactgctctgcccctcggggcacgctgtgggcatcttccgggctgctgtgtgcacccggggggttgcgaaggcggtggactttgtgcccgtagagtctatggaaacaactatgcggtccccggtcttcacggacaactcgtcccccccggccgtaccgcagacattccaagtggcccatctacacgcccccactggcagcggcaagagcactaaggtgccggctgcgtatgcagcccaagggtacaaggtactcgtcctgaacccatccgttgccgccaccctaggcttcggggcgtatatgtctaaggcacatggtgtcgaacctaacatcagaactggggtaaggaccatcaccacgggtgcccccattacgtattccacctatggcaagtttcttgccgacggtggttgctctgggggcgcctatgacatcataatatgtgatgagtgccactcaactgactcgactaccatcttgggcatcggcacagtcctggaccaagcggagacggctggagcgcgactcgtcgtactcgccaccgctacgcctccgggatcggtcaccgtgccacatcccaatatcgaggaggtggctctgtccaacactggagagatccccttctatggcaaagccatccccatcgagaccatcaagggggggaggcatctcatattttgccattccaggaaaaaatgtgatgagctcgccgcaaagctgtcaggtctcgggcttaacgctgtagcgtattaccggggtcttgatgtgtccgtcataccgaccagcggagacgtcgttgtcgtggcaacagacgctctaatgacgggcttcactggcgactttgactcagtgatcgactgtaatacatgtgtcactcagacggtcgacttcagcttggaccctaccttcaccattgagacgacgaccgtgccccaagacgcggtgtcgcgctcgcagcggcgaggcaggactggtaggggcagggcaggcatctacaggtttgtgactccaggagaacggccctcgggcatgttcgattcctcggtcttgtgtgagtgctatgacgcgggctgtgcttggtacgagctcacgcccgccgagaccacagttaggttgcgggcttacctgaatacaccagggttgcccgtctgccaagaccatctggagttctgggaaggcgtcttcacaggtctcacccacatagatgcccacttcctgtcccagactaagcaggcaggagacaacttcccctacttggtagcataccaggctacggtgtgcgccagggctcaggccccacccccatcgtgggaccaaatgtggaagtgtctcacgcggctaaagcccgtgctgcatggcccaacacccctgctgtacaggctaggagccgtccaaaatgaggtcatcttcacacaccccataaccaaattcatcatgacatgcatggcggctgacctggaggtcgccacgagcacttgggtgctagtaggcggggtcctcgcggctctggccgcgtattgcctgacaacgggcagcgtggtcattgtaggcaggattatcttgtccggaaagccggctattgtacccgacagggaagtcctctaccaacagttcgatgagatggaagagtgcgccacacacctcccttacatcgaacaaggaatgcagctcgccgaacaattcaagcagaaggcactcgggctgctacagacagccaccaagcaagcagaggctgctgctcccgtggtggagtccaagtggcgagcccttgagagcttctgggcgaagcatatgtggaatttcatcagcgggatacaatacttagcaggcttgtccactctgcctgggaatcccgcgatagcatcactgatggcatttacggcctctatcaccagcccgctcaccacccaacataccctcctgttcaacatcttgggaggatgggtagccgcccaactcgccccccccagcgctgcttctgctttcgtgggcgccggcattgccggcgcggccgttggcagcataggccttgggaaggtgctagtggacatcttggcgggttatggagcgggggtggcaggcgctctcgtggcctttaaggtcatgagtggtgagatgccttccactgaggacttggtcaacttgctccctgctatcctctcccctggcgccttagtcgtcggggtggtgtgcgcagcaatactgcgtcggcatgtgggcccaggggagggggctgtgcagtggatgaaccggctgatagcgttcgcctcgcggggtaaccacgtctcccccacgcattatgtgcccgagagcgacgctgcggcgcgtgtcactcagatcctctccagccttaccatcactcagctgctgaagaggcttcatcagtggattaacgaggactgctccacgccatgctccggctcgtggctaagggacgtttgggattggatatgcacggtgttaactgattttaagacctggctccagtccaagctcttgccgcggttaccgggagtccccttcctttcatgccaacgtgggtacaagggcatctggcggggagacggcatcatgcaaaccacctgcccatgtggagcgcagatcaccggacatgtcaaaaacggttccatgaggatcgtcgggcctaggacctgcagcaacacgtggcatggaacattccccatcaacgcgtacaccacgggcccctgcacgccctccccggcgcccaattattccagggcgctgtggagggtggctgctgaggagtacgtggaggttacgcaggtgggggatttccactacgtgacgggcgtgaccactgacaacgtaaagtgcccatgccaggttccggctcccgaattcttcacggaggtggatggggtgcggctgcacaggttcgctccgccgtgcaaacctctcctacgggaggaggtcacattccaggtcgggctcaaccaatacctggtcgggtcgcagctcccatgtgagcccgaaccggatgtagcagtgctcacttccatgctcaccgacccctcccacatcacagcagaggcggctaagcgtaggctggccagggggtctcccccctccttagccagctcttcagctagccagttgtctgcgccttccttgaaggcgacatgcactacccgtcatgactcccctgatgccgacctcatcgaggccaatctcctgtggcggcaggagatgggcgggaacatcacccgcgtggagtcagagaacaaggtagtaattctggactctttcgagccgcttcgagcggaggaagatgagagggaagtatccgttccggcagaaatcctgcgaagatccaggaaatttccccgagcgatgcccatatgggcaaggccggattacaaccctccactggtagagtcctggaaggacccggactacgtccctccggtggtacatgggtgcccattgccacctactaaggcccctccgataccacctccacggaggaaaaggacggttgtcctgacagagtccaccgtgtcttctgctttggctgagctcgccacaaagaccttcggcagctccgaatcgtcgaccgtcgacagcggtacggcgaccgccccccctgaccagccctccgacgacggcgacgcagggtccgacgttgagtcgtactcctccatgcccccccttgagggggagccgggggatcccgatctcagcgacgggtcttggtctaccgtgagcgaggaagctagtgaggacgtcgtctgctgctcgatgtcctacacatggacaggcgccttgatcacgccatgctccgcggaggaaagcaagctgcccatcaacgcgttgagcaactctttgctgcgtcaccacaatatggtctatgccacaacatctcgcagcgcaagccagcggcagaagaaggtcacctttgacagactgcaagtcctggacgaccactaccgggacgtgctcaaggaggtgaaggcgaaggcgtccacagttaaggctagacttctatccgtagaagaagcctgcatgctgacgcccccacactcggccaaatccaaatttggctatggggcaaaggacgtccggaacctatctagcaaggccattaaccacatccactccgtgtggaaggacttgctggaagacactgagacaccaattgacaccaccatcatggcaaagaatgaggttttctgcgtccaaccagagaagggaggccgcaagccagcccgcctcatcgtattcccagacttgggggttcgtgtgtgcgagaaaatggccctttatgacgtggtctccacccttcctcaggccgtgatgggctcctcatacgggtttcagtactctcctggacagcgggtcgagttcctggtgaatgcctggaagaaaaagaaaaaccctatgggcttcgcatatgacactcgctgttttgactcaacggtcaccgagagtgacatccgtgttgaggagtcaatctaccaatgttgtgacttggcccccgaagctagacaggccataaggtcgctcacagagcggctttatattgggggtcccctgactaactcaaaagggcagaactgcggttatcgccggtgccgcgcgagcggtgtgctgacgaccagctgcggtaataccctcacatgttacttgaaggcctctgcagcctgtcgagctgccaagctccaggactgcacaatgctcgtgtgcggagacgaccttgtcgttatctgtgaaagcgctggaacccaggaggacgcggcgagcctacgagtcttcacggaggctatgactaggtactctgccccccccggggacccgcccaagccagaatacgacttggagttgataacatcatgctcctccaatgtgtcggtcgcgcacgatgcatctggcaaaagggtgtactatctcacccgtgaccccaccaccccacttgcacgggctgcgtgggagacagctagacacactccagttaactcctggctaggcaacatcattatgtatgcgcccaccttatgggcaaggatgatcctgatgactcacttcttctccatccttctagctcaggaacaacttgaaaaggctctagattgtcagatctatggggcctgttactccattgagccacttgacctacctcagatcattcaacgactccatggccttagcgcattttcactccatagttactctccaggtgaaatcaatagggtggctgcatgcctcagaaaacttggggtaccacccttgcgagtctggagacatcgggccagaagtgtccgcgctaagctcctgtcccagggggggagggctgccaactgtggcaaatacctcttcaactgggcagtaaggaccaagcttaaactcactccaattccggctgcgtcccagttggacttatccagctggttcgttgctggttacagcgggggagacatatatcacagcctgtctcgtgcccgaccccgctggttcatgttgtgcctactcctactttccgtaggggtaggcatctacttgctccccaaccga

SEQ ID NO: 617 - DNA, 9359 bp, Hepatitis C Virus
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggtggtggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggcaggacctgggctcagcccgggtacccttggcccctctatggcaatgagggcatggggtgggcaggatggctcctgtcaccccgtggctctcggcctagttggggccccacggacccccggcgtaggtcgcgtaatttgggtaaggtcatcgataccctcacatgcggcttcgccgacctcatggggtacattccgctcgtcggcgcccccctagggggcgctgccagggccctggcgcatggcgtccgggtcctggaggacggcgtgaactacgcaacagggaatatgcccggttgctctttctctctcttcctcatggctttgctgtcctgtttgaccatcccaacttccgctatcgaagtgcgcaacgtgtccggagtataccatgtcacgaacgactgctccaacgcaagcatcgtgtatgaagcagcggacatgattatgcatacccccgggtgcgtgccctgcgttcgggagaacaactcctcccgctgctgggtggcgctcactcccacgctcgcggccaggaactccagcatccccactacgacaatacgacgtcacgtcgatctgctcgttgggacggctgctttctgctccgctatgtacgtgggagatttttgcggatctgttttccttgtctctcagctgttcaccttctcgcctcgcgtgcatgagacaatacaggaatgcaattgctcaatctatcccggccacgtatcgggtcaccgcatggcttgggacatgatgatgaactggtcacctacaacagctctagtggtgtcgcagttactccggatcccacaagctgtcgtggacatggtggcgggagcccactggggagtcctggcgggcctcgcctactattccatggcggggaactgggctaaggtcttggttgtgatgctactttttgccggcgtcgacgggaggacttacgcgacggggaaggcgcaggcccgcactgtcagtaagtttacgtccctcttcacggcagggccgtcccaaaaactccagcttgtgaacaccaacggcagctggcacatcaacaggactgccctgaactgcaatgactccctcaacaccgggtttcttgccgcgctgttctacacccacagcttcaactcgtccggatgcccggagcgcatggccagctgccgccccattgacaagttcgctcaggggtggggtcccatcacttacgttaagccgccccgcttggaccagaagccctattgttggcactacgcaccccaaccatgcggtattgtacctgcatcacaggtgtgcggtccagtgtactgtttcaccccaacccctgttgtggtggggacgaccgatcggttcggcgtccctacgtataattggggggagaatgagacggacgtgctgcttctcaacaacacgcggccgccgcgaggcaactggttcggctgcacatggatgaatggcactgggttcaccaagacgtgcgggggccccccgtgcaacatcgggggggtcggtaatgacaccttgatctgccccacggattgcttccggaagcaccctgaggccacttacaccaaatgcggttcggggccctggctgacacccaggtgcatggttgactacccatacaggctttggcactacccttgcactgtcaatttttccatcttcaaggttaggatgtatgtggggggtgtggagcacaggctcgatgccgcatgcaactggacccgaggagagcgttgtgacctggaggacagggatagatcagagcttagcccgctgctgctgtctacaacagagtggcaggtactgccctgttctttcactaccctaccggctctgtccaccggcttgatccatctccaccagaacatcgtggacgtgcaatacctatacggtatagggtcagcggttgtctcctacgcaattaagtgggagtatgtcctgttgctcttccttttcctggcggacgcgcgcgtctgtgcctgcttgtggatgatgctgctaatagctcaggctgaggccgccttagggaacttggtggtcctcaatgcggcgtccgtggctggagcgcatggcattcttccttttcttgtgttcttctgtgctgcctggtacatcaagggcaggcttgtccctggggcggcatacgctttctatggcgtatggccgctgctcctgctcctgctggcgttgccaccacgagcatacgccatggaccgggagatggctgcatcgtgcggaggcgcggtttttataggtctggcactcttgaccttgtcaccatactataaggcgttcctcgccaggctcatatggtggttacaatattttatcaccagagccgaggcgcacttgcaggtgtggattccccccctcaatgctcgggggggccgcgatgccatcatcctcctcatgtgcgtggtccacccagagctaatctttgccatcaccaaaaacttgctcgccatacttggcccgctcatggtgctccaggctggcataaccaaggtgccgtactttgtgcgcgcccatgggctcattcgtgcatgcatgctggtgcggcaggtcgctgggggtcattatgtccaaatggctctcatgaggctggctgcactgacaggcacgtacgtttatgaccatcttactccactgcgggactgggcccacgagggcctacgagaccttgcagtggcagttgagcccgtcgtcttctctgacatggagaccaagatcatcacctggggggcagacaccgcggcgtgtggggacatcatctcaggcctgcctgtctccgcccgcaggggaagggaggtacttttgggaccggcagatagtcttaaggggcaggggtggcgactccttgcgcccatcacggcctacgcccagcagacgcggggcctacttggctgcatcgtcaccagcctcacaggccgggacaagaaccaggtcgagggggaggttcaagtggtttccaccgcaacacaatctttcctggcgacctgcatcaacggcgtgtgttggactgtctaccacggtgccggcacaaagaccctcgccggccaaaagggcccaatcacccaaatgtacaccaatgtagaccaggacctcgtcggctggcaagcgcctcccggggcgcgatccttgacaccgtgtacttgtggcagctcggacctttacttggtcacgaggcatgctgatgtcattccggtgcgccggcggggcgacagcagaggaagcctactctcccccaggcctgtctcctacttgaagggctcttcgggtggtccactgctctgcccttcggggcatgctgtgggcatcttccgggctgctgtgtgcacccggggggtcgcgaaagcggtggactttgtgcccgttgagtctatggaaacaactatgcggtccccggtcttcacggacaactcgtcccccccggctgtaccgcagacattccaagtggcccatctacacgctcccactggcagcggcaagagcactaaggtgcctgctgcgtatgcagcccaagggtacaaggtactcgtcctgaacccgtctgttgccgccaccttaggtttcggggcgtatatgtccaaggcacatggtgtcgaccctagcatcagaactggggtaaggaccgtcaccacgggtgctcccattacatactccacctatggcaagtttcttgccgacggtggttgctctgggggcgcctatgacatcataatatgtgatgagtgccactcaactgactcaactaccatcttgggcatcggcacagtcctggaccaagcggagacggctggagcgcgactcgtcgtactcgccaccgctacgcctccgggatcggtcaccgtgccacatcccaatatcgaggaggtggctctgtccaacactggagagatccccttctacggtaaagccatccccatcgagaccatcaagggggggaggcacctcatattttgccattccaggaaaaaatgtgatgagctcgccgcgaagctgtcgggtctcggccttaacgctgtggcgtattaccggggtcttgatgtgtccatcataccgaccagcggagacgtcgttgtcgtggcaacagacgctctaatgacgggtttcactggcgactttgactcagtgatcgactgtaatacatgtgtcatccagacagtcgacttcagcttggaccctaccttcaccattgagacgacgaccgtgccccaagacgcggtgtcgcgctcgcagcggcgaggcaggactggtaggggcaggacaggcatctacaggtttgtgactccaggagaacggccctcgggcatgttcgattcctcggtcctgtgtgagtgctatgacgcgggctgtgcttggtacgagctcacgcccgccgagacctcagttagattgcgggcttacctgaatacaccagggttgcccgtctgccaggaccatctagagttctgggagggcgtcttcacaggcctcacccacatagatgcccacttcctgtcccagactaagcaggcaggagacaacttcccctacttggtggcataccaggctacggtgtgcgccagggctcaggctccacccccatcgtgggaccaaatgtggaaatgtctcatacggctaaagcctacgctgcacgggccaacacccttgctgtataggctaggagccgtccaaaacgaggtcaccctcacacaccccataaccaaattcatcatggcatgcatgtcggctgacctggaggtcgccacgagcacctgggtgctagtaggcggggtcctcgcagctctggccgcgtattgcctgacaacaggcagcgtggtcattgtaggcaggatcatcttgtccggaaagccggctattgtgcccgacagggaagtcctctaccagcagttcgatgagatggaagagtgcgccacgcacctcccttacattgaacaaggaatgcacctcgccgaacaattcaagcagaaggcactcgggttgctacagacagccaccaagcaagcagaagctgctgctcccgtggtggagtccaagtggcgagctcttgagagcttctgggcgaagcatatgtggaatttcatcagcgggatacaatacttagcaggcttgtccactctgcctgggaaccccgccatagcatcactgatggcattcacagcttctatcaccagcccgcttaccacccaacataccctcctgttcaacattttggggggatgggtggccgcccaactcgccccccccggcgctgcttctgctttcgtaggcgccggcatcgccggcgcggctgttggcagcataggccttgggaaggtgctagtggacatcttggcgggttatggagcgggggtggcaggcgccctcgtggcctttaaggtcatgagtggcgagatgccttccactgaggacttggttaacttgctccctgccatcctctcccctggtgccctagttgtcggggtagtgtgcgcagcaatactgcgtcggcatgtgggcccaggggagggggctgtgcagtggatgaaccggctgatagcgttcgcttcgcggggtaaccacgtctcccccacgcactatgtgcccgaaagcgacgctgcagcgcgcgtcactcagatcctctccagccttaccatcactcagctgctgaagaggctccatcagtggattaatgaggactgctccacgccatgctccggctcgtggctaagggacgtttgggactggatatgcatggtgttaagtgattttaagacctggctccagtccaagctcctgccgcggttaccgggagtccccttcctctcatgtcaacgtgggtacaggggcatttggcggggagacggcatcatgcaaaccacctgctcatgtggagcgcggatcaccggacatgtcaagaacggttccatgaggatcgttgggcctaggacctgtagcaacacgtggcatggaacattccccatcaacgcatacaccacgggcccctgcacgccctccccggcgcccaattattccagggcgctgtggagggtggctgctgaggagtacgtggaggtcaagcgggtgggggatttccactacgtgacgggcatgaccactgacaacgtaaagtgcccatgccaggttccggcccccgaattcttcacggaggtggacggggtgcggctgcacaggtacgctccgccgtgcaagcctctcctgcgggaggaggtcacattccaggtcgggctcaaccaatacgtggtcgggtcacagctcccatgcgagcccgagccggatgtagcggtgcttacttccatgctcaccgacccctcccacatcacagcagagacggctaagcgtaggctggccagagggtctcccccctccttagccagctcttcagctagccagttgtctgcgccttccttgaaggcgacatgcccttaccttcatgactccccagacgctgacctcatcgaggccaatctcctgtggcggcaggagatgggcgggaacatcacccgcgtggagtcagagaacaaggtagtaattctggactctttcgagccgcttcgagcggaggaagatgagagggaagtgtccgttccggcggaaatcctgcggagatccaggaaatttccccgagcgatgcccatatgggcaaggccggattacaaccctccactgatagagtcctggaaggacccggactacgtccctccggtggtacacgggtgcccattgccacctactaaggcccctccaataccacctccacggaggaaaaggacggttgtcctgacagaatccaccgtgtcttctgccctggctgagctcgccacaaagaccttcggcagctctgaatcgtcggccgtcgacagcagcacggcgatcgccccccctgaccagctctccaaagacggcgacgcagggtccgatgttgagtcgtgctcctccatgcccccccttgagggggaaccgggggatcccgatctcagcgacgggtcttggtctaccgtgagcgaggaagctagtgaggacgtcgtctgctgctcgatgtcctacacatggacaggcgccctgatcacgccatgctccgcggaggaaagcaagctgcccatcaacgcgctgagcaactctttgctgcgtcaccacaacatggtctatgccacaacatctcgcagcgcaagccagcggcagaagaaggtcacctttgacagactgcaggtcctggacgaccattaccgggacgtgctcaaggagatgaaggcgaaggcgtccacggttaaggccaaacttctatccgtagaagaagcctgtatgctaacgcccccacactcggccaaatccaaatttggctatggggcaaaggacgtccggaacctgtccagcaaggccattaaacacatccgctccgtgtgggaggacttgctggaagacactgagacaccaattgacaccaccatcatggcaaaaaatgaggttttctgtgtccaaccagagaaaggaggccgcaagccagctcgccttatcgtattcccagacttgggggttcgtgtgtgcgagaaaatggccctttatgacgtggtctccactcttcctcaggccgtgatgggctcctcatacgggttccagtactctcctggacagcgggttgagttcctggtgaatgcctggaaaaagaagaagaaccccatgggcttcgcatatgacacccgatgttttgactcaacggtcaccgagagtgacatccgtgttgaggagtcaatctaccaatgttgtgacttggcccccgaagccaggcaggccataaggtcgctcacagagcggctttatatcgggggtcccctgactaactcaaaagggcagaactgcggttatcgccggtgccgcgccagcggtgtgctgacgaccagctgcggtaataccctcacatgttacttgaaggcctctgcagcctgtcgagctgccaagctccaggactgcacaatgcttgtgtgcggagacgaccttgtcgtcatctgtgaaagcgcgggaacccaggaggacgcggcgagcctacgagtcttcacggaggccatgactaggtactctgccccccctggggacccgcccaaaccagaatacgacttggagttgataacatcatgctcctccaacgtgtcggtcgcgcacgatgcatctggtaaaagggtgtactacctcacccgtgaccccaccaccccacttgcacgggcggcgtgggagacagctagacacactccagtcaactcctggctaggcaacatcattatgtatgcgcccaccttatgggcaaggatgatcctgatgactcacttcttctccatccttctagctcaggaacaacttgaaaaggctctagattgtcagatctacggggcctgttactccattgagccacttgacctacctcagatcattcagcgactccatggtcttagcgcattttcactccatagttactctccaggtgaaatcaatagggtggctgcatgcctcagaaagcttggggtaccacccttgcgagtctggagacaccgggccagaagtgtccgcgctaagctcctgtcccagggagggagggctgccaactgcggcaaatacctcttcaactgggcagtaaggaccaagcttaaactcactccaattccggctgcgtcccagttggacttgtccagctggttcgttgctggttacagcgggggagacatatatcacagcctgtctcgtgcccggccccgctggttcatgttgtgcctactcctactctccgtaggggtaggcatctacctgctccccaaccga

SEQ ID NO: 618 - DNA, 9359 bp, Hepatitis C Virus
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgttaagttcccgggtggtggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggcaggacctgggctcagcccgggtacccttggcccctctatggcaatgagggcatggggtgggcaggatggctcctgtcaccccgtggctctcggcctagttggggccccacggacccccggcgtaggtcgcgtaatttgggtaaggtcatcgataccctcacatgcggcttcgccgacctcatggggtacattccgctcgtcggcgcccccctagggggcgccgccagggccctggcgcatggcgtccgggtcctggaggacggcgtgaactatgcaacagggaatatgcccggttgctctttctctctcttcctcatggctttgctgtcctgtttgaccatcccaacttccgctatcgaagtgcgcaacgtgtccggagtataccatgtcacgaacgactgctccaacgcaagcatcgtgtatgaagcagtggacatgattatgcatacccccgggtgcgtgccctgcgttcgggagaacaactcctcccgctgctgggtggcgctcactcccacgctcgcggccaggaactccagcatccccactacgacaatacgacgtcacgtcgatctgctcgttgggacggctgctttctgctccgctatgtacgtgggagatttttgcggatctgttttccttgtctctcagctgttcaccttctcgcctcgcgtgcatgagacaatacaggaatgcaattgctcaatctatcccggccacgtatcgggtcaccgcatggcttgggacatgatgatgaactggtcacctacaacagctctagtggtgtcgcagttactccggatcccacaagctgtcgtggacatggtggcgggagcccactggggagtcctggcgggcctcgcctactattccatggcggggaactgggctaaggtcttggttgtgatgctactttttgccggcgtcgacggggggacttacacgtcggggggggcgcagggccacactacctataagtttgcgtccctcttcacggtagggccatcccaaaaactccagcttgtgaacaccaacggcagctggcacatcaacaggactgccctgaactgcaatgactccctcaacaccgggtttcttgccgcgctgttctacacccgcagcttcaactcgtccggatgcccggagcgcatggccagctgccgccccattgacaagttcgctcaggggtggggtcccatcacttacgttaagccgccccgcttggaccagaagccctattgttggcactacgcaccccaaccatgcggtattgtacctgcatcacaggtgtgcggtccagtgtactgtttcaccccaacccctgttgtggtggggacgaccgatcggttcggcgtccctacgtataattggggggagaatgagacggacgtgctgcttctcaacaacacgcggccgccgcgaggcaactggttcggctgcacatggatgaatggcactgggttcaccaagacgtgcgggggccccccgtgcaacatcgggggggtcggtaatgacaccttgatctgccccacggattgcttccggaagcaccctgaggccacttacgccaaatgcggttcggggccctggctgacacccaggtgcatggttgactacccatacaggctttggcactacccttgcactgtcaatttttccatcttcaaggttaggatgtatgtggggggtgtggagcacaggctcaatgccgcatgcaactggacccgaggagagcgttgtgacctggaggacagggatagatcagagcttagcccgctgctgctgtctacaacagagtggcaggtcctgccctgttctttcactaccctaccggctctgtccactggcttgatccatctccaccagaacatcgtggacgtgcaatacctatacggtatagggtcagcggttgtctcctacgcaattaagtgggagtatgtcctgttgctcttccttctcctggcggacgcgcgcgtctgtgcctgcttgtggatgatgctgctagtagctcaggctgaggccgccttagggaacttggtggtcctcaatgcggcgtccgtggctggagcgcatggcattcttccttttcttgtgttcttctgtgctgcctggtacatcaagggcaggcttgtccctggggcggcatacgctttctatggcgtatggccgctgctcctgctcctgctggcgttgccaccacgagcatacgccatggaccgggagatggctgcatcgtgcgggggcgcggtttttataggtctggcactcttgaccttgtcaccacactataaggcgttcctcgccaggctcatatggtggttacaatactttatcaccagagccgaggcgcacttgcaggtgtggattccccccctcaatgttcgggggggccgcgatgccatcatcctcctcatgtgcgtggtccacccagagctaatctttgccatcaccaaaaacttgctcgccatacttggcccgctcatggtgctccaggctggcataaccaaggtgccgtactttgtgcgcgcccatgggctcattcgtgcatgcatgctggtgcggcaggtcgctgggggtcattatgtccaaatggctctcatgaggctggctgcactgacaggcacgtacgtttatgaccatcttactccactgcgggactgggcccacgagggcctacgagaccttgcagtggcagttgagcccgtcgtcttctctgacatggagaccaagatcatcacctggggggcagacaccgcggcgtgtggggacatcatctcaggcctgcctgtctccgcccgcaggggaagggaggtacttctgggaccggcagatagtcttaaggggcaggggtggcgactccttgcgcccatcacggcctacgcccagcagacgcggggcctacttggctgcatcgtcaccagcctcacaggccgggacaagaaccaggtcgagggggaggtccaagtggtttccaccgcaacacaatctttcctggcgacctgcatcaacggcgtgtgttggactgtctaccacggtgccggcacaaagaccctcgccggccaaaagggcccaatcacccaaatgtacaccaatgtagaccaggacctcgtcggctggcaagcgcctcccggggcgcgatccttgacaccgtgtacttgtggcagctcggacctttacttggtcacgaggcatgctgatgtcattccggtgcgccggcggggcgacagcagaggaagtctactctcccccaggcccgtttcctacttgaagggctcttcgggtggcccactgctctgcccttcggggcatgcggtgggcatcttccgggctgctgtgtgcacccggggggtcgcgaaggcggtggactttgtgcccgctgaggctatggaaacaactatgcggtccccggtcttcacggacaattcgtcccccccggccgtaccgcaggcataccaagtggcccatctacacgctcccactggcagcggtaagagcactaaggtgccggctgcgtatgcagcccaagggtacaaggtactcgtcctgaacccgtctgttgccgccaccttaggtttcggggcgtatatgtccaaggcatatggtgtcgaccctaacatcagaactggggtaaggaccgtcaccacgggtgctcccattacatactccacctatggcaagtttcttgccgacggtggttgctctgggggcgcctatgacatcataatatgtgatgagtgccactcaactgactcaactaccatcttgggcattggcacagtcctggaccaagcggagacggctggagcgcgactcgtcgtactcgccaccgctacgcctccgggatcggtcaccgtgccacatcctaatatcgaggaggtggctctgtccaacactggagagatccccttctacggtaaagccatccccatcgagaccatcaagggggggaggcacctcatattttgccattccaggaaaaaatgtgatgagctcgccgcgaagctgtcgggtctcggccttaacgctgtggcgtattaccggggtcttgatgtgtccgtcataccgaccagcggagacgtcgttgtcgtggcaacagacgctctaatgacgggtttcactggcgactttgactcagtgatcgactgtaatacatgtgtcatccagacagtcgacttcagcttagaccctaccttcaccattgagacgacgaccgtgccccaagacgcggtgtcgcgctcgcagcggcgaggcaggactggtaggggcaggacaggtatctacaggtttgtgactccaggagaacggccctcgggcatgttcgattcctcggtcctgtgtgagtgctatgacgcgggctgtgcttggtacgagctcacgcccgccgagacctctgttagattgcgggcttacctgaatacaccagggttgcccgtctgccaggaccatctagagttctgggagggcgtcttcacaggcctcacccacatagatgcccacttcctgtcccagaccaagcaggcaggagacaacttcccctacttggtagcataccaggctacggtgtgcgccagggctcaggctccacccccatcgtgggaccaaatgtggaaatgtctcatacggctaaagcctacgctgcacgggccaacacccttgctgtataggctaggagccgtccaaaacgaggtcaccctcacacaccccataaccaaattcatcatggcatgcatgtcggctgacctggaggtcgccacgagcacctgggtgctagtaggcggggtcctcgcagctctggccgcgtattgcctgacaacaggcagcgtggtcattgtaggcaggatcatcttgtccggaaagccggctattgtgcccgacagggaagttctctaccagcaattcgatgagatggaagagtgcgccacgcacctcccttacattgaacaaggaatgcacctcgccgaacaattcaagcagaaggcactcgggttgctacagacagccaccaagcaagcagaagctgctgctcctgtggtggagtccaagtggcgagctcttgagagcttctgggcgaagcatatgtggaatttcatcagcgggatacagtacttagcaggcttgtccactctgcctgggaaccccgccatagcatcactgatggcattcacagcttctatcaccagcccgcttaccacccaacataccctcctgttcaacattttggggggatgggtggccgcccaactcgccccccccggcgctgcttctgctttcgtaggcgccggcatcgccggcgcggctgttggcagcataggccttgggaaggtgctagtggacatcttggcgggttatggagcgggggtggcaggcgccctcgtggcctttaaggtcatgagtggcgagatgccttccactgaggacttggtcaacttgctccctgccatcctctcccccggtgccctagttgtcggggtagtgtgcgcagcaatactgcgtcggcatgtgggcccaggggagggggctgtgcagtggatgaaccggctgatagcgttcgcttcgcggggtaaccacgtctcccccacgcactatgtgcccgaaagcgacgctgcagcgcgcgtcactcagatcctctccagccttaccatcactcagctgctgaagaggctccatcagtggatcaatgaggactgctccacgccatgctccggctcgtggctaagggacgtttgggactggatatgcatggtgttaagtgattttaagacctggctccagtccaagctcctgccgcggttaccgggagtccccttcctctcatgtcaacgtgggtacaggggcatttggcggggagacggcatcatgcaaaccacctgctcatgtggagcgcggatcaccggacatgtcaagaacggttccatgaggatcgttgggcctaggacctgtagcaacacgtggcatggagcattccccatcaacgcatacaccacgggcccctgcacgccctccccggcgcccaattattccagggcgctgtggagggtggctgctgaggagtacgtggaggtcaagcgggtgggggatttccactacgtgacgggcatgaccactgacaacgtaaagtgcccatgccaggttccggcccccgaattcttcacggaggtggacggggtgcggctgcacaggtacgctccgccgtgcaagcctctcctgcgggaggaggtcacattccaggtcgggctcaaccaatacgtggtcgggtcacagctcccatgcgagcccgagccggatgtagcggtgctcacttccatgctcaccgacccctcccacatcacagcagagacggctaagcgtaggctggccagagggtctcccccctccttagccagctcttcagctagccagttgtctgcgccttccttgaaggcgacatgcccttaccttcatgactccccagacgctgacctcatcgaggccaatctcctgtggcggcaggagatgggcgggaacatcacccgcgtggagtcagagaacaaggtagtaattctggactctttcgagccgcttcgagcggaggaagatgagagggaagtgtccgttccggcggaaatcctgcggagatccaggaaatttccccgagcgatgcccatatgggcaaggccggattacaaccctccactgatagagtcctggaaggacccggactacgtccctccggtggtacacgggtgcccattgccacctactaaggcccctccaataccacctccacggaggaaaaggacggttgtcctgacagaatccaccgtgtcttctgccctggctgagctcgccacaaagaccttcggcagctctgaatcgccggccgtcgacaacagcacggcgattgccccccctgaccagctctccaaagacggcgacgcagggtccgatgttgagtcgtgctcctccatgcccccccttgagggggagccgggggatcccgatctcagcgacgggtcttggtctaccgtgagcgaggaagctggtgaggacgtcgtctgctgctcgatgtcctacacatggacaggcgccctgatcacgccatgctccgcggaggaaagcaagctgcccatcaacgcgctgagcaattctttgctgcgtcaccacaacatggtctatgccacaacatctcgcagcgcaagccagcggcagaagaaggtcacctttgacagactgcaggtcctggacgaccattaccgggacgtgctcaaggagatgaaggcgaaggcgtccacggttaaggccaaacttctatccgtagaagaagcctgtaagctaacgcccccacactcggccaaatccaaatttggctatggggcaaaggacgtccggaacctgtccagcaaggccgttaaacacatccgctccgtgtgggaggacttgctggaagacactgagacaccaattgacaccaccatcatggcaaaaaatgaggttttctgtgtccaaccagagaaaggaggccgcaagccagctcgccttatcgtattcccagacttgggggttcgtgtgtgcgagaaaatggccctttatgacgtggtctccactcttcctcaggccgtgatgggctcctcatacgggttccagtactctcccggacagcgggttgagttcctggtgaatgcctggaaaaagaagaagaaccccatgggcttcgcatatgacacccgatgttttgactcaacggtcaccgagagtgacatccgtgttgaggagtcaatctaccaatgttgtgacttggcccccgaagccaggcaggccataaggtcgctcacagagcggctttatatcgggggtcccctgactaattcaaaagggcagaactgcggttatcgccggtgccgcgccagcggtgtgctgacgaccagctgcggtaataccctcacatgttacttgaaggcctctgcagcctgtcgagctgctaagctccaggactgcacaatgcttgtgtgcggagacgacctcgtcgttatctgtgaaagcgcgggaacccaggaggacgcggcgagcctacgagtcttcacggaggccatgactaggtactctgccccccctggggacccgcccaaaccagaatacgacttggagttgataacatcatgctcctccaacgtgtcggtcgcgcacgatgcatctggtaaaagggtgtactacctcacccgtgaccccaccaccccacttgcacgggcggcgtgggagacagctagacacactccagtcaactcctggctaggcaacatcattatgtatgcgcccaccttatgggcaaggatgatcctgatgactcacttcttctccatccttctagctcaggaacaacttgacaaggctctagattgtcagatctacggggcctgttactccattgagccacttgacctacctcagatcattcagcgactccatggtcttagcgcattttcactccatagttactctccaggtgaaatcaatagggtggctgcatgcctcagaaagcttggggtaccacccttgcgagtctggagacaccgggccagaagtgtccgcgctaagctcctgtcccagggagggagggctgccaactgtggcaaatacctcttcaactgggcagtaaggaccaagcttaaactcactccaattccggctgcgtcccagttggacttgtccagctggttcgttgctggttacagcgggggagacatatatcacagcctgtctcgtgcccggccccgctggttcatgttgtgcctactcctactctccgtaggggtaggcatctacctgctccccaaccga

SEQ ID NO: 619 - DNA, 9359 bp, Hepatitis C Virus
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggtggtggtcagatcgttggtggagtttacctgttgccgcgcaggggccccaggttgggtgtgcgcgcgactaggaagacttccgagcggtcgcaacctcgtggaaggcgtcaacctatccccaaggctcgccggcacgagggcaggacctgggcccagcccgggtacccttggcccctctatggcaatgagggcatggggtgggcaggatggctcctgtcaccccacggctctcggcctaattggggccccaccgacccccggcgtaggtcgcgtaatttgggtaaggtcatcgataccctcacatgcggcttcgccgacctcatggggtacattccgctcgtcggcgcccccctagggggcgttgccagggccctggcgcatggcgtccgggtcctggaggacggcgtgaactatgcaacagggaatttgcccggttgctctttctctatcttcctcttggctttgctgtcctgtttgaccatcccagcttccgctatcgaagtgcgcaacgtgtccggagcgtaccatgtcacgaacgactgctccaacgcaagcattgtgtatgaggcagcggacatgattatgcatacccccgggtgcgtgccctgcgttcgggagggcaactcctcccgctgctgggtagcgctcactcccacgctcgcggccaggaactccagcatccccaccacgacaatacgacgtcacgtcgatttgctcgttgggacggctgctttctgctccgctatgtacgtgggagatctttgcggatctgttttccttgtatctcagctgttcaccttctcgcctcgtcggcataagacagtacaggactgcaattgctcaatctatcccggccatgtatcgggtcatcgcatggcttgggacatgatgatgaactggtcacctgcagcagctctagtggtgtcgcagttgctccggatcccacaagccgtcgtggacatggtggcgggggcccactggggagtcctggcgggcctcgcctactattccatggtggggaactgggctaaggttttgattgtgatgctactttttgccggcgtcgacgggcagacttacacgacgggtggggcgcaggcccgtactgtccaggggtttacgtccctcttcgcgtctggcccgtcccaaaaactccagcttgtaaacaccaacggcagctggcacatcaacaggactgccctgaactgcaatgactccctcaacactgggttcattgccgcgctgttctacgcccgcaacttcaacgcgtctggatgcccggagcgcatggccagttgccgccctattgacaagttcgctcaggggtggggtcccattacccatgttaagccgcccagctcggaccagaagccctattgttggcactacgcaccccaaccgtgcggtattgtacctgcgtcgcaggtgtgcggtccggtgtactgtttcaccccaagccctgttgtggtggggacgaccgatcggttcggcgtccctacgtatagctggggggtgaatgagacggacgtgctgctccttaacaacacgcggccgccgcgaggtaactggttcggctgcacatggatgaatggcactgggttcaccaagacgtgcgggggccccccgtgcaacatcgggggggtcggtaatgacaccttgatctgccccacggattgcttccggaagcaccccgaggccacttacaccaaatgcggttcggggccctggctgacacctaggtgcatggttgactacccatacaggctttggcactacccctgcactgtcaatttttccatcttcacggttaggatgtatgtggggggtgtggagcacaggctcaaagccgcatgcaactggacccgaggagagcgttgtgacttggaggacagggatagatcagagcttagcccgctgctgctgtccacgacagagtggcaggtgttgccctgttccttcaccaccctaccggctctgtccaccggcttgatccatctccatcggaacatcgtggacgtgcaatacctgtacggtgtagggtcagtggttgtctcctacgcagttaaatgggagtatatcctgttgctcttccttttcctggcggacgcgcgcgtctgtgcctgcttgtggatgatgctgctagtagctcaggctgaggccgccttagagaacttggtggtcctcaatgcggcgtccgtggccggaacgcatggcattctctccttccttgtgttcttctgcgctgcctggtacatcaagggcaggctggtccctggggcggcatatgctttctatggcgtatggcccctgctcctgctcctgctggcgttgccaccacgagcatacgccatggaccgggagatggctgcatcgtgcggaggcgcggtttttataggtctggcacttttgaccttatcaccacactataaagtgttcctcgccaggctcatatggtggttacaatattttatcgccagagccgaggcgcacttgcaggtgtggatcccccccctcaacgttcgggggggccgcgatgccatcatcctcctcacgtgcgtggcccacccagaactaatttttgccatcaccaaaatcttgctcgccatactcggcccgctcatggtgctccaggctggcataaccagggtgccgtactttgtgcgcgcccatgggctcattcgtgcatgcatgctggtgcggaaagtcgctgggggccattatgtccaaatggccttcatgaagctggccgcaatgacaggcacgtacgtttatgaccatctcactccactgcgggactgggcccacgagggcctacgagaccttgcagtagcagttgagcccgtcgtcttctctgacatggagaccaagatcatcacctggggggcagacaccgcggcgtgtggggacatcatcttaggcctgcccgtctctgcccgcagggggagggaaatacttttgggaccagcagatagtcttgaggggcaggggtggcgactccttgcgcccatcacggcctatgcccaacagacgcggggcctacttggctgcattgtcaccagtctcacaggccgggacaagaaccaggtcgagggggaggttcaagtggtttccaccgcaacacaatctttcctggcgacctgcgtcaacggcgtgtgttggactgtctaccacggcgccggcacaaagaccctcgccggccaaaagggcccaatcacccaaatgtataccaatgtagaccaggatctcgtcggctggcaagcgcctcccggggcgcgatccttgacaccgtgcacctgtggcagctcggacctttacttggtcacgaggcatgctgatgtcattccggtgcgccggcggggcgacagcagaggaagcctactctcccccaggcccgtctcctacttgaagggctcttcgggtggtccattgctctgcccctcggggcatgcagtgggcatcttccgggctgctgtgtgcacccggggggttgcgaaggcggtggactttgtgcccgttgagtctatggaaacaactatgcggtctccggtcttcacggacaactcgtcccccccggccgtaccgcagacattccaagtggcccatctacacgctcccactggcagtggcaagagcactaaggtgccggctgcgtatgcagcccaagggtacaaggtactcgtcctgaacccatctgttgccgccaccctaggtttcggggcgtatatgtctaaggcacatggtgtcgaccccaacatcagaactggggtgaggaccatcaccacgggtgcccccattacgtactccacctatggcaagtttcttgccgatggtggttgctctgggggcgcctatgacatcataatatgtgatgagtgtcactcaactgactcgactaccatcatgggcatcggcacagtcctggaccaagcggagacggctggagcgcgactcgtcgtactcgccaccgctacgcctccagggtcggttaccgtgccacatcccaacatcgaggaggtggctctgtccaacatcggagagatccccttctatggtaaagccatccccatcgagaccatcaagggggggaggcacctcatattttgtcattccaggaaaaaatgtgatgagcttgcagcaaagctatcgggtctcgggctcaacgctgtagcgtattaccggggtcttgatgtgtccgtcataccgaccaacggagacgtcgttgtcgtggcaacagacgctctaatgacgggtttcactggcgactttgactcggtgatcgactgtaatacatgtgtcacccagacagtcgacttcagcttggaccctaccttcaccattgagacgacgaccgtgccccaagacgcggtgtcgcgctcgcagcggcgaggcaggactggcaggggcaggccaggcatctacaggtttgtgactccaggagaacggccctcgggcatgttcgattcctcggtcctgtgtgagtgctatgacgcgggctgtgcttggtacgagctcacgcccgccgagaccacagttaggttgcgggcttacctgaatacaccagggttgcccgtctgccaggaccatctggagttctgggagggtgtcttcacaggcctcacccacatagatgcccacttcctgtcccagactaagcaggcaggggacaacttcccctacttggtagcataccaggctacggtgtgcgccagggctcaggctccacccccatcgtgggaccaaatgtggaaatgtctcatacggctgaagcccacgctgcacgggccaacacccctgctgtataggctgggagccgtccagaatgaggttaccctcacacaccccataactaaattcatcatggcatgcatgtcggctgacctggaggtcgccacgagcacctgggtgctagtaggcggagtcctcgcagctctggccgcgtattgcctgacaacaggcagcgtggtcattgtaggcagaatcatcttgtctggaaagccggctattgtacccgatagggaagtcctctaccagcagttcgatgaaatggaggagtgcgccacacacctcccttacatcgaacaaggaatgcagctcgccgaacaattcaagcagaaggcactcgggttgttacagacagccaccaagcaagcggaggctgctgctcccgtggtggagtctaagtggcgagcccttgagagcttctgggcgaagcatatgtggaatttcatcagcgggatacaatacttagcaggcttgtctactctgcctggaaaccctgcaatagcatcactgatggcattcacagcctctatcaccagcccgctcaccacccaacataccctcctgttcaacattctggggggatgggtggctgcccaactcgccccccccagcgctgcttccgcttttgtaggcgccggcatcgccggcgcggccattggcagcataggccttgggaaggtgctagtggacatcttggcgggttatggagcgggggtggcaggcgccctcgtggcctttaaggtcatgagtggtgagatgccttccactgaggacttggtcaacttgctccctgccatcctctcccctggtgccctagtcgtcggggtagtgtgcgcagcaatactgcgtcggcatgtgggcccaggggagggggctgtgcagtggatgaaccggctgatagcgttcgcttcgcggggtaaccacgtctcccccacgcactatgtgcccgagagcgacgctgcagcgcgtgtcactcagatcctctccagccttaccatcactcaactgctgaagaggctccatcagtggattaacgaggactgctccacgccatgctccggttcgtggctaagggacgtttgggactggatatgcacggtgttaactgattttaagacctggctccagtccaagctcctgccgcggttaccgggagtccccttcctctcatgccaacgtgggtataggggcatctggcggggagacggcatcatgcaaaccacctgcctatgtggagcgcagatcaccggacatgtcaaaaacggctccatgaggatcactgggcccaggacctgcagcaacacgtggcatggaacattccccatcaacgcatacaccacgggcccctgcacgccctccccggcgcccaattattccagggcgctgtggagggtggctgctgaggagtacgtggaggttacgcgggtgggggatttccactacgtgacgggcatgaccacagacaacgtaaagtgcccatgccaggttccggcccccgaattcttcacggaggtggatggggtgcggttgcacaggtacgctccgccgtgcaagcctctcctacgggaggaggtcacattccaggtcgggctcaaccaatacctggtcgggtcgcagctcccatgtgagcccgaaccggatgtggcggtgcttacttccatgctcaccgacccctcccatatcacagcagaggcggctaagcgtaggctggccagggggtctcccccctccttagccagctcttcagctagccagctgtctgcgccttccttgaaggcgacatgcactacccgtcacgactccccagatgctgacctcatcgaggccaatctcttgtggcggcaggagatgggcgggaacatcacccgtgtggagtcagagaacaaggtagtaattctggactctttcgagccgcttcgagcggaggaagatgagagggaggtatccgttccggcggaaatcctgcggagatccaggaaatttccccgagcgatgcccatatgggcaaggccagattacaaccctccactggtggagtcctggaaggacccggactacgttcctccggtggtgcatgggtgcccattgccacctactaaggcccctccaataccacctccacggaggaaaaggacggttgtcctgacagaatccaccgtgtcttctgccttggctgagctcgccacaaagacctttggcagctccgaatcgtcggccgtcgacagcggcacggcgaccgcccctctagaccagccctccgacgacggtgacgcagggtccgatgttgagtcgtactcctccatgcccccccttgagggggagccgggggatcccgatctcagcgacgggtcttggtctaccgtgagcgaggaagctagtgaggacgtcgtctgctgctcgatgtcctacacatggacaggcgccctgatcacgccatgctccgcggaggaaagcaagctgcccattaacgcgttgagcaactctttgctgcgtcaccacaacatggtctatgccacaacatctcgcagcgcgagccagcggcagaagaaggtcacctttgacagactgcaggtcctggacgaccattaccgggacgtgctcaaggagatgaaggcgaaggcgtccacagttaaggcaaaacttctatccatagaagaagcctgcatgctgacgcccccacactcggccaaatccaaatttggctatggggcgaaggacgtccggaacctatccagcaaggccattaaccacatccgctccgtgtggaaggacttgctggaagacactgagacaccaattgacaccaccatcatggcaaaaaacgaggttttctgcgtccaaccagagagaggaggccgcaagccagctcgccttatcgtattcccagacttgggggttcgtgtgtgcgagaaaatggccctctatgatgtggtctccactcttcctcaggccgtgatgggctcctcatacgggttccagtactctcctggacagcgggtcgagttcctggtgaatgcctggaaaaaaaagaaaaaccctatgggattcgcatatgacacccgccgttttgactcaacggtcactgagagtgacatccgtgttgaggagtcaatttaccaatgttgtgacttggcccccgaagccagacaggctataaaatcgctcacagagcggctttatatcgggggtcccctgactaattcaaaagggcagagctgtggttatcgccggtgccgcgcgagcggcgtgctgacgactagctgcggtaataccctcacatgttacttgaaagcctctgccgcctgtcgagctgcaaagctccaggactgcacgatgctcgtgaacggagacgaccttgtcgttatctgtgaaagcgcgggaacccaggaggatgcggcgagcctacgagtcttcacggaggctatgactaggtactctgccccccccggggacccgcccaaaccagaatacgacttggagttgataacatcatgctcctccaatgtgtcggtcgcgcacgatgcatctggcaaaagggtgtactacctcactcgtgaccccaccaccccactcgcacgggctgcgtgggagacagctagacacactctagtcaactcctggctaggcaacatcatcatgtatgcgcccaccttatgggtgaggatggtcatactgcctcacttcttctccatcctcctagctcaggaacaacttgaaaaagctctagagtgtcagatttacggggcctgttactctattgagccacttgacctacctcagatcattcagcgactccatggtcttagcgcattttcactccatagttactctccaggtgaaatcaatagggtggctgcatgcctcagaaaacttggggtaccacccttgcgagtctggagacatcgggccagaagtgtccgcgctaagctcctgtcccagggggggagggctgccaactgtggcaaatacctcttcaactgggcagtaaggaccaagcttaaactcactccaattccggctgcgtcccagttggacttgtccagctggttcgtcgctgggtacagcgggggagacatatatcacagcgtgcctcgtgcccgaccccgctggttcatgttgtgcctactcctactttccgtgggggtaggcatctacttgctccccaaccga

SEQ ID NO: 620 - DNA, 9359 bp, Hepatitis C Virus
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggtggtggtcagatcgttggtggagtttacctgttgccgcgcaggggccccaggttgggtgtgcgcgcgactaggaagacttccgagcggtcgcaacctcgtggaaggcgtcaacctatccccaaggctcgccgtcacgagggcaggacctgggcccagcccgggtacccttggcccctctatggcaatgagggcatggggtgggcaggatggctcctgtcaccccacggctctcggcctaattggggccccaccgacccccggcgtaggtcgcgtaatttgggtaaggtcatcgataccctcacatgcggcttcgccgacctcatggggtacattccgctcgtcggcgcccccttagggggcgttgccagggccctggcgcatggcgtccgggtcctggaggacggcgtgaactatgcaacagggaatttgcccggttgctctttctctatcttcctcttggctttgctgtcctgtttgaccatcccagcttccgctatcgaagtgcgcaacgtgtccggagcgtaccatgtcacgaacgactgctccaacgcaagcattgtgtatgaggcagcggacatgattatgcatacccccgggtgcgtgccctgcgttcgggaggataacgcctcccgctgctgggtagcgctcactcccacgctcgcggccaggaactccagcatccccaccacgacaatacgacgccacgtcgatttgctcgttgggacggctgctttctgctccgctatgtacgtgggagatctttgcggatctgtcttccttgtatctcagctgttcaccttctcgcctcgtcggcatgagacggtacaggaatgcaattgctcaatctatcccggccatgtatcgggtcatcgcatggcttgggacatgatgatgaactggtcacctgcaacagctctagtggtgtcgcagttgctccggatcccacaagctgtcgtggacatagtggcgggggcccactggggagtcctagcgggcctcgcctactattccatggtggggaactgggctaaggtcttggttgtgatgctactttttgctggcgtcgacgggcagacttacgtgacggggagctcgcagggccgcaccgccctcggtattgcgagcctcttctcgtctggaccatcccaaaaaatccagcttgtaaacaccaacggcagctggcacatcaacagtactgccttgaactgcaatgactccctcaacactgggttcattgccgcgctgttctacgcccgcaacttcaacgcgtctggatgcccggagcgcatggccagttgccgccctattgacaagttcgctcaggggtggggtcccattacccatgttaagccgcccagctcggaccagaagccctattgttggcactacgcaccccaaccgtgcggtattgtacctgcgtcgcaggtgtgcggtccggtgtactgtttcaccccaagccctgttgtggtggggacgaccgatcggttcggcgtccctacgtatagctggggggtgaatgagacggacgtgctgctccttaacaacacgcggccgccgcgaggtaactggttcggctgcacatggatgaatggcactgggttcaccaagacgtgcgggggccccccgtgcaacatcgggggggtcggtaatgacaccttgatctgccccacggattgcttccggaagcaccccgaggccacttacaccaaatgcggttcggggccctggctgacacctaggtgcatggttgattacccatacaggctttggcactacccctgcactgtcaatttttccatcttcacggttaggatgtatgtggggggtgtggagcacaggctcaaagccgcatgcaactggacccgaggagagcgttgtgacttggaggacagggatagatcagagcttagcccgctgctgctgtctacgacagagtggcaggtattgccctgttccttcaccaccctaccggctctgtccaccggcttgatccatctccatcggaacatcgtggacgtgcaatacctgtacggtgtagggtcagtggttgtctcctacgcagttaagtgggagtatatcctgttgctcttccttttcctggcggacgcgcgcgtctgcgcctgcttgtggatgatgctgctagtagctcaggctgaggccgccttagagaacttggtggtcctcaatgcggcgtctgtggccggaacgcatggcactctctctttccttgtgttcttctgtgctgcctggtacatcaagggcaggctggtccctggggcggcatacgctttctatggcgtgtggccgctgcttctgctcctgctggcgttgccaccacgagcatacgccatggaccgggaggtggctgcatcgtgcggaggcgcggttcttataggtctggcacttctgaccttgtcaccacactataaggtgttcctcgccaggctcatatggtggttacaatattttatcaccagagccgaggcgcacttgcaggtgtggatcccccccctcaacgttcgggggggccgcgatgccatcatcctcctcacgtgcgtggtccacccagaactaatttttgccatcaccaaaatcttgctcgccatactcggcccgctcatggtgctccaggctggcataaccagggtgccgtactttgtgcgcgcccatgggctcattcgtgcatgcatgctggtgcggaaagtcgctgggggccattatgtccaaatggccttcatgaagctggccgcaatgacaggcacgtacgtttatgaccatctcactccactgcgggactgggcccacgagggcctacgagaccttgcagtagcagttgagcccgtcgtcttctctgacatggagaccaagatcatcacctggggggcagacaccgcggcgtgtggggacatcatcttaggcctgcccgtctctgcccgcagggggagggaaatacttttgggaccagcagacagtcttgaggggcaggggtggcggctccttgcgcccatcacggcctatgcccaacagacgcggggcctacttggttgcatcgtcaccagtctcacaggccgggacaagaaccaggtcgagggggaggttcaagtggtttccaccgcaacacaatctttcctggcgacctgcgtcaacggcgtgtgttggactgtctaccacggcgccggcacaaagaccctcgccggccaaaagggcccaatcacccaaatgtataccaatgtagaccaagatctcgtcggctggcaagcgcctcccggggcgcgatccttgacaccgtgcacctgtggcagctcggacctttacttggtcacgaggcatgctgatgtcattccggtgcgccggcggggcgacagcagaggaagcctactctcccccaggcccgtctcctacttgaagggctcttcgggtggtccattgctctgcccctcggggcatgcagtgggcatcttccgggctgctgtatgcacccggggggttgcgaaggcggtggactttgtacccgttgagtctatggaaacaactatgcggtctccggtcttcacggacaactcgtcccccccggccgtaccgcagacattccaggtggcccatctacacgctcccactggcagcggcaagagcactaaggtgccggctgcgtatgcagcccaagggtacaaggtactcgtcctgaacccgtctgttgccgccaccctaggtttcggggcgtatatgtctaaggcacatggtgtcgaccccaacatcagaactggggtgaggaccatcaccacgggtgcccccattacgtactctacctatggcaagttccttgccgacggtggttgctctgggggcgcctatgacatcataatatgtgatgagtgccactcaactgactcgactaccatcatgggcatcggcacagtcctggatcaagcggagacggctggagcgcgactcgtcgtactcgccaccgctacgcctccaggatcggttaccgtgccacatcccaacatcgaggaggtggctctgtccaacgtcggagagatccccttctatggtaaagccatccccatcgagaccatcaagggggggaggcacctcatattttgccattccaggaaaaaatgtgatgagctcgcagcaaagctgtcgggtctcggcctcaacgctgtagcgtattaccggggtcttgatgtgtccgtcataccgaccagcggagacgtcgttgtcgtggcaacagacgctctaatgacgggtttcactggcgactttgactcggtgatcgactgtaatacatgtgtcacccagacagtcgacttcagcttggaccctaccttcaccattgagacgacaaccgtgccccaagacgcggtgtcgcgctcgcagcggcgaggcagaactggcaggggcaggccaggcatctacaggtttgtgactccaggagaacggccctcgggcatgttcgattcctcggtcctgtgtgagtgctatgacgcgggctgtgcttggtacgagctcacgcccgccgagaccacagttaggttgcgggcttacctgaatacaccagggttgcccgtttgccaggaccatctggagttctgggagggcgtcttcacaggcctcacccacatagatgcccacttcctgtcccagactaagcaggcaggggacaacttcccctacttggtagcataccaggctacggtgtgcgccagggctcaggctccacccccatcgtgggaccaaatgtggaaatgtctcatacggctaaagcccacactgcacgggccgacacccctgctgtataggctgggagccgtccagaatgaggttaccctcacacaccccataactaaattcatcatggcatgcatgtcggctgacctggaggtcgccacgagcacctgggtgctagtaggcggagtcctcgcagctctggccgcgtattgcctgacaacaggcagcgtggtcattgtaggcaggatcatcttgtctggaaagccggctattgtacccgatagggaagtcctctaccagcagttcgatgagatggaggagtgcgccacgcacctcccttacatcgaacaaggaatgcagctcgccgaacaattcaagcagaaggcactcgggttgttacagacagccaccaagcaagcggaggctgctgctcccgtggtggagtccaagtggcgagcccttgagagcttctgggcgaagcatatgtggaatttcatcagcgggatacaatacttagcaggcttgtctactctgcctggaaaccctgcaatagcatcactgatggcattcacagcctctatcaccagcccgctcaccacccaacataccctcctgttcaacattctggggggatgggtggctgctcaactcgccccccccagcgctgcttccgcttttgtaggcgccggcatcgccggcgcggccattggcagcataggccttggaaaggtgctagtggacatcttggcgggttatggagcgggggtggcaggcgccctcgtggcctttaaggtcatgagtggtgagatgccttccactgaggacttggtcaacttgctccctgccatcctctcccctggtgccctagtcgtcggggtagtgtgcgcagcaatactgcgtcggcatgtgggcccaggggaaggggctgtgcagtggatgaaccggctgatagcgttcgcttcgcggggtaaccacgtctcccccacgcactatgtgcccgagagcgacgctgcagcgcgtgtcactcagatcctctccagccttaccatcactcaactgctgaagaggctccatcagtggattaacgaggactgctccacgccatgctccggctcgtggctaagggacgtttgggactggatatgcacggtgttaactgattttaagacctggctccagtccaagctcctgccgcggttaccgggagtccccttcctctcatgccaacgtgggtataggggcatctggcggggagacggcatcatgcaaaccacctgcctatgtggagcgcagatcaccggacatgtcaaaaacggctccatgaggatcactgggcccaggacctgcagcaacacgtggcatggaacattccccatcaacgcatacaccacgggcccctgcacgccctccccggcgcccaattattccagggcgctgtggagggtggctgctgaggagtacgtggaggttacgcgggtgggggatttccactacgtgacgggcatgaccacagacaacgtaaagtgcccatgccaggttccggcccccgaattcttcacggaggtggatggggtgcggctgcacaggtacgctccgccgtgcaagcctctcctacgggaggaggtcacattccaggtcgggctcaaccaatacctggtcgggtcgcagctcccatgtgagcccgaaccggatgtggcggtgcttacttccatgctcaccgacccctcccatatcacagcagaggcggctaagcgtaggctggccagggggtctcccccctccttagccagctcttcagctagccagctgtctgcgccttccttgaaggcgacatgcactacccgtcacgactccccagatgctgacctcatcgaggccaatctcttgtggcggcaggagatgggcgggaacatcacccgtgtggagtcagagaacaaggtagtaattctggactctttcgagccgcttcgagcggaggaagatgagagggaggtatccgttccggcggagatcctgcggagatccaggaaatttccccgagcgatgcccatatgggcaaggccagattacaaccctccactggtagagtcctggaaggacccggactacgttcctccggtggtgcatgggtgcccattgccacctactaaggcccctccaataccacctccacggaggaaaaggacggttgtcctaacagagtccaccgtatcttccgccttggctgagctcgccacaaagacctttggcagctccgaatcgtcggccgtcgacagcggcacggcgaccgccccccttgaccagccctccgacgacggcgacgcagggtccgacgttgggtcgtactcctccatgcccccccttgagggggagccgggggatcccgatctcagcgacgggtcttggtctaccgtaagcgaggaagctagtgaggacgtcgtctgctgctcgatgtcctacacatggacaggcgccctgatcacaccatgctccgcggaggaaagcaagctgcccattaacgcgttgagcaactctttgctgcgccaccacaacatggtctatgccacaacatctcgcagcgcgagccagcggcagaagaaggtcacctttgacagactgcaagtcctggacgaccattaccgggacgtgctcaaggagatgaaggcgaaggcgtccacggttaaggcaaaacttctatccatagaagaagcctgcatgctgacgcccccacactcggccaaatccaaatttggctacggggcgaaggacgtccggaacctatccagcaaggccattaaccacatccgctccgtgtggaaggacttgctggaagacactgagacaccaattgacaccaccatcatggcaaaaaatgaggttttctgcgtccaaccagagaaaggaggccgcaagccagctcgccttatcgtattcccagacttgggggttcgtgtgtgcgagaaaatggccctctatgatgtggtctccactcttcctcaggccgtgatgggctcctcatacgggttccagtactctcctggacagcgggtcgagttcctggtgaatgcctggaaaaaaaagaaaaaccctatgggattcgcatatgacacccgctgttttgactcaacggtcactgagagtgacatccgtgttgaggagtcaatttaccaatgttgtgacttggcccccgaagccagacaggctataaagtcgctcacagagcggctttacatcgggggtcccctgactaattcaaaagggcagagctgtggttatcgccggtgccgcgcgagtggcgtgctgacgactagctgcggtaataccctcacatgttacttgaaagcctctgcagcctgtcgagctgcaaagctccaggactgcacgatgctcgtgaacggagacgaccttgtcgttatctgtgaaagcgcgggaacccaggaggatgcggcgagcctacgagccttcacggaggctatgactaggtattccgccccccccggggactcgccccaaccagaatacgacttggagctgataacatcatgttcctccaatgtgtcagtcgcgcacgatgcatctggcaaaagggtgtactacctcactcgtgatcccaccacccccattgcacgggctgcgtgggagacagctagacacactccagtcaactcctggctaggcaacatcatcatgtatgcgcccaccttatgggtgaggatggtcatactgcctcacttcttctccattctcctagctcaggaacaacttgaaaaagctctagagtgtcagatttacggggcctgttactctattgagccacttgacctacctcagatcattcagcgactccatggtcttagcgcattttcactccatagttactctccaggtgaaatcaatagggtggctgcatgcctcagaaaacttggggtaccacccttgcgagtctggagacatcgggccagaagtgtccgcgctaagctcctgtcccagggggggagggctgccaactgtggcaaatacctcttcaactgggcagtaaggaccaagcttaaactcactccaattccggctgcgtcccagttggacttgtccagctggttcgtcgctgggtacagcgggggagacatatatcacagcgtgcctcgtgcccgaccccgctggttcatgttgtgcctactcctactttccgtgggggtaggcatctacttgctccccaaccga

SEQ ID NO: 621 - DNA, 9359 bp, Hepatitis C Virus
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggtggtggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggcaggacctgggctcagcccgggtacccttggcccctctatggcaatgagggcatggggtgggcaggatggctcctgtcaccccgcggctctcggcctagttggggccccacggacccccggcgtaggtcgcgtaatctgggtaaggtcatcgataccctcacatgcggcttcgccgacctcatggggtacattccgctcgtcggcgcccccctagggggcgctgccagagccctggcgcatggcgtccgggtcctggaggacggcgtgaactatgcaacagggaatttgcccggttgctctttctctatcttcctcttggctttgctgtcctgtttgaccattccagcttccgctattgaggtgcgcaacgtgtccggagtgtaccatgtcacgaacgactgctctaacgcaagcattgtgtatgaggcagcggacgtgattatgcatacccccgggtgcgtgccctgcgttcgggagaacaactcctcccgctgctgggtagcgctcactcccacgctcgcggccaggaactccagcgtccccactacgacaatacgacgtcatgtcgatttgctcgttgggacggctgctttctgctccgctatgtacgtgggagatctttgcggatctgtcttccttgtctctcagctgttcaccttctcgcctcgccggcatgagacagtacaggactgcaattgctcaatctatcccggccacgtatcgggtcaccgcatggcctgggacatgatgatgaactggtcacctacaacagctctagtggtgtcgcagttactccggatcccacaagctgtcgtggacatggtggcgggagcccactggggagtcctggcgggcctcgcctactattccatggtggggaactgggctaaggtcttgattgtgatgctactttttgccggcgtcgacggggagactcatacgacgggggggacgcaggcccgtgctgcctccgggcttgcgggcctcttttcgcttgggccggcccaaaaaattcagcttataaacaccaacggcagctggcacatcaataggactgccctgaactgcaatgactccctcaacactgggttccttgccgcgctgttctacacccgcaacttcaatgcgtccggatgcccggagcgcatggccagctgccgccccattgacaagttcgctcaggggtggggtcccatcacttacgctaggccgcccagcttggaccagaagccctattgctggcactacgcaccccaaccgtgcggtattgtacccgcgtcgcaggtgtgcggtccagtgtactgtttcaccccaagccctgttgtggtggggacgaccgatcgtttcggcgtccctacgtatagctggggggagaatgagacggacgtgctgcttctcaacaacacgcggccaccgcaaggcaactggttcggctgcacatggatgaatagcactgggttcaccaagacgtgcgggggccccccgtgcaacatcgggggggtcggtaatgacaccttgatctgccccacggattgcttccggaagcaccccgaggccacttacaccaaatgcggttcggggccctggctgacacctaggtgcatggttgactacccatacaggctttggcactacccctgcactgtcaattttaccatcttcaaggttaggatgtatgtgggaggtgtggagcacaggctcaccgccgcatgcaactggacccgaggagagcgttgtgacttggaggacagggatagatcagagcttagcccgctgctgctgtctacaacagagtggcaggtattgccctgttccttcaccaccctaccggctctgtccaccggcttgatccatctccatcagaacatcgtggacgtgcaatacctgtacggtatagggtcagcggttgtctcctacgcaattaagtgggagtatgtcctgctgctcttccttttcctggcggacgcgcgcgtctgcgcctgcttgtggatgatgctgctaatagctcaggctgaggccgccttagagaacttggtggtcctcaatgcggcgtccgtagccggaacgcatggcattctctctttccttgtgttcttttgtgctgcctggtacatcaagggcaggctggtccctggggcggcatatgctttctatggcgtatggccactgctcctgctcctgctggcgttgccaccacgagcatacgccatggaccgggagatggctgcatcgtgcggaggcgcggttttcataggtctggcacttctgaccttgtcaccacaatataaagtgttcctcgccaggctcatatggtggttacaatattttatcaccagagccgaggcgcacttgcaggtgtggatcccccccctcaacgttcgggggggccgcgatgccatcatcctcctcatgtgcgcggtccacccagagctaatctttaccatcaccaaaatcttgctcgccatactcggcccgctcatggtgctccaggctggcatagccagggtgccgtactttgtgcgcgcccatgggctcattcgtgcatgcttgctggtgcggaaagtcgctgggggtcattatgtccaaatggccttcatgaggctggccgcaatgacaggcacgtacgtttatgaccatctttctccactgcgggactgggcccacgagggcctacgagaccttgcagtggcagtcgagcccgtcgtcttctctgacatggagaccaagatcattacctggggggcagacactgcggcgtgtggggacatcatctcaggcctgcccgtctccgcccgcagggggagggagatacttttgggaccggcagatagtcttgaggggcaggggtggcgactccttgcgcccatcacggcctatgcccaacagacgcggggcctacttggctgcatcgtcaccagcctcacaggccgggacaagaaccaggtcgagggggaggtccaagtggtttccaccgcaacacaatctttcctggcgacctgtgtcaacggcgtgtgttggactgtctaccacggcgccggcacaaagacccttgccggccaaaagggcccaatcacccaaatgtacaccaatgtagaccaggacctcgtcggctggcaagcgcctcccggggcgcgatccttgacaccgtgcacctgtggcagctcggacctttacttggtcacgaggcatgctgatgtcattccggtgcgccggcggggcgacagcagaggaagcctgctctcccccaggcccgtctcctacttgaagggctcttcgggtggtccactgctctgcccctcggggcatgctgtgggcatcttccgagctgctgtgtgcacccggggggttgcgaaggcggtggactttgtgcccgttgagtctatggaaacaactatgcggtccccggtcttcacggacaactcgtcccccccggccgtaccgcagacattccaagtggctcatctacacgctcccactggcagcggcaagagcactaaggtgccggctgcgtatgcagcccaagggtacaaggtactcgtcctgaacccgtctgttgccgccaccctaggtttcggggcgtatatgtctaaggcatatggtgtcgaccctaacatcagaactggagtgaggaccatcaccacgggtgcccccattacgtactccacctatggcaagtttcttgccgacggtggttgctctgggggcgcctatgacatcataatatgtgatgagtgccactcaactgactcgactaccatcttgggcatcggcacagtcctggaccaagcggagacggctggagcgcgactcgtcgtactcgccaccgctacgcctccgggatcggtcaccgtgccacatcccaatatcgaggaggtggctctgtccaacactggagagatccccttctatggtaaagccatccccatcgagaccatcaagggggggaggcacctcatattttgccattccaggaaaaaatgtgatgagctcgccgcaaagctgtcgggtctcgggcttaacgctgtagcgtattaccggggtcttgatgtgtccgtcataccgaccagcggagacgtcgttgtcgtggcaacagacgctctaatgacgggtttcactggcgactttgactcagtgatcgactgtaatacatgtgtcacccagacagtcgacttcagcttggaccctaccttcaccattgagacgacgaccgtgccccaagacgcggtgtcgcgctcgcagcggcgaggcaggactggtaggggcaggacgggcatctacaggtttgtgactccaggagaacggccctcgggcatgttcgattcctcggtcctgtgtgagtgctatgacgcgggctgtgcttggtacgagctcacgcccgccgagacctcagttaggttgcgggcttacctgaatacaccagggttgcccgtctgccaggaccatctggagttctgggagggcgtcttcacaggcctcacccacatagatgcccacttcctgtcccagactaagcaggcaggagacaacttcccctacttggtagcataccaggctacggtgtgcgccagggctcaggctccacccccatcgtgggaccaaatgtggaaatgtctcatacggctaaagcccacgctgcacgggccaacacccctgctgtataggctaggagccgtccaaaatgaggtcaccctcacacaccccataaccaaattcatcatggcatgcatgtcggctgacctggaggtcgccacgagcacctgggtgctagtaggcggagtcctcgcagctctggccgcgtattgcctgacaacaggcagcgtggtcattgtaggcaggatcatcttgtccggaaagccggctattctacctgacagggaagtcctctaccaggagttcgatgagatggaagagtgcgccacacacctcccttacattgaacaaggaatgcagctcgccgaacaattcaagcagaaggcactcgggttgttacagacagccaccaagcaagcagaggctgctgctcccgtggtggagtccaagtggcgagcccttgagagcttctgggcgaagcatatgtggaatttcatcagcgggatacaatacttagcaggcttgtccactctgcctgggaaccccgcaatagcatcactgatggcattcacagcctctatcaccagcccgctcaccacccaacacaccctcctgttcaacatcttggggggatgggtggctgcccaactcgccccccccagcgctgcttctgctttcgtaggcgccggcattgccggcgcggccgttggcagcataggccttgggaaggtgctagtggacatcttggcgggttatggagcgggggtggcaggcgccctcgtggcctttaaggtcatgagtggtgagatgccttccactgaggacttggtcaacttgctccctgccatcctctcccctggtgccctagtcgtcggggtagtgtgcgcagcaatactgcgtcggcatgtgggcccaggggagggggctgtgcagtggatgaaccggctgatagcgttcgcttcgcggggtaaccacgtctcccccacgcactatgtgcctgagagcgacgccgcagcgcgtgtcactcagatcctctccagccttaccatcactcagctgctgaagaggctccatcagtggattaacgaggactgctccacgccatgctccggctcgtggctaagggacgtttgggactggatatgcacggtgttaactgattttaagacctggctccagtccaagctcctgccgcggttaccgggggtccccttcctctcatgccagcgtgggtacaagggaatctggcggggagacggcatcatgcaaaccacctgcccatgtggagcgcagatcaccggacatgtcaagaacggttccatgaggatcgttgggcccaggacctgcagcaacacgtggcatggaacattccccatcaacgcatacaccacgggcccctgcacgccctccccggcgcccaattattccagggcgctgtggagggtggctgctgaggagtacgtggaggttacgcgggtgggggatttccactacgtgacgggcatgaccactgacaacgtaaagtgcccatgccaggttccggcccccgaattcttcacggaggtggatggggtgcggctgcacaggtacgctccgccgtgcaaacctctcctacgggaggaggtcacattccaggtcgggctcaaccaatacctggtcgggtcacagctcccatgtgagcccgaaccggatgtagcggtgctcacttccatgctcaccgacccctcccacatcacagcagaggcggctaagcgtaggctggccaggggctctcccccctccttggccagctcgtcagctagccagttgtctgcgccttccttgaaggcgacatgcactacccgtcatgactccccagatgctgacctcatcgaggccaatctcctgtggcggcaggagatgggcgggaacatcacccgcgtggagtcagagaataaggtagtaattctggactctttcgaaccgcttcgagcggaggaagatgagagggaagtatccgttccggcggaaatcctgcggagatccaggaaatttccccgggcgatgcccatatgggcaaggccggattacaaccctccactggtagagtcctggaaggacccggactacgtccctccagtggtacatgggtgcccattgccacctactaaggcccctccaataccacctccacggaggaaaaggacggttgtcctgacagaatccaccgtgtcttctgccttggctgagctcgccacaaagacctttggcagctccgaatcgtcggccgtcgacagcggcacggcgaccgcccctcatgaccagccctccgacgacggagacgcagggtccgatgttgagtcgtactcctccatgcccccccttgagggggagccgggggatcccgatctcagcgacgggtcttggtctaccgtgagcgaggaagctagtgaggacgtcgtctgctgctcgatgtcctatacatggacaggcgccttgatcacgccatgctccgcggaggaaagcaagctgcccatcaacgcgttgagcaactctttgctgcgtcaccacaacatggtctatgccacaacatctcgcagcgcaagccagcggcagaagaaggtcacctttgacagactgcaggtcctggacgaccattaccgggacgtgcttaaggagatgaaggcgaaggcgtccacagttaaggccaaacttctatccgtagaagaagcctgcatgctgacgcccccacactcggccaaatccaaatttggctatggggcaaaggacgtccggaacctatccagcaaggccattaaccacatccgctccgtgtggaaggacttgctggaagacactgagacaccaattgacaccaccatcatggcaaaaaatgaggttttctgcgtccaaccagagaaaggaggccgcaagccagctcgccttatcgtattcccagacttgggggttcgcgtgtgcgagaaaatggccctttatgacgtggtctccacccttcctcaggccgtgatgggctcctcatacgggttccagtactctcctggacagcgggtcgagttcctggtgaatgcctggaaaaagaagaagaaccctatgggcttcgcatatgacacccgctgttttgactcaacggtcaccgagagtgacatccgtgttgaggagtcaatctaccaatgttgtgacttggcccccgaagccagacaggccataaggtcgctcacagagcggctttatatcgggggtcccctgactaactcaaaagggcagaactgcggttatcgccggtgccgcgcaagcggtgtgctgacgaccagctgcggtaataccctcacatgttacttgaaggcctctgcagcctgtcgagctgccaagctccaggactgcacgatgctcgtgtgcggagacgaccttgtcgttatctgtgaaagcgcgggaacccaggaggacgcggcgagcctacgagtcttcacggaggctatgactaggtactctgccccccccggggacccgcccaaaccagaatacgacttggagttgataacatcatgctcctccaatgtgtcggtcgcgcacgatgcatctggcaaaagggtgtactacctcacccgtgaccccaccaccccactcgcacgggctgcgtgggagacagctagacacactccagtcaactcctggctaggcaacatcatcatgtatgcgcccaccttatgggcaaggatgatcttgatgactcacttcttctccatccttctagctcaggaacaacttgaaaaggctctagattgtcagatctacggggcctgttactccattgagccacttgacctacctcagatcattcagcgactccatggtcttagcgcattctcactccatagttactctccaggtgaaatcaatagggtggctgcttgcctcagaaaacttggggtaccacccttgcgagtctggagacatcgggccagaagtgtccgcgctaagctcctgtcccagggggggagggctgccaactgtggcaaatacctcttcaactgggcagtaaggaccaagcttaaactcactccaattccggctgcgtcccagttggacttgtccagctggttcgttgctggttacagcgggggagacatatatcacagcctgtctcgtgcccgaccccgctggttcatgttgtgcctactcctactttccgtaggggtaggcatctacctgctccccaaccga

SEQ ID NO: 622 - DNA, 9359 bp, Hepatitis C Virus
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagaccgctagccgagtagtgttgggtcgcgaaaggccttgtggtactgcctgatagggtgcttgcgagtgccccgggaggtctcgtagaccgtgcaccatgagcacaaatcctaaacctcaaagaaaaaccaaacgtaacaccaaccgccgcccacaggacgtcaagttcccgggtggtggtcagatcgttggtggagtttacctgttgccgcgcaggggccccaggttgggtgtgcgcgcgactaggaagacttccgagcggtcgcaacctcgtggaaggcgacaacctatccccaaggctcgccgacccgagggcaggacctgggctcagcccgggtacccttggcccctctatggcaatgagggcatggggtgggcaggatggctcctgtcaccccgcggctctcggcctagttggggccccacagacccccggcgcaggtcgcgtaatttgggtaaggtcatcgataccctcacatgcggcttcgccgacctcatggggtacattccgctcgtcggcgcccccctagggggcgctgccagggccctggcgcatggcgtccgggtcctggaggacggcgtgaactatgcaacagggaatttgcccggttgctctttctctatcttcctcttggctttgctgtcctgtttgaccatcccagcctccgctatcgaagtgcgcaacgtgtccggattgtaccatgtcacgaacgactgctccaacgcaagcattgtgtatgaggcagcggacatgattatgcacacccccgggtgcgtgccctgcgttcgggagaacaattcctcccgctgctgggtagcgctcactcctacgctcgcggccaggaactccagcatccccactacgacaatacggcgtcacgtcgacttgctcgttgggacggctgctttctgctccgctatgtacgtgggggatctttgcggatctgttttccttgtctctcagctgttcaccttctcgcctcgccggcatgagacagtacaggagtgcaattgctcaatctatcccggccacgtatcgggtcaccgcatggcttgggacatgatgatgaactggtcacctacaacagctctggtggtgtcgcagctactccggatcccacaagctgtcgtggacatggtggcgggagcccactggggagtcctggcgggcctcgcctactattccatggtagggaactgggctaaggtcttggttgtgatgctactttttgccggcgtcgacgggtcgactcgcgtaatgggggggacgcaggcctatactaccagggggcttgtgaggctctttacgcctgggccgtcccaaaacatccagcttataaacaccaacggcagctggcacatcaacaggactgccctgaactgcaatgactccctcaacaccgggttccttgccgcgctgttctacacccgcaacttcaatgcgtccggatgcccggagcgcatggccagctgccgccccattgacaagttcgctcaggggtggggtcccatcacttacgctaggccgcccagcttggaccagaagccctattgctggcactacgcaccccaaccgtgcggtattgtacccgcgtcgcaggtgtgtggtccagtgtactgtttcaccccaagccctgttgtggtggggacgaccgatcgtttcggcgtccctacgtatagctggggggagaatgagacggacgtgctgcttctcaacaacacgcggccaccgcaaggcaactggttcggctgcacatggatgaatagcactgggttcaccaagacgtgcgggggccccccgtgcaacatcgggggggtcggtaatgacaccttgatctgccccacggattgcttccggaagcaccccgaggccacttacaccaaatgcggttcggggccctggctgacacctaggtgcatggttgactacccatacaggctttggcactacccctgcaccgtcaattttaccatcttcaaggttaggatgtatgtgggaggcgtggagcacaggctcaccgccgcatgcaactggacccgaggagagcgttgtgacttggaggacagggatagatcagagcttagcccgctgctgctgtctacaacagagtggcaggtattgccctgttccttcaccaccctaccggctttgtccaccggcttgatccacctccatcggaacaccgtggacgtgcaatacctgtacggtatagggtcagcggttgtctcctacgcaattaagtgggagtatgtcctgctgctcttccttttcctggcggacgcgcgcgtctgcgcctgcttgtggatgatgctgctaatagctcaggctgaggccgccctagagaacttggtggtcctcaatgcggcgtccgtagccggaacgcatggcattctctccttccttgtcttcttctgtgctgcctggtacatcaagggcaggctggtccctggggcgacatatgctttctatagcgtatggccgctgctcctgctcctgctggcgttgccaccacgagcttacgccatggaccgggagatggctgcatcgtgcggaggcgcggtttttataggtctggcactcttgaccttgtcaccacaatataaggtgttcctcgccaggctcatatggtggttacaatatttcatcaccagagccgaggcgcacctgcaggtgtggatcccccccctcaacgttcgggggggccgcgatgccatcatcctcctcatgtgcgcggtccacccagagctaatctttgccatcaccaaaattttgctcgccatactcggcccgcttatggtgctccaggctggcataaccagggtgccgtactttgtgcgcgcccatgggctcattcgtgcatgcttgctggtgcggaaagtcgctgggggtcattatgttcaaatggctttcatgaggctggccgcaatgacaggcacgtacgtttatgaccatctctctccactgcgggactgggcccacgagggcctacgagaccttgcagtggcggttgagcccgtcgtcttctccgacatggagaccaagatcatcacctggggggcagacaccgcggcgtgtggggacatcatctcaggcctgcccgtctccgcccgcagggggagggagatacttttgggaccggcagatagtcttgaggggcaggggtggcgactccttgcgcccatcacggcctatgcccaacagacgcggggcctactcggctgcatcgtcaccagcctcacaggccgggacaagaaccaagtcgagggggaggtgcaagtggtttccaccgctacacaatctttcctggcgacctgcgtcaacggcgtgtgttggactgtctaccacggcgccggcacaaagacccttgccggccaaaagggcccaattacccaaatgtacaccaatgtagaccaggacctcgtcggctggcaagcgcctcccggggcgcgatccttgacaccgtgcacctgtggcagctcggacctttacttggtcacgaggcacgctgatgtcattccggtgcgccggcggggcgacagcagaggaagcctactctcccccaggcccgtctcctacttgaagggctcttcgggtggtccactgctctgcccctcggggcatgccgtgggcatcttccgggctgccgtgtgcacccggggggttgcgaaggcggtggactttgtgcccgttgagtctatggaaacaactatgcggtccccggtcttcacggacaactcgtcccccccggccgtaccgcagacattccaagtggctcatctacacgctcccactggtagcggcaaaagcactaaggtgccggctgcgtatgcagcccaagggtacaaggtactcgtcctgaacccgtctgttgccgccaccctaggttttggggcgtatatgtctaaggcatatggtgtcgaccctaacatcagaactggggtaaggaccatcaccacgggtgcccccattacgtactccacctatggcaagtttcttgccgacggtggttgctctgggggcgcctatgacatcataatatgtgatgagtgccactcaactgactcgactaccatcttgggcatcggcacagtcctggaccaagcggagacggctggagcgcgactcgtcgtactcgccaccgctacgcctccaggatcggtcaccgtgccacatcccaatatcgaggaggtggctctgtccaacattggagagatccccttctatggtaaagccatccccatcgagaccatcaagggggggaggcacctcatattttgccattccaggaaaaaatgtgatgagctcgccgcaaagctgtcgggtctcgggcttaacgctgtagcgtattaccggggtcttgatgtgtccgtcataccgaccagcggagacgtcgttgtcgtggcaacagacgctctaatgacgggtttcaccggcgactttgactcagtgatcgactgtaatacatgtgtcacccagacagtcgacttcagcttggaccctaccttcaccattgagacgacgactgtgccccaagacgcggtgtcgcgctcgcaacggcgaggcaggactggtaggggcaggacaggcatctataggtttgtgactccaggagaacggccttcgggcatgttcgattcctcggtcctgtgtgagtgctatgacgcgggctgtgcttggtacgagctcacgcccgccgaaacctcagttaggttgcgggcttacctgaatacaccagggttgcccgtctgccaggaccatctggagttctgggagggcgtcttcacaggcctcacccacatagatgcccacttcctgtcccagactaagcaggcaggagacaacttcccctacttggtagcataccaggctacggtgtgcgccagggctcaggctccacctccatcgtgggaccagatgtggaaatgtctcatacggctaaagcccacgctgcacgggccaacacccctgctgtataggctaggagccgtccaaaatgaggtcaccctcacacatcccataaccaaattcatcatggcatgcatgtcggctgacctggaggtcgccacgagcacctgggtgctagtaggcggagtcctcgcagctctggccgcgtattgcctgacaacaggcagcgtggtcattgtaggcagggtcatcttgtccgggaagccggctattctacccgacagggaagtcctctaccaggagttcgatgagatggaggagtgcgccacacacctcccttacattgaacaaggaatgcagctcgccgaacaattcaagcagaaggcactcgggttgttacagacagccaccaagcaagcagaggctgctgctcccgtggtggagtccaagtggcgagcccttgagagcttctgggcgaagcacatgtggaatttcatcagcgggatacaatacttagcaggcttgtccactctgcctgggaaccccgcaatagcatcactgatggcattcacagcctccatcaccagcccgctcaccacccaacacaccctcctgttcaacatcctggggggatgggtggctgcccaactcgccccccccagcgctgcttctgctttcgtaggcgccggcattgctggcgcggccgttggcagcataggccttgggaaggtgctagtggacatcttggcgggttatggagcgggggtggcaggcgccctcgtggcctttaaggtcatgagtggtgagatgccttccactgaggacttggtcaacttgctccctgccatcctctcccctggtgccctggtcgtcggggtagtgtgcgcagcaatactgcgtcggcatgtgggcccaggggagggggctgtgcagtggatgaaccggctgatagcgttcgcttcgcggggtaaccacgtctcccccacgcactatgtgcctgagagcgacgccgcagcgcgtgtcactcagatcctctccagccttaccatcactcagctgctgaagaggctccatcagtggattaacgaggactgctccacgccatgctccggctcgtggctaagggacgtttgggactggatatgcacggtgttaactgattttaagacctggctccagtccaagctcctgccgcggttaccgggggtccccttcctctcatgccagcgtgggtacaagggaatctggcggggagacggcatcatgcaaaccacctgcccatgtggagcgcagattaccggacatgtcaaaaatggttccatgaggatcgtcgggcctaggacctgcagcaacacgtggcatggaacattccccatcaacgcgtacaccacgggcccctgcacgccctccccggcgcccaattactccagggcgctgtggagggtggctgctgaggagtacgtggaggttacgcgggtgggggatttccactacgtgacgggcatgaccactgacaacgtaaagtgcccatgccaggttccggcccccgaattcttcacggaggtggatggggtgcggctgcacaggtacgctccgccatgtagacctctcctacgggaggaggtcacattccaggtcgggctcaaccaatacctggtcgggtcacagctcccatgtgagcccgaaccggatgtagcggtgctcacttccatgctcaccgacccctcccacatcacagcagaggcggctaagcgtaggctggctaggggctctcccccctccttggccagctcgtcagctagccagttgtctgcgccttccttgaaggcgacatgcactacccgtcatgactccccagatgctgacctcatcgaggccaatctcctgtggcggcaggagatgggcgggaacatcacccgcgtggagtcagagaataaggtagtaattctggactctttcgaaccgcttcgagcggaggaagatgagagggaagtatccgttccggcggaaatcctgcggagatccaggaaatttccccgagcgatgcccatatgggcaaggccggattacaaccctccactggtagagtcctggaaggacccggactacgtccctccggtggtacatgggtgcccattaccacctactaaggcccctccaataccacccccacggaggaaaaggacggttgtcctgacagaatccaccgtgtcttctgccttggctgagctcgccacaaagacctttggcagctccgaatcgtcggccgtcgacagcggcacggcgaccgctccccctgaccagccctccgatgacggcgacgcagggtccgatgttgagtcgtactcttccatgcccccccttgagggagagccgggagatcccgatctcagcgacgggtcttggtctaccgtgagcgaggaagctagtgaggacgtcgtctgctgctcaatgtcctatacatggacaggcgccctgatcacgccatgctccgcggaggaaagcaagctgcccatcaacgcgttgagcaactctttgctgcgtcaccataacatggtctatgctacaacatctcgcagcgcaagccagcggcagaagaaggtcacctttgacagactgcaagtcctggacgaccattaccgggacgtgcttaaggagatgaaggcgaaggcgtccacagttaaggccaaacttctatccgtggaagaagcctgcatgctgacgcccccacactcggccaaatccaaatttggctatggggcaaaggacgtccggaacctatccagcaaggccattaaccacatccgctccgtgtggaaggacttgctggaagacactgagacaccaattgacaccaccatcatggcaaaaaatgaggttttctgcgtccaaccagagaaaggaggccgcaagccagctcgccttatcgtattcccagacttgggggttcgcgtgtgcgagaaaatggccctttatgacgtggtctccacccttcctcaggccgtgatgggctcctcatacgggttccagtactctcctggacagcgggtcgagttcctggtgaatgcctggaaaaaaaagaagaaccctatgggcttcgcatatgacacccgttgttttgactcaacggtcaccgagagtgacatccgtgttgaggagtcaatctaccaatgttgtgacttggcccccgaagccagacaggccataaggtcgcttacagagcggctttacatcgggggtcccctgactaactcaaaagggcagaactgcggttatcgccggtgccgcgcgagcggtgtgctgacgaccagctgcggtaatacccttacatgttacttgaaggcctctgcagcctgtcgagctgccaagctccaggactgcacgatgctcgtgtgcggagacgaccttgtcgttatctgtgaaagcgcgggaacccaggaggacgcggcgagcctacgagtcttcacggaggctatgactaggtactctgccccccccggggatccgcccaaaccagaatacgacttggagttgataacatcatgctcctccaatgtgtcggtcgcgcacgatgcatctggcaaaagggtgtactacctcacccgtgaccccaccaccccacttgcacgggctgcgtgggagacagctagacacactccagtcaactcctggctaggcaacatcatcatgtatgcgcccaccttatgggcaaggatgatcctgatgactcacttcttctccatccttctagctcaggaacaacttgaaaaggctctagattgtcagatctacggggcctgttactccattgagccacttgacctacctcagatcattcagcgactccatggtcttagcgcattttcactccatagttactctccaggtgaaatcaatagggtggctgcatgcctcagaaaacttggggtaccacccttgcgagtctggagacatcgggccagaagtgtccgcgctaagctcctgtcccagggggggagggctgccaactgtggcaaatacctcttcaactgggcagtgaggaccaagcttaaactcactccaattccggctgcgtcccagttggacttgtccagctggttcgttgctggttacagcgggggagacatatatcacagcctgtcttgtgcccgaccccgctggttcatgttgtgcctactcctactttctgtaggggtaggcatctacctgctccccaaccga

SEQ ID NO: 623 - DNA, 9359 bp, Hepatitis C Virus
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggtggtggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggcaggacctgggctcagcccgggtacccttggcccctctatggcaatgagggcatggggtgggcaggatggctcctgtcaccccgtggctctcggcctagttggggccccacggacccccggcgtaggtcgcgtaatttgggtaaggtcatcgacaccctcacatgcggcttcgccgacctcatggggtacattccgctcgtcggcgcccccctagggggcgctgccagggccctggcgcatggcgtccgggtcctggaggacggcgtgaactatgcaacagggaatctgcccggttgctctttctctatcttcctcttggctttgctgtcctgtttgaccatcccagcttccgctatcgaagtgcgcaacgtgtccggagtgtaccatgtcacgaacgactgctctaacgcaagcattgtgtatgaggcagcggacatgattatgcatacccccgggtgcgtgccctgcgttcgggagaacaactcctcccgctgctgggtagcgctcactcccacgctcgcggccaggaattccagcatccccactacgacaatacgacgtcacgtcgacttgctcgttgggacggctgctttctgctccgctatgtacgtgggagatctttgcggatctgttttccttgtctctcagttgttcaccttctcgcctcgccggcatgagacagtacaggactgcaattgttcaatctatcccggccacgtatcgggtcatcgcatggcttgggacatgatgatgaactggtcacctacaacagctctagtggtgtcgcagttactccggatcccacaagctgtcgtggacatagtggcgggagcccactggggagtcctggcgggccttgcctactattccatggtggggaactgggctaaggttttgattgtgatgctactttttgccggcgttgacggggagacctacacgacggggggggcgcaggcctacaacgctagcgggctcgcgtccctcttcacgtttgggccgtcccagaaaatccagcttatgaataccaacggcagctggcacatcaacaggactgccctgaactgcaatgactccctcaacactgggttccttgctgcgctgttctactacaaaaaattcaatgcgtccggatgctcggagcgcatggccagctgccgcccccttgacaagttcgctcaggggtggggtcccatcacttacgctgagccgcccaacttggaccagaagccctattgttggcactacgcaccccgaccgtgcggtatcgtacccgcgtcgcaggtgtgcggtccagtgtactgtttcaccccaagccctgttgtggtggggacgaccgatcgtttcggcgtccctacgtacagctggggggagaatgagacggacgtgctgcttctcaacaacacgcggccgccgcgaggcaactggttcggttgcacatggatgaatggcactgggttcaccaagacgtgcggaggtcccccgtgcaacatcgggggggtcggtaatgacaccttgatctgccccacggattgcttccggaagcaccccgaggccacttacaccaaatgcggttcggggccctggctgacgcctaggtgcatggttgactacccatacaggctttggcactacccctgcactgtcaattttaccatcttcaaggttaggatgtatgtggggggtgtggagcacaggctcaacgccgcatgcaactggacccgaggagagcgttgtgacttggaggacagggatagatcagagcttagcccgctgctgctgtccacaacagagtggcaggtattgccctgttccttcaccaccctaccggctctgtccactggcttgatccatctccatcggaacatcgtggacgtgcagtacctgtactgtatagggtcagcggttgtctcctacgcaattaagtgggagtatgtcctgttgctcttccttttcctggcggacgcgcgcgtctgtgcctgcttgtggatgatgctgctaatagcccaggctgaggccgccttagagaacttggtggtcctcaatgcggcgtccgtggccggaacgcacggcattttccctttccttgtgttcttctgtgctgcctggtacatcaagggcaggctggtccctggggcaacatatgctttctatggcgtatggccgctgctcctgctcctgctggcgttgccaccacgagcatacgccatggaccgggagatggctgcatcgtgcggaggcgcggtttttataggtctggcactcttgaccttgtcaccacactataaagtgttcctcgccaggctcatatggtggttacaatactttatcaccagagccgaggcgcacttgcaggtgtggatcccccccctcaacgctcgggggggccgcgatgccatcatcctcctcatgtgcgcgatccacccagagctaatctttaccatcaccaaaatcttgctcgccatactcggcccgctcatggtgctccaggctggcataaccagggtgccgtactttgtgcgcgcccatgggctcattcgtgcatgcatgctggtgcggaaagccgctgggggccattatgtccaaatggctttcatgaggctagccgcgctgacgggcacgtacgtttatgaccatcttactccactgcagaactgggctcacgagggcctacgagaccttgcggtggcagttgagcctgtcgtcttctctgacatggagaccaagatcattacctggggggcagataccgcggcgtgtggggacatcatcttaggcctgcccgtctccgcccgcagggggagggagatacttttgggaccggcagatagtcttgaggggcaggggtggcgactccttgcgcccatcacggcctatgcccaacagacgcggggcctacttggctgcatcatcaccagcctcacaggccgggacaagaaccaggtcgagggggaggttcaagtggtttccaccgcaacacaatctttcctggcgacctgcatcaacggcgtgtgttggaccgtctaccacggcgccggcacaaagaccctcgccggtcaaaaaggcccaatcacccaaatgtacaccaatgtagaccaggacctcgtcggctggcaagcgcctcctggggcgcgatccttgacaccgtgcacctgtggcagctcggacctttacttggtcacgaggcatgccgatgtcattccggtgcgccggcggggcgacagcagaggaagcctactctcccccaggcccgtctcctacttgaagggttcttcgggtggtccactgctctgcccctcggggcatgttgtgggcatcttccgggctgctgtgtgcacccggggggttgcgaaagcggtggactttgtgcccgttgagtctatggaaacaactatgcggtccccggtcttcacggacaactcgtcccctccggccgtaccgcagacattccaagtggcccatctacacgctcccactggtagcggcaagagcactaaggtgccggctgcgtatgcagcccaagggtacaaggtactcgtcttgaacccgtctgtcgccgccaccctaggtttcggggcgtatatgtctaaggcacatggtgtcgaccctaacatcagaacgggggtaaggaccatcaccacgggtgcccccattacgtactccacctatggcaagtttcttgccgacggtggttgctctgggggcgcctatgacatcataatatgtgatgagtgccactcaactgactcgactaccatcttgggcatcggcacagtcctggaccaagcggagacggctggagcgcgactcgtcgtactcgccaccgctacgcctccgggatcagtcaccgtgccacaccccaatatcgaggaagtggctctgtccaacattggagagatccccttctatggtaaagccatccccatcgagaccatcaagggggggaggcacctcatattttgccattccaagaagaaatgtgatgagctcgctgcaaagctgtcgggcctcgggcttaacgctgtagcgtattaccgaggtcttgatgtgtccgtcataccgaccagcggagacgtcgttgtcgtggcaacagacgctctaatgacgggtttcactggcgacttcgactcagtgatcgactgtaatgtatgtgtcacccagacagtcgacttcagcttggaccctactttcaccattgagacgacgaccgtgccccaagacgcggtgtcgcgctcgcagcggcgaggcaggactggcaggggcaggacaggcacctataggtttgtgactccaggagaacggccctcgggcatgttcgattcctcggtcctgtgtgagtgctatgacgcaggctgtgcttggtacgagctcacgcccgccgagacctcagttaggctgcgggcttacctgaatacaccagggttgcccgtctgccaggaccatctggagttctgggagggcgtctttacaggcctcacccacatagatgcccacttcctgtcccagactaagcaagcaggagacaacttcccctacttggtagcataccaggctacggtgtgcgccagggctcaggctccacccccatcgtgggaccaaatgtggaaatgtctcatacggcttaagcctacgctgcacgggccaacacccctgctgtataggctaggagccgtccaaaatgaggtcgtcctcacacaccccataaccaaattcatcatggcatgcatgtcggctgacctggaggtcgccacgagcacctgggtgctagtaggcggagtcctcgcagctctggccgcgtactgcctgacaacaggcagcgtggtcattgtaggcaggatcatcttgtccggaaagccggctatcgtgcccgacagggaagccctctaccagcagttcgatgagatggaagagtgcgccacacacctaccctacattgaacaaggaatgcagctcgccgaacaattcaagcagaaggcactcgggttgttgcagacagccaccaagcaagcagaggctgctgctcccgtggtggagtccaagtggcgagcccttgagagcttctgggcgaagcatatgtggaatttcatcagcgggatacaatacttagcaggcttgtccactctgcctgggaatcccgcaatagcatcactgatggcatttacagcctccatcaccagcccgctcaccacccaacataccctcctgttcaacattttggggggatgggtggctgcccaactcgccccccccagcgctgcttctgctttcgtgggcgccggcattgccggcgcggccgttggcagcataggccttgggaaggtgttagtggacatcttggcgggttatggggcgggggtggcaggcgccctcgtggccttcaaggtcatgagtggtgagatgccttccactgaggacttggtcaacttgctccctgccatcctctcccctggtgccctagtcgtcggggtagtgtgcgcagcaatactgcgtcggcatgtgggcccaggggagggggccgtgcagtggatgaaccggctgatagcgttcgcttcgcggggtaaccacgtctcccccacgcactatgtgcccgagagcgacgctgcagcgcgtgtcactcagatcctctccagccttaccatcactcagttgctgaagaggctccaccagtggatcaacgaggactgctccacgccatgctccggctcgtggctaagggacgtttgggactggatatgcacggtgttaactgattttaagacctggctccagtccaagctcctgccgcggttgccgggagtccccttcctctcatgccaacgtgggtacaagggcatatggcgcggagacggcatcatgcaaaccacctgcccatgtggagcgcagattaccggacatgtcaagaacggttccatgaggatcgttgggcctaggacctgcagcaacacgtggcatggaacattccccatcaacgcatacaccacgggcccctgcacaccctccccggcgcccaattattccagggcgctgtggagggtggctgctgaggagtacgtggaggttacgcgggtgggggatttccactacgtgacgggcatgaccactgacaacgtaaagtgcccatgccaggttccggcccccgaattcttcacggaggtggatggggtgcggctgcacaggtacgctccggcgtgcaaacctctcctacgggaggaggtcacattccaggtcgggctcaaccaatacctggtcgggtcgcagctcccatgcgagcccgaaccggatgtagcggtgctcacttccatgctcaccgacccctcccacatcacagcagaggcggctaagcgtaggctggccagggggtctcccccctccctggccagctcttcagctagccagttgtctgcgccttccttgaaggcgacatgcactacccgccatgactccccagatgctgacctcatcgaggccaatctcctgtggcggcaggagatgggcgggaacatcacccgcgtggagtcagagaacaaggtagtaattctggactctttcgagccgcttcgagcggaggaagatgagagggaagtatccgttccggcggaaatcctgcggagatccaggaaatttcctcgagcgatgcccatatgggcaaggccggattacaatcctccactggtagagtcctggaaggacccggactacgtccctccggtggtacatggatgcccattgccacctactaaggcccctccaataccacctccgcggaggaaaaggacggttgtcctgacagaatccaccgtgtcttctgccttggctgagctcgccacaaagaccttcggcagctccgaatcgtcggccgtcgacagcggcacggcgaccgcccctcctgaccagccctccgacgacggcggcgcagggtccgatgttgagtcgtactcctccatgcccccccttgagggggagccgggggatcccgatctcagcgacgggtcttggtctaccgtgagcgaggaagctagtgaggacgtcgtctgctgctcgatgtcctacacatggacaggcgctctgattacgccatgctccgcggaggaaagcaagctgcccatcaacgcgttgagcaactccttgctgcgccaccacaacatggtctatgccacaacatctcgcagcgcaagccagcggcagaagaaggtcacctttgacagactgcaggtcctggacgaccactaccgggacgtgctcaaggagatgaaggcgaaggcgtccacggttaaggctaaacttctatccatagaagaagcctgcatgctgacgcccccacactcggccaaatcgaaatttggctatggggcaaaggacgtccggagcctatccagcagggccgtttcccatatccgctccgtgtgggaggacttgctggaagacactgaaacaccaattgacaccaccatcatggcaaagaatgaggttttctgcgtccaaccagagaaaggaggccgcaagccagctcgccttatcgtattcccagacttgggggttcgtgtgtgcgagaaaatggccctttatgacgtggtctccacccttcctcaggccgtgatgggcccctcatacgggttccagtactctcctggacagcgggtcgagttcctggtgaatgcctggaaaaagaagaaaaaccctatgggcttcgcatatgacacccgctgttttgactcaacggtcactgagagtgacatccgtgttgaggagtcaatctaccaatgttgtgacttggcccccgaagccagacaggccataaggtcgctcacagagcggctttacatcgggggtcccctgactaactcaaaagggcagaactgcggttatcgccggtgccgcgcgagcggtgtactgacgaccagctgcggtaataccctcacatgttacttgaaggcctctgcagcctgtcgagctgccaagctccaggactgcacgatgctcgtgtgcggagacgaccttgtcgttatctgtgaaagcgcgggaacccaggaggacgcggcgagcctacgagtcttcacggaggctatgactaggtactctgccccccccggggacccgcccaaaccagaatacgacttggagttgataacatcatgctcctccaatgtgtcggtcgcgcacgatgcatctggcaaaagggtgtactacctcacccgtgaccccaccaccccacttgcacgggctgcgtgggagacagctagacacactccagtcaactcctggctaggcaacatcatcatgtatgcgcccaccttatgggcaaggatgatcctgatgactcacttcttctccatccttctagctcaggaacaacttgaaaaggctctagattgtcagatctacggggcctgttactccattgagccacttgacctacctcagatcattcagcgactccatggtcttagcgcattttcactccatagttactctccaggtgaaatcaatagggtggctgcatgcctcagaaaacttggggtaccacccttacgagtctggagacatcgggccagaagtgtccgcgctaagcttctgtcccagggggggagggctgccaactgtggcaaatacctcttcaactgggcagtaaggaccaagcttaaactcactccaattccggctgcgtcccagttggacttgtccagctggttcgttgctggttacagcgggggagacatatatcacagcgtgtctcgtgcccgaccccgctggttcatgttgtgcctactcctactttccgtaggggtaggcatctacctgctccccaaccga

SEQ ID NO: 624 - DNA, 9359 bp, Hepatitis C Virus
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggtggtggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggcaggacctgggctcagcccgggtacccttggcccctctatggcaatgagggcatggggtgggcaggatggctcctgtcaccccgtggctctcggcctagttggggccccacggacccccggcgtaggtcgcgtaatttgggtaaggtcatcgacaccctcacatgcggcttcgccgacctcatggggtacattccgctcgtcggcgcccccctagggggcgctgccagggccctggcgcatggcgtccgggtcctggaggacggcgtgaactatgcaacagggaatctgcccggttgctctttctctatcttcctcttggctttgctgtcctgtttgaccatcccagcttccgctatcgaagtgcgcaacgtgtccggagtgtaccatgtcacgaacgactgctctaacgcaagcattgtgtatgaggcagcggacatgattatgcatacccccgggtgcgtgccctgcgttcgggagaacaactcctcccgctgctgggtagcgctcactcccacgctcgcggccaggaactccagcatccccactacgacaatacgacgtcacgtcgacttgctcgttgggacggctgctttctgctccgctatgtacgtgggagatctttgcggatctgttttccttgtctctcagttgttcaccttctcgcctcgccggcatgagacagtacaggactgcaattgttcaatctatcccggccacgtatcgggtcatcgcatggcttgggacatgatgatgaactggtcacctacaacagctctagtggtgtcgcagttactccggatcccacaagctgtcgtggacatagtggcgggagcccactggggagtcctggcgggccttgcctactattccatggtggggaactgggctaaggttttgattgtgatgctgctatttgccggtgttgatgggaacacctacacgacagggggggcgcaagcctacaacgctagcgggctcgcgtccctcttcacggtcgggccttcccagaaagtccagctcgtgaataccaacggcagctggcacattaacaggaccgccctgaactgcaatgactccctcaacactgggttccttgctgcgctgttctactacaaaaaattcaatgcgtccggatgcccggagcgcatggccagctgccgcccccttgacaagttcgctcaggggtggggtcccatcacttacgctgagccgcccaacttggaccagaagccctattgttggcactacgcaccccgaccgtgcggtatcgtacccgcgtcgcaggtgtgcggtccagtgtactgtttcaccccaagccctgttgtggtggggacgaccgatcgtttcggcgtccctacgtacagctggggggagaatgagacggacgtgctgcttctcaacaacacgcggccgccgcgaggcaactggttcggttgcacatggatgaatggcactgggttcaccaaaacatgcgggggccccccgtgcaacatcgggggggtcggtaacgacaccttgacctgccccacggattgcttccggaagcaccccgaggccacttacaccaaatgcggttcggggccctggctgacgcctaggtgcatggttgactacccatacaggctttggcactacccctgcactgtcaattttaccatcttcaaggttaggatgtatgtggggggtgtggagcacaggctcaacgccgcatgcaactggacccgaggagagcgttgtgacttggaggacagggatagatcagagcttagcccgctgctgctgtccacaacagagtggcaggtattgccctgttccttcaccaccctaccggctctgtccactggcttgatccatctccatcggaacatcgtggacgtgcagtacctgtacggtatagggtcagcggttgtctcctacgcaattaagtgggagtatgtcctgttgctcttccttttcctggcggacgcacgcgtctgtgcctgcttgtggatgatgctgctaatagctcaggctgaggccgccttagagaacttggtggtcctcaatgcggcgtccgtggccggaacgcacggcattttctctttccttgtgttcttctgtgctgcctggtacatcaagggcaggctggtccctggggcaacatatgctttctatggcgtatggccgctgctcctgctcctgctggcgttgccaccacgagcatacgccatggaccgggagatggctgcatcgtgcggaggcgcggtttttataggtctggcactcttgaccttgtcaccacactataaagtgttcctcgccaggctcatatggtggttacagtactttatcaccagagccgaggcgcacttgcaggtgtggatcccccccctcaacgttcgggggggccgcgatgccatcatcctcctcatgtgcgcgatccacccagagctaatctttaccatcaccaaaatcttgctcgccatactcggcccgctcatggtgctccaggctggcataaccagggtgccgtactttgtgcgcgcccatgggctcattcgtgcatgcatgctggtgcggaaagccgctgggggtcattatgtccaaatggctttcatgaggctagccgcgctgacgggcacgtacgtttatgaccatcttactccactgcagaactgggctcacgagggcctacgagaccttgcggtggcagttgagcctgtcgtcttctctgacatggagaccaagatcattacctggggggcagataccgcggcgtgtggggacatcatcttaggcctgcccgtctccgcccgcagggggagggagatacttttgggaccggcagatagtcttgaggggcaggggtggcgactccttgcgcccatcacggcctatgcccaacagacgcggggcctacttggctgcatcatcaccagcctcacaggccgggacaagaaccaggtcgagggggaggttcaagtggtttccaccgcaacacaatctttcctggcgacctgcatcaacggcgtgtgttggaccgtctaccacggcgccggcacaaagaccctcgccggtcaaaagggcccaatcacccaaatgtacaccaatgtagaccaggacctcgtcggctggcaagcgcctcctggggcgcgatccttgacaccgtgcacctgtggcagctcggacctttacttggtcacgaggcatgccgatgtcattccggtgcgccggcggggcgacagcagaggaagcctactctcccccaggcccgtctcctacttgaagggttcttcgggtggtccactgctctgcccctcggggcatgttgtgggcatcttccgggctgctgtgtgcacccggggggttgcgaaagcggtggactttgtgcccgttgagtctatggaaacaactatgcggtccccggtcttcacggacaactcgtcccctccggccgtaccgcagacattccaagtggcccatctacacgctcccactggtagcggcaagagcactaaggtgccggctgcgtatgcagcccaagggtacaaggtactcgtcttgaacccgtctgtcgccgccaccctaggtttcggggcgtatatgtctaaggcacatggtgtcgaccctaacatcagaacgggggtaaggaccatcaccacgggtgcccccattacgtactccacctatggcaagtttcttgccgacggtggttgctctgggggcgcctatgacatcataatatgtgatgagtgccactcaactgactcgactaccatcttgggcatcggcacagtcctggaccaagcggagacggctggagcgcgactcgtcgtactcgccaccgctacgcctccgggatcagtcaccgtgccacaccccaatatcgaggaggtggctctgtccaacattggagagatccccttctatggtaaagccatccccatcgaaaccatcaagggggggaggcacctcatattttgccattccaagaagaaatgtgatgagctcgctgcaaagctgtcgggcctcgggcttaacgctgtagcgtattaccgaggtcttgatgtgtccgtcataccgaccagcggagacgtcgttgtcgtggcaacagacgctctaatgacgggtttcactggcgacttcgactcagtgatcgactgtaatgtatgtgtcacccagacagtcgacttcagcttggaccctactttcaccatcgagacgacgaccgtgccccaagacgcggtgtcgcgctcgcagcggcgaggcaggactggcaggggcaggacaggcacctacaggtttgtgactccaggagaacggccctcgggcatgttcgattcctcggtcctgtgtgagtgctatgacgcaggctgtgcttggtacgagctcacgcccgccgagacctcagttaggctgcgggcttacctgaatacaccagggttgcccgtctgccaggaccatctggagttctgggagggcgtctttacaggcctcacccacatagatgcccacttcctgtcccagactaagcaagcaggagacaacttcccctacttggtagcataccaggctacggtgtgcgccagggctcaggctccacccccatcgtgggaccaaatgtggaaatgtctcatacggcttaagcctacgctgcacgggccaacacccctgctgtataggctaggagccgtccaaaatgaggtcgtcctcacacaccccataaccaaattcatcatggcatgcatgtcggctgacctggaggtcgccacgagcacctgggtgctagtaggcggagtcctcgcagctctggccgcgtactgcctgacaacaggcagcgtggtcattgtaggcaggatcatcttgtccggaaagccggctatcgtgcccgacagggaagccctctaccagcagttcgatgagatggaagagtgcgccacacacctaccctacattgaacaaggaatgcagctcgccgaacaattcaagcagaaggcactcgggttgctgcagacagccaccaagcaagcagaggctgctgctcccgtggtggagtccaagtggcgagcccttgagagcttctgggcgaagcatatgtggaacttcatcagcgggatacaatacttagcaggcttgtccactctgcctgggaatcccgcaatagcatcactgatggcatttacagcctccatcaccagcccgctcaccacccaacataccctcctgttcaacattttggggggatgggtggccgcccaactcgccccccccagcgctgcttctgctttcgtaggcgccggcattgccggcgcggccgttggcagcataggccttgggaaggtgttagtggacatcttggcgggttatggggcgggggtggcaggcgccctcgtggccttcaaggtcatgagtggtgagatgccttccactgaggacttggtcaacttgctccctgccatcctctcccctggtgccctagtcgtcggggtagtgtgcgcagcaatactgcgtcggcatgtgggcccaggggagggggccgtgcagtggatgaaccggctgatagcgttcgcttcgcggggtaaccacgtctcccccacgcactatgtgcccgagagcgacgctgcagcgcgtgtcactcagatcctctccagccttaccatcactcagttgctgaagaggctccaccagtggatcaacgaggactgctctacgccatgctccggctcgtggctaagggatgtttgggactggatatgcacggtgttaactgattttaagacctggctccagtccaagctcctgccgcggttgccgggagtccccttcctctcatgccaacgtgggtacaagggcatatggcggggagacggcatcatgcaaaccacctgcccatgtggagcgcagattaccggacatgtcaaaaacggttccatgaggatcgttgggcctaggacctgcagcaacacgtggcatggaacattccccatcaacgcatacaccacgggcccctgcacgccctccccggcgcccaattattccagggcgctgtggagggtggctgctgaggagtacgtggaggttacgcgggtgggggatttccactacgtgacgggcatgaccactgacaacgtaaagtgcccatgccaggttccagcccccgaattcttcacggaggtggatggggtgcggctgcacaggtacgctccggcgtgcaaacctctcctacgggaggaggtcacattccaggtcgggctcaaccaatacctggtcgggtcgcagctcccatgcgagcccgaaccggatgtagcggtgctcacttccatgctcaccgacccctcccacatcacagcagaggcggctaagcgtaggctggccagggggtctcccccctccctggccagctcttcagctagccagttgtctgcgccttccttgaaggcgacatgcactacccgccatgactccccagatgctgacctcatcgaggccaatctcctgtggcggcaggagatgggcggaaacatcacccgcgtggagtcagagaacaaggtagtaattctggactctttcgagccgcttcgagcggaggaagatgagagggaagtatccgttccggcggaaatcctgcggagatccaggaaatttcctcgggcgatgcccatatgggcaaggccggattacaaccctccactggtagagtcctggaaagacccggactacgtccctccggtggtacatgggtgcccattaccacctactaaggcccctccaataccacccccgcggaggaaaaggacggttgtcctgacagaatccaccgtgtcttctgccttggctgagctcgccacaaagaccttcggcagctccgaatcgtcggccgtcgacagcggcacggcgaccgcccctcctgaccagccctccgacgacggcggcgcagggtccgatgttgagtcgtactcctccatgcccccccttgagggggagccgggggatcccgatctcagcgacgggtcttggtctaccgtgagcgaggaagctagtgaggacgtcgtctgctgctcgatgtcctacacatggacaggcgctctgattacgccatgctccgcggaggaaagcaagctgcccatcaacgcgttgagcaactccttgctgcgccaccacaacatggtctatgccacaacatctcgcagcgcaagccagcggcagaagaaggtcacctttgacagactgcaggtcctggacgaccattaccgggacgtgctcaaggagatgaaggcgaaggcgtccacggttaaggctaaacttctatccatagaagaagcctgcatgctgacgcccccacactcggccaaatcgaaatttggctatggggcaaaggacgtccggaacctatccagcagggccgtttcccatatccgctccgtgtgggaggacttgctggaagacactgaaacaccaattgacaccaccatcatggcaaagaatgaggttttctgcgtccaaccagagaaaggaggccgcaagccagctcgccttatcgtattcccagacttgggggttcgtgtgtgcgagaaaatggccctttatgacgtggtctccacccttcctcaggccgtgatgggctcctcatacgggttccagtactctcctggacagcgggtcgagttcctggtgaatgcctggaaaaagaagaaaaaccctatgggcttcgcatatgacacccgctgttttgactcaactgtcaccgagagtgacatccgtgttgaggagtcaatctaccaatgttgtgacttggcccccgaagccagacaggccataaggtcgctcacagagcggctttatatcgggggtcccctgactaactcaaaagggcagaactgcggttatcgccggtgccgcgcgagcggtgtactgacgaccagctgcggtaataccctcacatgttacttgaaggcctctgcagcctgtcgagctgccaagctccaggactgcacgatgctcgtgtgcggagacgaccttgtcgttatctgtgaaagcgcgggaacccaggaggacgcggcgagcctacgagtcttcacggaggctatgactaggtactctgccccccccggggacccgcctaaaccagaatacgacttggagttgataacatcatgctcctccaatgtgtcggtcgcgcacgatgcatctggcaaaagggtgtactacctcacccgtgaccccaccaccccacttgcacgggctgcgtgggagacagctagacacactccagtcaactcctggctaggcaacatcatcatgtatgcgcccactttgtgggcaaggatgatcctgatgactcacttcttctcgatccttctagctcaggaacaacttgaaaaggctctagattgtcagatctacggggcctgttactccattgagccacttgacctacctcagatcattcagcgactccatggtcttagcgcattttcactccatagttactctccaggtgaaatcaatagggtggctgcatgcctcagaaaacttggggtaccacccttacgagtctggagacatcgggccagaagtgtccgcgctaagcttctgtcccagggggggagggctgccaactgtggcaaatacctcttcaactgggcagtaaggaccaagcttaaactcactccaattccggctgcgtcccagttggacttgtccagctggttcgttgctggttacagcgggggagacatatatcacagcgtgtctcgtgcccgaccccgctggttcatgttgtgcctactcctactttccgtaggggtaggcatctacctgctccccaaccga

SEQ ID NO: 625 - DNA, 9359 bp, Hepatitis C Virus
ttgggggcgacactccaccatagatcactcccctgtgaggaactactgtcttcacgcagaaagcgtctagccatggcgttagtatgagtgtcgtgcagcctccaggaccccccctcccgggagagccatagtggtctacggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggtggtggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggcaggacctgggctcagcccgggtacccttggcccctctatggcaatgagggcatggggtgggcaggatggctcctgtcaccccgcggctctcggcctagttggggccccacggacccccggcgtaggtcgcgtaatttgggtaaggtcatcgataccctcacatgcggcttcgccgacctcatggggtacattccgctcgtcggcgcccccctagggggcgctgccagggccctggcgcatggcgtccgggtcctggaggacggcgtgaactatgcaacagggaatttgcccggttgctctttctctatcttcctcttggctttgctgtcctgtttgaccatcccagcttccgctatcgaagtgcgcaacgtgtccggagtgtaccatgtcacgaacgactgctccaacgcaagcattgtgtatgaggcagcggacatgatcatgcatacccccgggtgcgtgccctgcgttcgggagaacaactcctcccgctgctgggcagcgctcactcccacgctcgcggccaggaattccagcatccccactacgacaatacgacgtcacgtcgatctgctcgttggggcggctgctttctgctccgctatgtacgtgggagatctttgcggatctgttttcctcgtctctcagctgttcaccttctcgcctcgccggcatgagacagtacaggactgcaattgttcaatctatcccggccacttatcgggtcaccgcatggcttgggacatgatgatgaactggtcacctacaacagctctagtggtgtcgcagttactccggatcccacaagccgtcgtggatatggtggcgggagcccactggggagtcctggcgggcctcgcctactattccatggtggggaactgggctaaggtcttgattgtgatgctactttttgccggcgtcgatgggactacctacacgacggggggggcacagggccgcactgtccacgggtttaccagcctcttttcacctgggccggcccaaaacctccagcttataaacaccaacggcagctggcacatcaacaggactgccctgaactgcaatgactccctcaacaccgggttcatcgcagcgctgttctacgcccgcagattcaacgcgtccggatgcccggagcgcatggccagctgccgccccattgacaagttcgctcaagggtggggtcccatcacttacgccaagccgcccagcttggaccagaagccctattgttggcactacgcaccccaaccgtgcggtattgtacccgcgtcgcaggtgtgcggtccagtgtactgtttcaccccaagccctgttgtggtggggacgactgatcgtttcggcgtccctacgtacagctggggggagaatgagacggacgtgctgcttcttaacaacacgcggccgccgcgaggcaactggttcggctgcacatggatgaatggcactgggttcaccaagacgtgcgggggccccccgtgtaacatcgggggggtcggtaatgacaccttgatctgccccacggattgcttccggaagcaccccgaggccacttacaccaaatgcggttcggggccctggctgacacctaggtgcatggttgactacccatacaggctttggcactacccctgcactgtcaattttaccatcttcaaggttaggatgtatgtggggggtgtggagcacaggctcaacgccgcatgcaactggacccgaggagagcgttgtgacttggaggacagggatagatcagagcttagcccgctgctgctgtctacaacagagtggcagatattgccctgttccttcaccaccctaccggctctgtccaccggcttgatccatctccatcggaacatcgtggacgtgcaatacctgtacggtatagggtcagcggttgtctcctacgcaattaagtgggagtatgtcctgttgctcttccttttcctggcggacgcgcgcgtctgtgcctgcttgtggatgatgctgctgatagctcaggctgaggccgccttagagaacttggtggtccttaatgcggcgtccgtggccggaacgcatggcattctctctttccttgtgttcttctgtgctgcctggtacatcaagggcaggctggtccctggggcggcatatgctttctatggcgtatggccgctgctcctgctcctgctggcgttgccaccacgagcgtacgccatggaccgggagatggctgcatcgtgcggaggcgcggtttttataggtctggcacttttgaccttgtcaccacactataaagcgttcctcgccaagctcatatggtggttgcaatattttatcaccagatccgaggcgctcttgcaagtgtgggtcccccctctcaacgttcgggggggccgcgatgccatcatcctcctcatgtgcgcgatccacccagagctaatctttaccatcaccaaaatcttgctcgccatactcggcccgctcatggtgctccaggctggcataaccagggtgccgtactttgtgcgcgcccatgggctcattcgtgcatgcttgctggtgcggaaagtcgctgggggtcattatatccaaatggctttcatgaggctagccgcgctgacaggcacgtacgtttatgaccatcttactccactgcggggctgggcccatgagggcctacgagaccttgcagtggcagttgagcccgtcgtcttctctgacatggaaaccaagatcattacctggggggcagacaccgcggcgtgtggggacatcatcttaggcctgcccgtctccgcccgcagggggagggagatactcttgggaccggcagatagtcttgaggggcaggggtggcgactccttgcgcccatcacggcctatgcccaacagacgcggggcctacttggctgcatcgtcaccagcctcacaggccgggacaagaaccaggtcgagggggaggttcaagtggtttccaccgcaacgcaatctttcctggcgacctgcgtcaacggcgtgtgttggactgtctaccatggcgccggcacaaagaccctcgccggccaaaagggcccaatcacccaaatgtacaccaatgtagaccaggacctcgtcggctggcaagcgcctcccggggcgcgatccttgacaccgtgcacctgtggcagctcggacctttacttggtcacgaggcatgctgatgtcattccggtgcgccggcggggcgacagcagaggaagcctactctcccccaggcccgtctcctacttgaagggctcttcgggtggtccgctgctctgcccctcggggcatgctgtgggcatcttccgggctgctgtgtgcacccggggggttgcgaaggcggtggactttgtgcccgttgagtctatggaaacaactatgcggtctccggtcttcacggacaactcgtcccccccggccgtaccgcagacattccaagtggcccatctacacgctcccactggcagcggcaagagcactaaggtgccggctgcgtatgcagcccaagggtacaaggtactcgtcttgaacccgtctgttgccgccaccctaggtttcggggcgtatatgtctaaagcacatggtgtcgaccctaacatcagaactggggtaaggaccatcactacaggtgcccccattacgtactccacctatggcaagttccttgccgacggtggttgctctgggggcgcctatgacatcataatatgtgatgagtgccactcaactgactcgactaccatcttgggcatcggcacagtcctggaccaagcggagacggctggagcgcgactcgtcgtactcgccaccgctacgcctccgggatcggtcaccgtgccacatcccaatatcgaggaggtggctctgtccaacattggagagatccccttctatggtaaagccatccccatcgagaccatcaagggggggaggcacctcatattttgccattccaggaaaaaatgtgatgagctcgccgcaaagttgtcgggtctcgggcttaacgctgtagcgtattaccggggccttgatgtgtccgtcataccgaccagcggagacgtcgttgtcgtggcaacagacgctctaatgacgggttacactggcgactttgactcagtgatcgactgtaatacatgtgtcacccagacagtcgacttcagcttggaccctaccttcaccattgagacgacgaccgtgccccaagacgcggtgtcgcgctcgcagcggcgaggcaggactggtaggggcaggacgggcatctacaggtttgtgactccaggagaacggccctcgggcatgttcgattcttcggtcctgtgtgagtgctatgacgcgggctgtgcttggtacgagctcacgcccgccgagacctcagttaggttgcgggcttacctgaatacaccagggttgcccgtctgccaggaccacctggagttctgggagggcgtcttcacaggcctcacccacatagatgcccacttcctgtcccagactaaacaggcaggagacaacttcccctacttggtagcataccaagctacggtgtgcgccagagctcaggctccacccccatcgtgggaccaaatgtggaaatgtctcatacggctaaagcctacgctgcacgggccaacacccctgctgtataggctaggagccgtccaaaatgaggtcaccctcacacatcccataaccaaattcatcatggcatgcatgtcggctgacctggaggtcgccactagcacctgggtgctagtgggcggagtcctcgcagctctggccgcgtattgcctgacaacaggcagcgtggtcattgtaggcaggatcatcttgtccggaaagccggctattgtacctgacagggaagtcctctaccaggagttcgatgagatggaagagtgcgccacgcacctcccttacattgaacaaggaatgcagctcgccgaacagttcaagcagaaggcactcgggttgttacagaccgccaccaagcaagcagaggctgctgctcccgtggtggagtctaagtggcgggcccttgagagcttctgggcgaagcatatgtggaatttcatcagcgggatacaatacctagcaggcttgtccactctgcctgggaaccccgcgatagcatccctgatggcattcacagcctccatcaccagcccgctcaccacccaacataccctcctgttcaacattctggggggatgggtggccgcccaactcgccccccccagcgccgcttctgctttcgtaggcgccggcatcgccggcgcggccgttggcagcataggccttgggaaggtgctagtggacatcttggcgggttatggagcgggggtagcgggcgccctcgtggcctttaaggtcatgagtggtgagatgccttccactgaggacttggtcaacttactccctgccatcctctcccctggtgccctagtcgtcggggtagtgtgcgcagcaatactgcgtcggcatgtgggcccaggggagggggctgtgcagtggatgaaccggctgatagcgttcgcttcgcggggtaaccacgtctcccccacgcactatgtgcccgagagcgacgctgcagcgcgtgtcactcagatcctctccagccttaccatcactcagctgttgaagaggctccatcagtggattaacgaggactgctccacgccatgctccggctcgtggctaagggacgtttgggactggatatgcacggtgttaactgattttaagacctggctccagtccaagctcctgccgcggttaccgggtgtccccttcctctcatgccaacgtgggtacaagggcatctggcagggagacggcatcatgcataccacctgcccatgtggagcgcagatcaccggacatgtcaaaaacggttccatgaggatcgttgggcctaggacctgcagcaacacgtggcatggaacattccccatcaacgcatacaccacgggcccctgcacgccctccccggcgcccaattattccagggcgttgtggagggtggctgctgaggagtacgtggaggttacgcgggtgggggatttccactacgtgacgggcatgaccactgacaacataaagtgcccatgccaggttccggcccccgaattcttcacggaggtggacggggtgcggctgcacaggtacgctccgccatgcaaacctctcttacgggaggaggtcacattccaggtcgggctcaaccaatacctggtcgggtcacagctcccatgtgagcccgaaccggatgtagcggtgctcacttccatgctcaccgacccctcccatatcacagcagagacggctaagcgtaggctggccagggggtctcccccctccttagccagctcttcagctagccagttgtctgcgccttccttgaaggcgacatgcactacccgccatgactccccagacgctgacctcatcgaggccagtctcctgtggcggcaggagatgggcgataacatcacccgcgtggagtcagagaacaaggtagtaattctggactctttcgagccgcttcgagcggaggaagatgagagggaaatatccgttccggcggaaatcctgcggagatccaggaaatttccccgagcgatgcccatatgggcaaggccggattacaaccctccactggtagagtcctggaaggacccggactacgtccctccggtggtacatgggtgcccattgccacctactaaggcccctccaataccacctccacggaggaaaaggacggtcgtcctgacagaatccaccgtgtcttctgccttggctgagctcgccacaaagaccttcggcagctccgaatcgtcggccgtcgacagcggcacggcgaccgcccctcctgaccagccctccgacgacggcgacgcagggtccgatgttgagtcgtactcctccatgcccccccttgagggggagccgggggatcccgatctcagcgacgggtcttggtctaccgtgagcgaggaagctagtgaggacgtcgtctgctgctcgatgtcttacacatggacaggcgccctgatcacgccatgctccgcggaggaaagcaagctgcccatcaacgcgttgagcaactctttgctgcgccaccacaacatggtctatgccacaacatctcgcagcgcaagccagcggcagaagaaggtcacctttgacagactgcaagtcctggacgatcattaccgggacgtgctcaaggagatgaaggcgaaggcgtccacagtcaaggccaagcttctatccgtagaagaggcctgcaagctgacgcccccacactcggccaaatccaaatttggctatggggcaaaggacgtccggaacctatccagcaaggccattaaccacatccgctccgtgtggaaggacttgttggaagacactgacacaccaatcgacaccaccatcatggcaaaaaatgaggttttctgcgtccaaccagagaaaggaggccgcaagccagctcgccttatcgtattcccagacttgggggttcgtgtgtgcgagaaaatggccctgtatgacgtggtctccacccttcctcaggccgtgatgggctcctcatacggtttccagtactctcctggacagcgggtcgagttcctggtgaatgcctggaaaaagaagaagaaccctatgggcttcgcatatgacacccgctgttttgactcaacggtcaccgagagtgacatccgtgttgaggagtcaatctaccaatgttgtgacttggcccccgaagccagacaggccataaggtcgctcacagagcggctttatatcgggggtcccctgactaactcaaaagggcagaactgcggttatcgccggtgccgcgcgagcggtgtgctgacgaccagctgcggtaataccctcacatgttacttgaaggccactgcagcctgtcgagctgctaagctccaggactgcacgatgctcgtgtgcggagacgaccttgtcgttatctgtgaaagcgcgggaacccaggaggacgcggcgagcctgcgagtcttcacggaggctatgactaggtactctgccccccccggggacccgcccaaaccagaatacgacttggagttgataacatcatgctcctccaatgtgtcggtcgcgcacgatgcatctggcaaacgggtgtactacctcacccgtgaccccaccaccccgcttgcacgggctgcgtgggagacagctagacacactccagtcaactcctggctaggcaacatcatcatgtatgcgcccaccttatgggcaaggatgatcctgatgactcacttcttctccatccttctagctcaggaacaacttgaaaaggctctagattgtcagatctacggggcctgttactccattgagccacttgacctacctcagatcattcagcgactccatggtcttagcgcattttcactccatagttactctccaggtgaaatcaatagggtggctgcatgcctcagaaaacttggggtaccacccttgcgagtctggagacatcgggccagaagtgtccgcgctaagctcctgtcccagggggggagggctgccacctgtggcaaatacctcttcaactgggcagtgaggaccaagcttaaactcactccaattccggctgcgtcccagttggacttgtccagttggttcgttgctggttacagcgggggagacatatatcacagcttgtctcgtgcccgaccccgctggttcatgttgtgcctactcctactttctgtaggggtaggcatctacctgctccccaaccga

SEQ ID NO: 626 - DNA, 9359 bp, Hepatitis C Virus
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggtggtggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggcaggacctgggctcagcccgggtacccttggcccctctatggcaatgagggcatggggtgggcaggatggctcctgtcaccccgcggctctcggcctagttggggccccacggacccccggcgtaggtcgcgtaatttgggtaaggtcatcgataccctcacatgcggcttcgccgacctcatggggtacattccgctcgtcggcgcccccctagggggcgctgccagggccctggcgcatggcgtccgggtcctggaggacggcgtgaactatgcaacagggaatttgcccggttgctctttctctatcttcctcttggctttgctgtcctgtttgaccatcccagcttccgctatcgaagtgcgcaacgtgtccggagtgtaccatgtcacgaacgactgctccaacgcaagcattgtgtatgaggcagcggacatgatcatgcacacccccgggtgcgtgccctgcgttcgggagaacaactcctcccgctgctgggcagcgctcactcccacgctcgcggccaggaattccagcatccccactacgacaatacgacgtcacgtcgatctgctcgttggggcggctgctttctgctccgctatgtacgtgggagatctttgcggatctgttttcctcgtctctcagctgttcaccttctcgcctcgccggcatgagacagtacaggactgcaattgttcaatctatcccggccacttatcgggtcaccgcatggcttgggacatgatgatgaactggtcacctacaacagctctagtggtgtcgcagttactccggatcccacaagccgtcgtggatatggtggcgggagcccactggggagtcctggcgggcctcgcctactattccatggtggggaactgggctaaggtcttgattgtgatgctactttttgccggcgtcgatgggactacctacacgacggggggggcacagagccgcactgtccaagggtttaccagcctcttttcacctgggccggcccaaaacatccagcttataaacaccaacggcagctggcacatcaacaggactgccctgaactgcaatgactccctcaacaccgggttcatcgcagcgctgttctacgcccgcagattcaacgcgtccggatgcccggagcgcatggccagctgccgccccattgacaagttcgctcaagggtggggtcccatcacttacgccaagccgcccagcttggaccagaagccctattgttggcactacgcaccccaaccgtgcggtattgtacccgcgtcgcaggtgtgcggtccagtgtactgtttcaccccaagccctgttgtggtggggacgactgatcgtttcggcgtccctacgtacagctggggggagaatgagacggacgtgctgcttcttaacaacacgcggccgccgcgaggcaactggttcggctgcacatggatgaatggcactgggttcaccaagacgtgcgggggccccccgtgtaacatcgggggggtcggtaatgacaccttgatctgccccacggattgcttccggaagcaccccgaggccacttacaccaaatgcggttcggggccctggctgacacctaggtgcatggttgactacccatacaggctttggcactacccctgcactgtcaattttaccatcttcaaggttaggatgtatgtggggggtgtggagcacaggctcaacgccgcatgcaactggacccgaggagagcgttgtgacttggaggacagggatagatcagagcttagcccgctgctgctgtctacaacagagtggcagatactgccctgttccttcaccaccctaccggctctgtccaccggcttgatccatctccatcggaacatcgtggacgtgcaatacctgtacggtatagggtcagcggttgtctcctacgcaattaagtgggagtatgtcctgttgctcttccttttcctggcggacgcgcgcgtctgtgcctgcttgtggatgatgctgctgatagctcaggctgaggccgccttagagaacttggtggtcctcaatgcggcgtccgtggccggaacgcatggcattctctccttccttgtgttcttctgtgctgcctggtacatcaagggcaggctggtccctggggcggcatatgctttctatggcgtatggccgctgctcctgctcctgctggcgttgccaccacgagcgtacgccatggaccgggagatggctgcatcgtgcggaggcgcggtttttataggtctggcacttttgaccttgtcaccacactataaagcgttcctcgccaagctcatatggtggttgcaatattttatcaccagatccgaggcgctcttgcaagtgtgggtcccccctctcaacgttcgggggggccgcgatgccatcatcctcctcatgtgcgcgatccacccagagctaatctttaccatcaccaaaatcttgctcgccatactcggcccgctcatggtgctccaggctggcataaccagggtgccgtactttgtgcgcgcccatgggctcattcgtgcatgcttgctggtgcggaaagtcgctgggggtcattatatccaaatggctttcatgaggctagccgcgctgacaggcacgtacgtttatgaccatcttactccactgcggggctgggcccatgagggcctacgagaccttgcagtggcagttgagcccgtcgtcttctctgacatggaaaccaagatcattacctggggggcagacaccgcggcgtgtggggacatcatcttaggcctgcccgtctccgcccgcagggggagggagatacttttgggaccggcagatagtcttgaggggcaggggtggcgactccttgcgcccatcacggcctatgcccaacagacgcggggcctacttggctgcatcgtcaccagcctcacaggccgggacaagaaccaggtcgagggggaggttcaagtggtttccaccgcaacgcaatctttcctggcgacctgcgtcaacggcgtgtgttggactgtctaccatggcgctggcacaaagaccctcgccggccaaaagggcccaatcacccaaatgtacaccaatgtagaccaggacctcgtcggctggcaagcgcctcccggggcgcgatccttgacaccgtgcacctgtggcagctcggacctttacttggtcacgaggcatgctgatgtcattccggtgcgccggcggggcgacagcagaggaagcctactctcccccaggcccgtctcctacttgaagggctcttcgggtggtccgctgctctgcccctcggggcatgctgtgggcatcttccgggctgctgtgtgcacccggggggttgcgaaggcggtggactttgtgcccgttgagtctatggaaacaactatgcggtctccggtcttcacggacaactcgtcccccccggccgtaccgcagacattccaagtggcccatctacacgctcccactggcagcggcaagagcactaaggtgccggctgcgtatgcagcccaagggtacaaggtactcgtcttgaacccgtctgttgccgccaccctagggttcggggcgtatatgtctaaagcacatggtgtcgaccctaacatcagaactggggtaaggaccatcactacaggtgcccccattacgtactccacctatggcaagttccttgccgacggtggttgctctgggggcgcctatgacatcataatatgtgatgagtgccactcaactgactcgactaccatcttgggcatcggcacagtcctggaccaagcggagacggctggagcgcgactcgtcgtactcgccaccgctacgcctccgggatcggtcaccgtgccacatcccaatatcgaggaggtggctctgtccaacattggagagatccccttctatggtaaagccatccccatcgagaccatcaagggggggaggcacctcatattttgccattccaggaaaaaatgtgatgagctcgccgcaaagttgtcgggtctcgggcttaacgctgtagcgtattaccggggccttgatgtgtccgtcataccgaccagcggagacgtcgttgtcgtggcaacagacgctctaatgacgggttacactggcgactttgactcagtgatcgactgtaatacatgtgtcacccagacagtcgacttcagcttggaccctaccttcaccattgagacgacgaccgtgccccaagacgcggtgtcgcgctcgcagcggcgaggcaggactggtaggggcaggacgggcatctacaggtttgtgactccaggagaacggccctcgggcatgttcgattcttcggtcctgtgtgagtgctatgacgcgggctgtgcttggtacgagctcacgcccgccgagacctcagttaggttgcgggcttacctgaatacaccagggttgcccgtctgccaggaccacctggagttctgggagggcgtcttcacaggcctcacccacatagatgcccacttcctgtcccagactaaacaagcaggagacaacttcccctacttggtagcataccaagctacggtgtgcgccagagctcaggctccacccccatcgtgggaccaaatgtggaaatgtctcatacggctaaagcctacgctgcacgggccaacacccctgctgtataggctaggagccgtccaaaatgaggtcaccctcacacaccccataaccaaattcatcatggcatgcatgtcggctgacctggaggtcgccactagcacctgggtgctagtgggcggagtcctcgcagctctggccgcgtattgcctgacaacaggcagcgtggtcattgtaggcaggatcatcttgtccggaaagccggctattgtacctgacagggaagtcctctaccaggagttcgatgagatggaagagtgcgccacgcacctcccttacattgaacaaggaatgcagctcgccgaacagttcaagcagaaggcactcgggttgttacagaccgccaccaagcaagcagaggctgctgctcccgtggtggagtctaagtggcgggcccttgagagcttctgggcgaagcatatgtggaatttcatcagcgggatacaatacctagcaggcttgtccactctgcctgggaaccccgcgatagcatccctgatggcattcacagcctccatcaccagcccgctcaccacccaacataccctcctgttcaacattctggggggatgggtggccgcccaactcgccccccccagcgccgcttctgctttcgtaggcgccggcatcgccggcgcggccgttggcagcataggccttgggaaggtgctagtggacatcttggcgggttatggagcgggggtagcgggcgccctcgtggcctttaaggtcatgagtggtgagatgccttccactgaggacttggtcaacttactccctgccatcctctcccctggtgccctggtcgtcggggtagtgtgcgcagcaatactgcgtcggcatgtgggcccaggggagggggctgtgcagtggatgaaccggctgatagcgttcgcttcgcggggtaaccatgtctcccccacgcactatgtgcccgagagcgacgctgcagcgcgtgtcactcagatcctctccagccttaccatcactcagctgttgaagaggctccatcagtggattaacgaggactgctccacgccatgctccggctcgtggctaagggacgtttgggactggatatgcacggtgttaactgattttaagacctggctccagtccaagctcctgccgcggttaccgggtgtccccttcctctcatgccaacgtgggtacaagggcatctggcagggagacggcatcatgcataccacctgcccatgtggagcgcagatcaccggacatgtcaaaaacggttccatgaggatcgttgggcctaggacctgcagcaacacgtggcatggaacattccccatcaacgcatacaccacgggcccctgcacgccctccccggcgcccaattattccagggcgttgtggagggtggctgctgaggagtacgtggaggttacgcgggtgggggatttccactacgtgacgggcatgaccactgacaacataaagtgcccatgccaggttccggcccccgaattcttcacggaggtggacggggtgcggctgcacaggtacgctccgccatgcaaacctctcttacgggaggaggtcacattccaggtcgggctcaaccaatacctggtcgggtcacagctcccatgtgagcccgaaccggatgtagcggtgctcacttccatgctcaccgacccctcccatatcacagcagagacggctaagcgtaggctggccagggggtctcccccctccttagccagctcttcagctagccagttgtctgcgccttccttgaaggcgacatgcactacccgccatgactccccagacgctgacctcatcgaggccagtctcctgtggcggcaggagatgggcgataacatcacccgcgtggagtcagagaacaaggtagtaattctggactctttcgagccgcttcgagcggaggaagatgagagggaaatatccgttccggcggaaatcctgcggagatccaggaaatttccccgagcgatgcccatatgggcaaggccggattacaaccctccactggtagagtcctggaaggacccggactacgtccctccggtggtacatgggtgcccattgccacctactaaggcccctccaataccacctccacggaggaaaaggacggtcgtcctgacagaatccaccgtgtcttctgccttggctgagctcgccacaaagaccttcggcagctccgaatcgtcggccgtcgacagcggcacggcgaccgcccctcctgaccagccctccgacgacggcgacgcagggtccgatgttgagtcgtactcctccatgcccccccttgagggggagccgggggatcccgatctcagcgacgggtcttggtctaccgtgagcgaggaagctagtgaggacgtcgtctgctgctcgatgtcttacacatggacaggcgccctgatcacgccatgctccgcggaggaaagcaagctgcccatcaacgcgttgagcaactctttgctgcgccaccacaacatggtctatgccacaacatctcgcagcgcaagccagcggcagaagaaggtcacctttgacagactgcaagtcctggacgatcattaccgggacgtgctcaaggagatgaaggcgaaggcgtccacagtcaaggccaagcttctatccgtagaagaggcctgcaagctgacgcccccacactcggccaaatccaaatttggctatggggcaaaggacgtccggaacctatccagcaaggccattaaccacatccgctccgtgtggaaggacttgttggaagacactgacacaccaatcgacaccaccatcatggcaaaaaatgaggttttctgcgtccaaccagagaaaggaggccgcaagccagctcgccttatcgtattcccagacttgggggttcgtgtgtgcgagaaaatggccctttatgacgtggtctccacccttcctcaggccgtgatgggctcctcatacggtttccagtactctcctggacagcgggtcgagttcctggtgaatgcctggaaaaagaagaagaaccctatgggcttcgcatatgacacccgctgttttgactcaacggtcaccgagagtgacatccgtgttgaggagtcaatctaccaatgttgtgacttggcccccgaagccagacaggccataaggtcgctcacagagcggctttatatcgggggccccttgactaactcaaaagggcagaactgcggttatcgccggtgccgcgcgagcggtgtgctgacgaccagctgcggtaataccctcacatgttacttgaaggccactgcagcctgtcgagctgctaagctccaggactgcacgatgctcgtgtgcggagacgaccttgtcgttatctgtgaaagcgcgggaacccaggaggacgcggcgagcctacgagtcttcacggaggctatgactaggtactctgccccccccggggacccgcccaaaccagaatacgacttggagttgataacatcatgctcctccaatgtgtcggtcgcgcacgatgcatctggcaaacgggtgtactacctcacccgtgaccccaccaccccacttgcacggactgcgtgggagacagctagacacactccagtcaactcctggctaggcaacatcatcatgtatgcgcccaccttatgggcaaggatgatcctgatgactcacttcttctccatccttctagctcaggaacaacttgaaaaggctctggattgtcagatctacggggcctgttactccattgaaccacttgacctacctcagatcattcagcgactccatggtcttagcgcattttcactccatagttactctccaggtgaaatcaatagggtggctgcatgcctcagaaaacttggggtaccacccttgcgagtctggagacatcgggccagaagtgtccgcgctaagctcctgtcccagggggggagggctgccacctgtggcaaatacctcttcaactgggcagtgaggaccaagcttaaactcactccaattccggctgcgtcccagttggacttgtccagttggttcgttgctggttacagcgggggagacatatatcacagcttgtctcgtgcccgaccccgctggttcatgttgtgcctactcctactttctgtaggggtaggcatctacctgctccccaaccga

SEQ ID NO: 627 - DNA, 9359 bp, Hepatitis C Virus
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggtggtggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggcaggacctgggctcagcccgggtacccttggcccctctatggcaatgagggcatggggtgggcaggatggctcctgtcaccccgcggctctcggcctagttggggccccacggacccccggcgtaggtcgcgtaatttgggtaaggtcatcgataccctcacatgcggcttcgccgacctcatggggtacattccgctcgtcggcgcccccctagggggcgctgccagggccctggcgcatggcgtcagggtcctggaggacggcgtgaactatgcaacagggaatttgcccggttgctctttctctatcttcctcttggctttgctgtcctgtttgaccattccagcttccgctatcgaagtgcgcaacgtgtccggaatgtaccatgtcacgaacgactgctccaacgcaagcattgtgtatgaggcagaggacatgattatgcatacccccgggtgcgtgccttgcgttcgggagaacaactcctcccgctgctgggtagcgctcactcccacgctcgcggccaggaactccagcatccccactacgacaatacgacgtcacgtcgacttgctcgttggggcggccgcattctgctccgctatgtacgtgggagatctttgcggatctgttttccttgtctctcagctgttcaccttctcgcctcgccggcatgagacagtacaggactgcaattgctcaatctatcccggccacgtatcgggtcaccgcatggcttgggacatgatgatgaactggtcacctacaacagctctagtggtgtcgcagttgctccggatcccacaagctgtcgtggacatagtggtgggagcccactggggaatcctggcgggcctcgcctactattccatggtggggaactgggctaaggtcttgattgtgatgctactttttgccggcgtcgacggggggactcacacgacggggggaacgcaggcccgtgctgcccagaggcttacgagcttcttttcgcctgggccgtcccaaaacatccagcttataaacaccaatggcagctggcacatcaacaggactgccctgaactgcaatgactccctccgcactgggttccttgccgcgctgttctacacccacagattcaacgcgtccggatgcccggagcgcatggccagctgccgccccattgacaagtttgctcaggggtggggtcccatcacttacgctgagccgcccagcttggaccagaagccctattgttggcactacgcaccccgaccgtgcggtatcgtacccgcgtcgcaggtgtgtggtccagtgtactgtttcaccccaagccctgttgtggtggggacgaccgatcgtttcggcgtccctacgtatagctggggggagaatgagacggacgtgctgcttctcaacaacacgcggccgccgcggggtaactggttcggctgcacatggatgaatagcactgggttcaccaagacgtgcgggggccccccgtgcaacatcgggggggccggtaatgacaccttgatctgccccacggattgcttccggaagcaccctgaggccacttacaccaaatgcggttcggggccctggctgacacctaggtgcatggttgactacccatacaggctttggcactacccctgcactgtcaatttttccatcttcaaggttaggatgtatgtggggggtgtggagcacaggctcaacgccgcatgcaactggacccgaggggagcgttgcgacttggaggacagggatagatcagagcttagcccgctgctgctgtctacaacagagtggcaggtattgccctgttccttcaccaccctaccggctctgtccaccggcttgatccatctccatcggaacatcgtggacgtgcaatacctgtacggtatagggtcggcggttgtctcctacgcaattaagtgggagtatgtcctgttgctcttcctttacctggcggacgcgcgcgtctgtgcctgcttgtggatgatgctgctaatagctcaggccgatgccgccttagagaacttggtggtcctcaatgcagcgtccgtggccggaacgcatggcattctctccttccttgtgttcttctgtgctgcctggtacatcaagggcaggctggtccctggggcggcatatgtcttctatggcgtatggccgctgctcctgctcctgctggcgttgccaccacgagcatacgccatggaccgggagatggctgcatcgtgcggaggcgcggttttcataggtctgacacttttgaccttgtcaccacactataaagcgctcctcgccaggctcatatggtggttacaatattttatcaccagagccgaggcgctcttgcaggtgtggatcccccccctcaacgttcgggggggccgcgatgccatcatcctcctcatgtgcgcaatccacccagagctaatctttgccatcaccaaaatcttgctcgccgtactcggcccgctcatggtgctccaggctggcataaccagggtgccgtactttgtgcgcgcccatgggctcattcgtgcatgcttgctggtgcggaaagtcgctgggggtcattatgtccaaatggctttcatgaggctggccgcgctgacaggcacgtacgtctatgcccatcttactccactgcgggactgggcccacgagggcctacgagaccttgcagtggcagttgagcccgtcgtcttctctgacatggagaccaagatcattacctggggggcagacaccgcggcgtgtggggacatcatcttaggcctgcccgtctctggccgcagggggagggagatacttttgggaccggcagatagttttgaggggcaggggtggcgactccttgcgcccatcacggcctatgcccaacagacgcggggcctacttggctgcatcatcaccagcctcacaggccgggacaagaaccaggtcgagggggaggttcaagtggtttccaccgcaacacaatctttcctggcgacctgcgtcaacggcgtgtgttggactgtctaccacggcgccggcacaaagaccctcgccggccaaaagggcccgatcacccaaatgtacaccaatgtagaccaggatctcgtcggctggcaagcgcctcccggggcgcgatccttgacaccgtgcacctgtggcagctcggacctttacttggtcacgaggcatgctgatgtcattccggtgcgccggcggggcgacagcagaggaagcctactctcccccaggcccgtctcctacttgaagggctcttcgggtggtccactgctctgcccctcggggcatgctgtgggcatcttccgggctgctgtgtgcacccggggggttgcgaaggcggtggactttgtgcccgttgagtctatggaaacaactatgcggtccccggtcttcacggacaactcgtcccccccggccgtaccgcagacattccaagtggcccatctacacgctcccactggtagcggcaagagcactaaggtgccggctgcgtatgcagcccaagggtacaaggtactcgtcctgaacccgtctgttgccgccaccctaggtttcggggcgtatatgtctaaggcacatggtgtcgaccctaacatcagaactggggtaaggaccatcaccacgggtgcccccattacgtactccacctatggcaagttccttgccgacggtggttgctctgggggcgcctatgacatcataatatgtgatgagtgccactcaactgactcgactaccatcttgggcatcggcacagtcctggaccaagcggagacggctggagcgcgactcgtcgtacttgccaccgctacgcctccgggatcggtcaccgtgccacatcccaacatcgaggaggtggctctgtccaacattggagagatccccttctatggtaaagccatccccattgagaccatcaagggggggaggcacctcatattttgccattccaggaaaaaatgtgatgagctcgccgcaaagctgtcgggtctcgggcttaacgctgtagcgtattaccggggccttgacgtgtccgtcataccgaccagcggagacgtcgttgtcgtggcaacagacgctctaatgacgggtttcactggcgactttgactcagtgatcgactgtaatacatgtgtcacccagacagtcgacttcagcttggaccctaccttcaccattgagacgacgaccgtgccccaagacgcggtgtcgcgctcgcagcggcgaggcaggactggtaggggcaggacaggcatctacaggtttgtgactccaggagaacggccctcgggcatgttcgattcctcggtcctgtgtgagtgctatgacgcgggctgtgcttggtacgagctcacgcccgccgagacctcagttaggttgcgggcttacctgaatacaccagggttgcccgtctgccaggaccatctggagttctgggagggcgtcttcacaggcctcacccacatagatgcccacttcctgtcccagactaagcaggcaggagagaacttcccctacttggtagcataccaggctacggtgtgcgccagggctcaggctccacccccatcgtgggaccaaatgtggaaatgtctcatacggctaaagcccacgctgcacgggccaacacccctgctgtataggctaggagccgtccaaaatgaggtcaccctcacacaccccataaccaaattcatcatggcatgcatgtcggctgacctggaggtcgccacgagcacctgggtgctagtaggcggagtcctagcagctctggccgcgtattgcttgacaacaggcagcgtggtcattgtaggcaggatcatcttgtccggaaagccggctattgtacccgacagggaagtcctctaccagcagttcgatgagatggaagagtgcgccacacacctcccttacattgaacaaggaatgcagctcgccgaacagttcaagcagaaggcactcgggttgttgcagacagccaccaagcaagcagaggctgctgctcccgtggtggagtccaagtggagggcccttgagagcttctgggcgaagcatatgtggaatttcatcagcgggatacaatacttagcaggcttgtccaccctgcctgggaaccccgcaatagcatcactgatggcattcacagcctccatcaccagcccgctcaccacccaacataccctcctgttcaacattttggggggatgggtggccgcccaactcgccccccccagcgctgcttctgctttcgtaggcgccggcatcgccggcgcggccgttggcagcataggccttgggaaggtgctagtggacatcttggcaggttatggagcgggggtggcaggcgccctcgtggcctttaaggtcatgagtggtgagttgccttccactgaggacttggtcaacttgctccctgccatcctctcccctggtgccctagtcgtcggggtagtgtgcgcagcaatactgcgtcggcatgtgggcccaggggagggggctgtgcagtggatgaaccggctgatagcgttcgcttcgcggggtaaccacgtttcccccacgcactatgtgcccgaaagcgacgctgcagcgcgtgtcactcagatcctctccagccttaccatcactcagctgctgaggaggctccatcaatggattaacgaggactgctccacgccatgctccggctcgtggctaagggacgtttgggactggatatgcacggtgttaaccgattttaagacctggctccagtccaagctcctgccgcggttaccgggagtccccttcctctcatgccaacgtgggtataggggtatctggcggggagacggcatcatgcaaaccacctgcccatgtggagcgcagattaccggacatgtcaaaaacggttccatgaggatcgttgggcctaggacctgcagcaacacgtggcatggaacattccccatcaacgcatacaccacgggcccttgcacgccctccccggcgcccaattattccagggcgctgtggagggtggctgctgaggagtacgtggaggttacgcgggtgggggatttccattacgtgacgggcatgaccactgacaacgtaaagtgcccatgccaggttccggcccccgaattcttcacggaggtggatggggtgcggctgcacaggtacgctccgccgtgcagacctctcctacgggatgaggtcacattccaggtcgggctcaaccaatacccggtcgggtcacagctcccatgtgagcctgaaccggatgtagcggtgctcacttccatgctcaccgacccctcccacatcacagcagaggcggctaagcgtaggctggctagggggtctcctccctccttagccagctcttcagctagccagttgtctgcgccttccttgaaggcgacatgcactacccagcatgactccccagatgctgacctcatcgaagccaatctcctgtggcggcaggagatgggcgggaacatcacccgcgtggagtcagagaacaaggtagtaattctggactctttcgagccgcttcgagcggaggaagatgagagggaagtatccgttccggcggagatcctatggagatccaggaaatttccccgagcgatgcccatatgggcaaggccggattacaaccctccactggtagagtcctggaaggacccggactacgttcctccggtggtacatgggtgcccattgccgcctactaaggcccctccaataccacctccacggaggaaaaggacggttgtcctgacagaatccaccgtgtcttctgccttggctgagctcgccacaaagaccttcggcagctccgaatcgtcggccgtcgacagcggcacggcgaccgcccctcctgaccagccctccgacgacggcgacgcagggtccgatgttgagtcgtactcctccatgcccccccttgagggggagccgggggatcccgatctcagcgacgggtcttggtctaccgtgagcgaggaagctagtgaggacgtcgtctgctgctcgatgtcctacacatggacgggcgccctgatcacgccatgctccgcggaggaaagcaagctgcccatcaacgcgttgagcaactctttgctgcgtcaccataacatggtctatgccacaacatctcgcagcgcaagccagcggcagaagaaggtcacctttgacagactgcaggtcctggacgaccattaccgggacgtgctcaaggagatgaaggcgaaggcgtccacggttaaggctaaacttctatccgtagaagaagcctgcatgctgacgcccccacactcggccaaatccaaatttggctatggggcgaaggacgtccggaacctatccagcaaggccattaaccacatccactccgtgtggaaggacttgctggaagacactgagacaccaattgacaccaccatcatggcaaaaaatgaggttttctgcgtccaaccagagaaaggaggccgcaagccagctcgccttatcgtattcccagacttgggggttcgtgtgtgcgagaaaatggccctctatgacgtggtctccacccttcctcaggccgtgatgggctcctcatacgggttccagtactctcctggacagcgggtcgagttcctggtgaatgcctggaaacaaaagaagaaccctatgggcttcgcatatgacacccgctgttttgactcaacggtcaccgagagtgatatccgtgttgaggagtcaatctaccaatgttgtgacttggcccccgaagccagacaggccataaggtcgctcacagagcggctttatatcgggggtcccctgactaattcaaaagggcagaactgcggttatcgccggtgccgcgcgagcggtgtactgacgaccagctgcggtaataccctcacatgttacttgaaggcctctgcagcctgtcgagctgccaagctccaggactgcacgatgctcgtgtgcggagacgaccttgtcgttatctgtgaaagcgcgggaacccaggaggacccggcgagcctacgagtcttcacggaggctatgactaggtactctgggccccccggggacccgcccaaaccagaatacgacttggagttgataacatcatgctcctccaatgtatcggttgcgcacgatgcatctggcaaaagggtgtactacctcacccgtgaccccaccaccccacttgcacgagctgcgtgggagacagctagacacactccagtcaactcctggctaggcaacatcatcatgtatgcgcccaccttatgggcaaggatgatcctgatgactcacatcttctccatccttctagctcaggaacaacttgaaaaggctctagattgtcagatctacggggcctgttactccgttgagccacttgacctacctcagatcattcagcgactccatggtcttagcgcattttcactccatagttactctccaggtgaaatcaatagggtggctgcatgcctcagaaaacttggggtaccacccttgcgagtctggagacatcgggccagaagtgtccgcgctaagctcctgtcccagggggggagggctgccaactgtggcagatacctcttcaactgggcagtaaggaccaagcttaaactcactccaattccggctgcgtcccagttggacttgtccagctggttcgttgctggttacagcgggggagacatatatcacagcgtgtctcgtgcccgaccccgctggttcatgttgtgcctactcctactttccgtaggggtaggcatctacctgctccccaaccga

SEQ ID NO: 628 - DNA, 9359 bp, Hepatitis C Virus
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggtggtggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggcaggacctgggctcagcccgggtacccttggcccctctatggcaatgagggcatggggtgggcaggatggctcctgtcaccccgcggctctcggcctagttggggccccacggacccccggcgtaggtcgcgtaatttgggtaaggtcatcgataccctcacatgcggcttcgccgacctcatggggtacattccgctcgtcggcgcccccctagggggcgctgccagggccctggcgcatggcgtcagggtcctggaggacggcgtgaactatgcaacagggaatttgcccggttgctctttctctatcttcctcttggctttgctgtcctgtttgaccatcccagcttccgctatcgaagtgcgcaacgtgtccggaatgtaccatgtcacgaacgactgctccaacgcaagcattgtgtatgaggcacaggacatgattatgcatacccccgggtgcgtgccttgcgttcgggaggacaactcctcccgctgctgggtagcgctcactcccacgctcgcggccaggaactccagcatccccactacgacaatacgacgtcacgtcgacttgctcgttggggcggccgcattctgctccgctatgtacgtgggagatctttgcggatctgttttccttgtctctcagctgttcaccttttcgcctcgccggcatgagacagtacaggactgcaattgctcaatctatcccggccacgtatcgggtcaccgcatggcttgggacatgatgatgaactggtcacctacaacagctctagtggtgtcgcagttgctccggatcccacaagccgtcgtggacatagtggtgggagcccactggggagtcctggcgggcctcgcctactattccatggtggggaactgggctaaggtcttgattgtgatgctactttttgccggcgtcgacgggaagactcacacgacggggggaacgcaggcccgtgctgcccagaggcttacgagcttcttttcgcctgggccgtcccaaaacatccagcttataaacaccaacggcagctggcacatcaacaggactgccctgaactgcaatgactccctccaaactgggttccttgccgcgctgttctatgcccacagattcaacgcgtccggatgcccggagcgcatggccagctgccgccccattgacaagtttgctcaggggtggggtcccatcactcacgccgagccgcccagcttggaccagaagccctattgttggcactacgcaccccgaccgtgcggtattgtacccgcgtcgcaggtgtgtggtccagtgtactgtttcactccaagccctgttgtggtggggacgaccgatcgttatggcgtccctacatatagctggggggagaatgagacggacgtgctgcttctcaacaacacgcggccgccgcaaggcaactggttcggctgcacatggatgaatagcactgggttcaccaagacgtgcggaggccctccgtgcaacatcgggggggtcggtaatgacaccttgatctgccccacggattgcttccggaagcaccctgaggccacttacaccaaatgcggttcggggccctggctgacacctaggtgcatggttgactacccatacaggctttggcactacccctgcactctcaatttttccatcttcaagattaggatgtatgtggggggtgtagagcacaggctcaacgccgcatgcaactggacccgaggggagcgttgcgacttggcggacagggatagatcagagcttagcccgctgctgctgtctacaacagagtggcaggtattgccctgttccttcaccaccctaccggctctgtccaccggcttgatccatctccatcggaacatcgtggacgtgcaatacctgtacggtatagggtcggcggttgtctcctacgcaattaagtgggagtatgtcctgttgctcttcctttacctagcggacgcgcgcgtctgtgcctgcttgtggatgatgctgctaatagctcaggctgatgccgccttagagaacttggtggtcctcaatgcagcgtccgtggccggaacacatgacattctctccttccttgtgttcttctgtgctgcctggtacatcaagggcaggctggtccctggggcggcatatgccttctatggcgtatggccgctgctcctgctcctgctggcgttgccaccacgagcatacgccatggaccgggagatggctgcatcgtgcggaggcgcggttttcataggtctgacactgttgaccttgtcaccacactacaaagcgctcctcgccaggctcatatggtggttacaatattttatcaccagagccgaggcgctcttgcaggtgtggatcccccccctcaacgttcgggggggccgcgatgccatcatcctcctcatgtgcgcgatccacccagagctaatctttaccatcaccaaaatcttgctcgccatactcggcccgctcatggtgctccaggctggcataaccagggtgccgtactttgtgcgcgcccatgggctcattcgtgcatgcttgctggtgcggaaagtcgctgggggtcattatgtccaaatggctttcatcaaactggccccgctgacagggacgtacgtctatgaccatcttactccactgcgggactgggcccacgagggcctacgagaccttgcagtggcagttgagcccgtcgtcttctctgacatggagaccaagatcattacctggggggcagacaccgcggcgtgtggggacatcatcttaggcctgcccgtctctggccgcagggggagggagatacttttgggaccggcagatagttttgaggggcaggggtggcgactccttgcgcccatcacggcctatgcccaacagacgcggggcctatttggctgcatcatcaccagcctcacaggccgggacaagaaccaggtcgagggggaggttcaagtggtttccaccgcaacacaatctttcctggcgacctgcgtcaacggcgtgtgttggactgtctaccacggcgccggcacaaagaccctcgccggccaaaagggcccgatcacccaaatgtacaccaatgtagaccaggatctcgtcggctggcaagcgcctcccggggcgcgatccttgacaccgtgcacctgtggcagctcggacctttacttggtcacgaggcatgctgatgtcattccggtgcgccggcggggcgacagcagaggaagcctactctcccccaggcccgtctcctacttgaagggctcttcgggtggtccactgctctgcccctcggggcatgctgtgggcatcttccgggctgctgtgtgcacccggggggttgcgaaggcggtggactttgtgcccgttgagtctatggaaacaactatgcggtccccggtcttcacggacaactcgtcccccccggccgtaccgcagacattccaagtggcccatctacacgctcccactggtagcggcaagagcactaaggtgccggctgcgtatgcagcccaagggtacaaggtactcgtcctgaacccgtctgttgccgccaccctaggtttcggggcgtatatgtctaaggcacatggtgtcgaccctaacatcagaactggggtaaggaccatcaccacgggtgcccccattacgtactccacctatggcaagttccttgccgacggtggttgctctgggggcgcctatgacatcataatatgtgatgagtgccactcaactgactcgactagcatcttgggtatcggcacagtcctggaccaagcggagacggctggagcgcgactcgtcgtactcgccaccgctacgcctccgggatcggtcaccgtgccacatcccaacatcgaggaggtggctctgtccaacattggagagatccccttctatggtaaagccatccccattgagaccatcaagggggggaggcacctcatattctgccattccaagaaaaaatgtgatgagctcgccgcaaagctgtcgggtctcgggcttaatgctgtagcatattaccggggccttgacgtgtccgtcataccgaccagcggagacgtcgttgtcgtggcaacagacgctctaatgacgggtttcactggcgactttgactcagtgatcgactgtaatacatgtgtcacccagacagtcgacttcagcttggaccctaccttcaccattgagacgacgaccgtgcctcaagacgcggtgtcgcgctcgcagcggcgaggcaggactggtaggggcaggacaggcatctacaggtttgtgactccaggagaacggccctcgggcatgttcgattcctcggtcctgtgtgagtgctatgacgcgggctgtgcttggtacgagctcacgcccgccgagacctcagttaggttgcgggcttacctgaatacaccagggttgcccgtctgccaggaccatctggagttctgggagggcgtcttcacaggcctcacccacatagatgcccacttcctgtcccagactaagcaggcaggagagaacttcccctacttggtagcataccaggctacggtgtgcgccagggctcaagctccacccccatcgtgggaccaaatgtggaaatgtctcatacggctgaagcctacgctgcacgggccaacgcccctgctgtataggctaggagccgtccaaaatgaggtcaccctcacacaccccataaccaaattcatcatggcatgcatgtcggctgacctggaggtcgccacgagcacctgggtgctagtaggcggagtcctagcagctctggccgcgtattgcttgacaacaggcagcgtggtcattgtaggcaggatcatcttgtccggaaagccggctattgtgcccgacagggaagtcctctaccagcagttcgatgagatggaagagtgcgccacgcacctcccttacattgaacaaggaatgcagctcgccgaacagttcaagcagaaggcactcgggttgttgcagacagccaccaagcaagcagaggctgctgctcccgtggtggagtccaagtggaaagcccttgagagcttctgggcgaagcatatgtggaatttcatcagcgggatacaatacttagcaggcttgtccactctgcctgggaaccccgcaatagcatcactgatggcattcacagcctccatcaccagcccgctcaccacccaacataccctcctgttcaacattttggggggatgggtggccgcccaactcgccccccccggcgctgcttctgctttcgtaggcgccggtatcgccggcgcggccgttggcagcataggcctcgggaaggtgctagtggacatcttggcaggttatggagcgggggtggcaggcgccctcgtggcctttaaggtcatgagtggtgagttgccttccactgaggacttggtcaacttgctccctgccatcctctcccctggtgccctagtcgtcggggtagtgtgcgcagcaatactgcgtcggcatgtgggcccaggggagggggctgtgcagtggatgaaccggctgatagcgttcgcttcgcggggtaaccacgtttcccccacgcactatgtgcccgaaagcgacgctgcagcgcgtgtcactcagatcctctccagccttaccatcactcagctgctgaggaggcttcatcaatggattaacgaggactgctctacgccatgctccggctcgtggctaagggacgtttgggactggatatgcacggtgttaaccgattttaagacctggctccagtccaagctcctgccgcggttgccgggagtccccttcctctcatgccaacgtgggtacaggggcatctggcggggagacggcatcatgcaaaccacctgcccatgtggagcacagatcaccggacatgtcaaaaacggttccatgaggatcgttgggcctaggacctgcagcaacacgtggcatggaacattccccatcaacgcatacaccacgggcccttgcacgccctccccggcgcccaattattccagggcgctgtggagggtggctgctgaggagtacgtggaggttacgcgggtgggggatttccactacgtgacgggcatgaccactgacaacgtaaagtgcccatgccaggttccggcccccgaattcttcacggaggtggatggggtgcggctgcacaggtacgctccgccgtgcaggcctctcctacgggatgaggtcacattccaggtcgggctcaaccaatacccggtcgggtcacagctcccatgtgagcccgaaccggatgtagcggtgctcacttccatgctcaccgacccctcccacatcacagcagaggcggctaagcgtaggctggctagggggtctcctccctccttagccagctcttcagctagccagttgtctgcgccttccttgaaggcgacatgcactacccagcatgactccccagatgctgacctcatcgaagccaatctcctgtggcggcaggagatgggcgggaacatcacccgcgtggagtcagagaacaaggtagtaattctggactctttcgagccgcttcgagcggaggaagatgagagggaagtatccgttccggcggagatcctgtggagatccaggaaattcccccgagcgatgcccatatgggcaaggccggattacaaccctccactggtagagtcctggaaggacccggactacgtccctccagtggtacatgggtgcccattgccacccactaaggctcctccaataccacctccacggaggaaaaggacggttgtcctgacagaatccaccgtgtcttctgccttggctgagctcgccacaaagaccttcggcagctccgaatcgtcggccgtcgacagcggcacggcgaccgcccctcctgaccagccctccgacgacggcgacgcagggtccgatgttgagtcgtactcctccatgcccccccttgagggggagccgggggatcccgatctcagcgacgggtcttggtctaccgtgagcgaggaagctagtgaggacgtcgtctgctgctcgatgtcctacacatggacaggcgccctgatcacgccatgctccgcggaggaaagtaagttgcccatcaacgcgttgagcaactctctgctgcgtcaccacaacatggtctatgccacaacatctcgcagcgcaagccagcggcagaagaaggtcacctttgacagactgcaggtcctggacgaccattaccgggacgtgctcaaggagatgaaggcgaaggcgtccacggttaaggctaaacttctatccgtagaagaagcctgcatgctgacgcccccacactcggccaaatccaaatttggctatggggcgaaggacgtccggaacctatccagcaaggccattaaccacatccgctccgtgtggaaggacttgctggaagacactgagacaccaattgacaccaccatcatggcaaaaaatgaggttttctgcgtccaaccagagaaaggaggccgcaagccagctcgccttatcgtattcccagacttgggggttcgtgtgtgcgagaaaatggccctttatgacgtggtctccacccttcctcaggccgtgatgggctccttatacgggttccagtactctcctggacagcgggtccagttcctggtgaatgcctggaaacaaaagaagaaccctatgggcttcgcatatgacacccgctgttttgactcaacggtcactgagagtgatatccgtgttgaggagtcaatctaccaatgttgtgacttggcccccgaagccagacaggccataaggtcgctcacagagcggctttatatcgggggtcccctgactaactcaaaagggcagaactgcggttatcgccggtgccgcgcgagcggtgtactgacgaccagctgcggtaataccctcacatgttacttgaaggcctctgcagcctgtcgagctgccaagctccaggactgcacgatgctcgtgtgcggagacgaccttgtcgttatctgtgaaagcgcgggaacccaggaggacgcggcgagcctacgagtcttcacggaggctatgactaggtactctgccccccccggggacccgcccaaaccagaatacgacttggagttgataacatcatgctcctccaatgtatcggtcgcgcacgatgcatctggcaaaagggtgtactacctcacccgtgaccccaccaccccacttgcacgagctgcgtgggagacagctagacacactccagttaactcctggctaggcaacatcatgatgtatgcgcccaccttatgggccaggatgatactcatgactcacatcttctccatccttctagctcaggaacaactggaaaaggctctagattgtcagatctacggggcctgttactccattgagccacttgacctacctcagatcattcagcgactccatggtcttagcgcattttcactccatagttactctccaggtgaaatcaatagggtggctgcatgcctcagaaaacttggggtaccacccttgcgagtctggagacatcgggccagaagtgtccgcgctaagctcctgtcccagggggggagggctgccaactgtggcagatacctcttcaactgggcagtaaagaccaagcttaaactcactccaattccggctgcgtcccagttggacttgtccagctggttcgttgctggttacagcgggggagacatatatcacagcgtgtctcgtgcccgaccccgctggttcatgttgtgcctactcctactttccgtaggggtaggcatctacctgctccccaaccga

SEQ ID NO: 629 - DNA, 9587 bp, Hepatitis C Virus
gccagcccccgattgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggattaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcagcctcgtggaaggcgacaacctatccccaaggctcgccagcccgagggcagggcctgggctcagcccggatacccttggcccctctacggcaatgagggtctggggtgggcaggatggctcctgtcaccccgtggctctcggcctagttggggccctacggacccccggcgtaggtcgcgtaatttgggtaaggtcatcgataccctcacatgcggcttcgccgacctcatggggtacatcccgctcgtcggcgcccccctaggaggcgctgccagggccctggcgcatggcgtccgggttctggaggacggcgtgaactatgcaacagggaatttgcccggttgctctttctctatcttcctcttggctttgctgtcctgtttgaccatcccagcttccgcttacgaagtgcgcaacgtatccggggtgtaccatgtcacgaacgactgctccaactcaagtattgtgtatgaggcagcggacatgatcatgcacacccccgggtgcgtgccctgcgttcgggaggacaattcctcccgttgctgggtagcgctcactcccacgcttgcggccaggaacagcagcgtccccaccacgacaatacgacgccacgtcgacttgctcgttggggcagctgctttctgttccgctatgtacgtgggagacctctgcggatctgttttcctcatttcccagctgttcaccttctcacctcgccggtatgagacggtgcaagactgcaactgctcgctctatcccggccacgtatcaggtcaccgcatggcttgggatatgatgatgaactggtcacctacaacagccctggtggtgtcgcagttgctccggatcccacaagccgtcgtggacatggtggcgggggcccactggggagtcctggcgggccttgcctactattccatggtggggaactgggctaaggtcttgattgtgatgctactttttgccggcgtcgacgggaacactcgtgtgtcagggggggaagcagccaagaacaccatgggctttgcatccctctttgtgtctggcccgtcgcagaaaatccaacttattaacaccaatggcagctggcacatcaacaggactgctctgaattgcgatgactccctccacaccgggttccttgctgcgctgttttacgcgcacaagttcaactcgtccggatgctcggggcgcatggccagctgccgccccattgacgagtttgcccaggggtggggtcccatcactcacggtgtgcctgacaacctggaccagaggccttactgctggcactacgcgcctcggccgtgcggtatcgtacccgcgtcgcaggtgtgtggcccagtgtattgcttcaccccgagccctgtcgtggtggggacgaccgatcgtttcggcgcccccacgtacagctggggggagaatgagacggacgtgctactccttaacaacacgcgaccgccacaaggcaactggttcggttgcacatggatgaacagcaccgggttcaccaagacgtgcgggggccccccgtgcaacattggaggggtcggcaacaacaccttgacctgtcctacggactgcttccggaagcaccccgaggccacttacaccaaatgcggctcgggcccttggttgacacctaggtgcatggttgactacccatacagactctggcactacccttgcactgtcaattttaccatcttcaaggtcaggatgtatgtagggggtgtggagcacaggctcgacgccgcgtgcaattggacccgaggagagcgttgcaatgtggaggacagggatagatcagagcttagcccactgctactgtccacaacagagtggcagatactgccctgttccttcaccaccctaccggctctgtccactggtttgatccacctccaccagaacatcgtggacgtgcaatacctgtacggtgtggggtcagtggttgtctccgttgtaatcagatgggagtatgtcgtgctgctcttccttctcctggcggacgcacgcgtctgcgcctgcttgtggatgatgctgctgatagctcaggctgaggccgccttagagaacttggtggtcctcaatgcggcatctgtagctggagcgcatggcactctctccttccttgtgttcttctgtgccgcctggtacatcaagggcaagctggtccctggagcggcatatgctttctatggcgtgtggccgctgctcctgctcctgctggcattaccaccacgagcatacgccatggaccgggagatggctgcatcatgcggaggcgcggtcttcataggtctggcactcctgaccttgtcaccacactataaagcgttcctcgctaggctcatttggtggttgcagtatcttatcaccagggtcgaggcgctactgcaagtgtgggtcccccctcttaacgttcgggggggccgcgatgccatcatcctcctcacgtgcgcggtccatccagagctaatctttgaaatcaccaaaatcttgctcgccataattggtccgctcatggtgctccaggctggcttaaccagagtgccgtacttcgtgcgcgctcaggggctcatccgtgtgtgcatgttggtgcggaaagtcgctgggggtcactacgtccagatggctctcatgaggctggccgcgctgacgggcacgtacgtttacaaccatcttactccgctgcgggactgggcccacgcgggcttgcgggaccttgtggtggcagttgagcccgtcgtcttctctgacatggagaccaagatcatcacctggggggcagacaccgcggcgtgtggggacatcatcttgggtctacccgtctccgcccgaagggggagggagatacttttgggaccggccgacagttatgaagggcagggatggcggcttcttgcgcctatcacggcctattcccaacagacgcggggcctactcggttgcatcatcactagtctcacaggccgggacaggaaccaggtcgagggggaggttcaggtggtttccaccgcaacgcagtccttcttggcgacctgcatcaatggtgtgtgttggactgtctaccatggtgccggctcaaagaccctagccggcccaaagggtccgatcacccaaatgtacaccaatgtagaccaggacctcgtcggctggcaggcgccccccggggcgcgttccttaacaccatgcacctgcggcagctcggacctctacttggtcacgaggcatgctgatgtcattccggtgcgccggcggggcgataacaggggcagcctgctttcccccagacctgtctcttacttaaagggctcctcgggtggtccactgctctgcccctcagggcacgctgtgggcatcttccgggccgccgtgtgcaccaggggggttgcgaaggcggtggactttgtgcccgttgagtccatggaaactaccatgcggtctccggtcttcacggacaattcatctcccccggccgtaccgcagacattccaagtggcccatctacacgctcccactggcagcggtaagagcactaaggtgccggctgcttatgcagcccaagggtacaaggtactcgtcctgaacccatccgttgccgccaccttaggttttggggcgtatatgtctaaagcacatggtgttgaccccaacatcagaactggggtaaggaccatcaccacaggcgctcccattacgtattccacttatggcaagttccttgccgacggtggttgctctgggggcgcctatgacatcataatatgtgatgagtgccactcaactgactcgacttccatcttgggcatcggcactgtcttggaccaagcggagacggctggagcgcggctcgtcgtgctcgccaccgctacacctccgggatcagtcaccgtgccacatcccaatatcgaggaggtggctttgtccaacactggagagatccccttttatggtaaggcctttcccatcgaggccatcaagggggggaggcatctcattttctgccactccaagaagaaatgtgacgagctcgccacaaagctgtcggcccttggaatcaacgctgtagcgtactaccggggtcttgatgtgtccgtcataccgacaagcggagatgtcgttgtcgtggcaacagacgctctgatgacgggctacactggcgactttgactcagtgatcgactgtaacacatgtgtcacccagacagtcgacttcagcttggaccctaccttcaccattgagacgacgaccgtgccccaagacgcggtatcgcgctcgcaacggcgaggcaggactggtaggggcagggggggcatatacaggtttgtgactccaggggaacggccctcgggcatgttcgattcttcggtcctgtgcgagtgctatgacgcgggctgtgcttggtacgagctcacgcccgccgagacctcggttaggttgcgggcttacctaaatacaccagggttgcccgtctgccaggaccatctggagttctgggagagcgtcttcacaggcctcacccacatagatgcccatttcttatcccagaccaagcaggcaggagacaacttcccctacctggtagcgtaccaggctacggtgtgcgccagggcccaggccccaccaccatcgtgggaccaaatgtggaagtgtctcatacggctaaagcctacactgcacgggccaacacccctgctgtacaggctaggagccgtccaaaacgaagtcactctcacacaccccataaccaaattcatcatggcatgcatgtcggctgacctagaggtcgtcacgagcacctgggtgctagtaggcggggtccttgcagctctggccgcgtactgcctgacaacgggcagcgtggtcattgtgggtaggatcatcttgtctgggaagccggctgtcattcccgatagggaagtgctctaccaggagttcgatgaaatggaagagtgcgcctcgcacctcccttacattgaacagggaatgcagctcgccgagcaattcaagcagaaggcgctcgggttgctgcaagcagccaccaagcaagcggaggctgctgctcccgtggtggagtccaagtggcaagcccttgaggccttttgggcgaagcacatgtggaatttcatcagcgggatacagtacttagcaggcttgtccactctgcctgggaaccccccgatagcttcactgatggcattcacagcctctatcaccagcccgctcaccacccagcataccctcttgtttaacatcttgggggggtgggtggcagcccaactcgccccccccagcgctgcttcagctttcgtgggcgccgggatcgctggcgcggctgttggcagcataggccttgggaaggtgcttgtggacatcctggcgggctatggggcgggggtggcaggcgcgctcgtggcctttaaggtcatgagcggcgaaatgccctccaccgaggacctagtcaacttgctccctgccatcctctcccccggtgccctggttgtcggggtcgtgtgcgcggcaatactgcgccggcacgtgggcccgggggagggggctgtgcagtggatgaaccggctgatagcgttcgcttcgcggggtaaccatgtttcccccacgcactatgtgcctgagagcgacgcggccgcgcgtgtcactcagatcctctccagccttaccatcacccagctgttgaagagactccaccagtggatcaatgaggactgctccacgccatgctccggctcgtggctcagggatgtttgggactggatatgcacggtgttgactgacttcaagacctggctccagtccaagctcctgccacggttgccgggggtccctttcctttcatgccaacgtggatataagggagtctggcgaggagatggcgtcatgcacaccacttgcccatgtggcgcacaaatcaccggacatgtcaaaaacggttccatgaggatcgttgggcctaaaacctgtagcaacacgtggcacggaacattccccatcaacgcgtacaccacgggttcctgcacaccctccccggcgccaaactattccagggcgttgtggcgggtagctgctgaggagtacgtggaggtcacgcgggtgggggatttccactacgtgacgggcatgaccactgacaacataaaatgcccatgccaggttccggcccccgaatttttcacagagttggacggggtgcggctgcacaggtacgctccggcgtgcaaacctctcttacgggatgaggtcacattccaggtcgggctcaaccaatacgtggttgggtcacagcttccatgcgagcccgaaccggatgtaacagtgctcacttccatgctcaccgacccctcccacattacagcagagacggctaagcgtaggctggccagggggtctcccccttccttggcccgctcttcagctagtcagttgtctgcgccttctctgaaggcgacatgcaccacccatcatgactccccagacgccgacctcatcgaggccaacctcctgtggcggcaggagatgggcgggaacatcacccgcgtggagtcagagaacaaagtagtgattctggactctttcgacccgcttcgagcggaggaggatgagagggaagtatccgttccggcggagatcctgcggaaaaccaggaaattcccctcagcgttgcccatatgggcacgcccggactacaacccaccactgttagagtcttggagagacccggactatgtccctccggtggtacacgggtgcccgttaccgcccaccaaggcccctccaataccacctccacggagaaagagaacagttatcctgacagaatccactgtgtcttctgccttggcggagcttgctacaaagaccttcggcagctccggatcgtcggccgtcgacagcggcacagcgactgcccctcctgatgggccctccgacgacggtgatgcaggatcggacgctgagtcatactcctccatgcccccccttgagggggagccgggggatcccgatctcagcgacgggtcttggtccactgtgagcgaggaggccagtgaggacgtcgtctgctgctcaatgtcctacacatggacaggtgccttaatcacgccatgcgccgcggaggagagcaagctgcccatcaatgcgttgagcaactctttgctgcgccaccacaacatggtctatgctacaacatcccgcagcgcaagccagcggcagaaaaaggtcacctttgacagactgcaagtcctggacgaccactaccgggacgtgctcaaggagatgaaggcgaaggcgtccacagttaaggccaaacttctatccgtagaagaggcctgcaagctgacgcccccacattcagccagatctaagtttggctatggggcaaaggacgtccggaacctatccagtaaggccgttaaccacatccactccgtgtggaaggacttgctggaagacactgagacaccaattgataccaccgtcatggcaaaaaatgaggtcttctgtgtccaaccagagaaaggaggccgcaagccagctcgccttatcgtgttcccagacctgggggtgcgtgtgtgcgagaaaatggccctttatgatgtggtctccactcttcctcaggccgtgatgggctcctcatacggattccaatactctcctggacagcgggtcgagttcctggtgaatgcctggaaatcaaagaagacccctatgggcttcgcatatgacacccgctgttttgactcaacagtcactgagaatgacatccgtgttgaggagtcaatttaccaatgttgtgacttggcccccgaggccagacaggccataaggtcgctcacagagcggctttatatcgggggccccctgactaattcaaaagggcagaactgcggttatcgccggtgccgcgccagcggcgtgctgacgactagctgcggtaacaccctcacatgttacttgaaggcctctgcagcctgtcgagctgcaaagctccaggactgcacgatgctcgtgtgcggagacgacctcgtcgttatctgtgagagcgcggggacccaggaggacgcggcgagcctgcgagtcttcacggaggctatgaccaggtactctgccccccccggggacccgccccaaccggaatacgacttggagctgataacatcatgctcctccaacgtgtcggtcgcgcacgatgcatctggcaagcgggtgtactatctcacccgcgaccccaccacccctcttgctcgggctgcgtgggagacagctagacacactccagtcaactcctggctaggcaacatcatcatgtatgcgcccaccttatgggcaaggatgattctgatgacccacttcttctcaatccttctagcccaggagcaacttgagaaagccctagattgccagatctacggggccacttactccattgagccacttgacctacctcagatcattcaacgactccatggtcttagcgcattttcactccatagttactctccaggtgagatcaatagggtggcttcatgcctcaggaaacttggggtaccgcccttgcgagtctggagacatcgggccagaagtgtccgcgctaagctactgtcccagggggggagggccgccacgtgtggcaagtacctcttcaactgggccgtacggaccaagctcaaactcactccaattccggctgcgtcccggttggacttgtccggctggttcgtcgccggttacagcgggggagacatatatcacagcctgtctcgcgcccgaccccgctggttcatgtggtgcctactcctactttccgtaggggtaggcatctacctgctccccaaccggtgaacggggagctaaacactccaggccaataggccattcctttttttttttttttttttttttttctttttttttccttttttttttttttttttttttttccttttctttcttctttggtggctccatcttagccctagtcacggctagctgtgaaaggtccgtgagccgcatgactgcagagagtgctgatactggcctctctgcagatcatgt

SEQ ID NO: 630 - DNA, 9646 bp, Hepatitis C Virus
gccagccccctgatgggggcgacactccaccatgaatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggataaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcacgtcggcccgagggcaggacctgggctcagcccgggtacccttggcccctctatggcaatgagggttgcgggtgggcgggatggctcctgtctccccgtggctctcggcctagctggggccccacagacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttctggaagacggcgtgaactatgcaacagggaaccttcctggttgctctttctctatcttccttctggccctgctctcttgcctgactgtgcccgcttcagcctaccaagtgcgcaattcctcggggctttaccatgtcaccaatgattgccctaactcgagtattgtgtacgaggcggccgatgccatcctgcacactccggggtgtgtcccttgcgttcgcgagggtaacgcctcgaggtgttgggtggcggtgacccccacggtggccaccagggacggcaaactccccacaacgcagcttcgacgtcatatcgatctgcttgtcgggagcgccaccctctgctcggccctctacgtgggggacctgtgcgggtctgtctttcttgttggtcaactgtttaccttctctcccaggcgccactggacgacgcaagactgcaattgttctatctatcccggccatataacgggtcatcgcatggcatgggatatgatgatgaactggtcccctacggcagcgttggtggtagctcagctgctccggatcccacaagccatcatggacatgatcgctggtgctcactggggagtcctggcgggcatagcgtatttctccatggtggggaactgggcgaaggtcctggtagtgctgctgctatttgccggcgtcgacgcggaaacccacgtcaccgggggaagtgccggccgcaccacggctgggcttgttggtctccttacaccaggcgccaagcagaacatccaactgatcaacaccaacggcagttggcacatcaatagcacggccttgaactgcaatgaaagccttaacaccggctggttagcagggctcttctatcagcacaaattcaactcttcaggctgtcctgagaggttggccagctgccgacgccttaccgattttgcccagggctggggtcctatcagttatgccaacggaagcggcctcgacgaacgcccctactgctggcactaccctccaagaccttgtggcattgtgcccgcaaagagcgtgtgtggcccggtatattgcttcactcccagccccgtggtggtgggaacgaccgacaggtcgggcgcgcctacctacagctggggtgcaaatgatacggatgtcttcgtccttaacaacaccaggccaccgctgggcaattggttcggttgtacctggatgaactcaactggattcaccaaagtgtgcggagcgcccccttgtgtcatcggaggggtgggcaacaacaccttgctctgccccactgattgtttccgcaagcatccggaagccacatactctcggtgcggctccggtccctggattacacccaggtgcatggtcgactacccgtataggctttggcactatccttgtaccatcaattacaccatattcaaagtcaggatgtacgtgggaggggtcgagcacaggctggaagcggcctgcaactggacgcggggcgaacgctgtgatctggaagacagggacaggtccgagctcagcccattgctgctgtccaccacacagtggcaggtccttccgtgttctttcacgaccctgccagccttgtccaccggcctcatccacctccaccagaacattgtggacgtgcagtacttgtacggggtagggtcaagcatcgcgtcctgggccattaagtgggagtacgtcgttctcctgttcctcctgcttgcagacgcgcgcgtctgctcctgcttgtggatgatgttactcatatcccaagcggaggcggctttggagaacctcgtaatactcaatgcagcatccctggccgggacgcacggtcttgtgtccttcctcgtgttcttctgctttgcgtggtatctgaagggtaggtgggtgcccggagcggtctacgccttctacgggatgtggcctctcctcctgctcctgctggcgttgcctcagcgggcatacgcactggacacggaggtggccgcgtcgtgtggcggcgttgttcttgtcgggttaatggcgctgactctgtcgccatattacaagcgctacatcagctggtgcatgtggtggcttcagtattttctgaccagagtagaagcgcaactgcacgtgtgggttccccccctcaacgtccggggggggcgcgatgccgtcatcttactcatgtgtgttgtacacccgactctggtatttgacatcaccaaactactcctggccatcttcggacccctttggattcttcaagccagtttgcttaaagtcccctacttcgtgcgcgttcaaggccttctccggatctgcgcgctagcgcggaagatagccggaggtcattacgtgcaaatggccatcatcaagttaggggcgcttactggcacctatgtgtataaccatctcacccctcttcgagactgggcgcacaacggcctgcgagatctggccgtggctgtggaaccagtcgtcttctcccgaatggagaccaagctcatcacgtggggggcagataccgccgcgtgcggtgacatcatcaacggcttgcccgtctctgcccgtaggggccaggagatactgcttgggccagccgacggaatggtctccaaggggtggaggttgctggcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctggactgtctaccacggggccggaacgaggaccatcgcatcacccaagggtcctgtcatccagatgtataccaatgtggaccaagaccttgtgggctggcccgctcctcaaggttcccgctcattgacaccctgcacctgcggctcctcggacctttacctggtcacgaggcacgccgatgtcattcccgtgcgccggcgaggtgatagcaggggtagcctgctttcgccccggcccatttcctacttgaaaggctcctcggggggtccgctgttgtgccccgcgggacacgccgtgggcctattcagggccgcggtgtgcacccgtggagtggctaaggcggtggactttatccctgtggagaacctagagacaaccatgagatccccggtgttcacggacaactcctctccaccagcagtgccccagagcttccaggtggcccacctgcatgctcccaccggcagcggtaagagcaccaaggtcccggctgcgtacgcagcccagggctacaaggtgttggtgctcaacccctctgttgctgcaacgctgggctttggtgcttacatgtccaaggcccatggggttgatcctaatatcaggaccggggtgagaacaattaccactggcagccccatcacgtactccacctacggcaagttccttgccgacggcgggtgctcaggaggtgcttatgacataataatttgtgacgagtgccactccacggatgccacatccatcttgggcatcggcactgtccttgaccaagcagagactgcgggggcgagactggttgtgctcgccactgctacccctccgggctccgtcactgtgtcccatcctaacatcgaggaggttgctctgtccaccaccggagagatccctttttacggcaaggctatccccctcgaggtgatcaaggggggaagacatctcatcttctgccactcaaagaagaagtgcgacgagctcgccgcgaagctggtcgcattgggcatcaatgccgtggcctactaccgcggtcttgacgtgtctgtcatcccgaccagcggcgatgttgtcgtcgtgtcgaccgatgctctcatgactggctttaccggcgacttcgactctgtgatagactgcaacacgtgtgtcactcagacagtcgatttcagccttgaccctacctttaccattgagacaaccacgctcccccaggatgctgtctccaggactcaacgccggggcaggactggcagggggaagccaggcatctacagatttgtggcaccgggggagcgcccctccggcatgttcgactcgtccgtcctctgtgagtgctatgacgcgggctgtgcttggtatgagctcacgcccgccgagactacagttaggctacgagcgtacatgaacaccccggggcttcccgtgtgccaggaccatcttgaattttgggagggcgtctttacgggcctcactcatatagatgcccactttctatcccagacaaagcagagtggggagaactttccttacctggtagcgtaccaagccaccgtgtgcgctagggctcaagcccctcccccatcgtgggaccagatgtggaagtgtttgatccgccttaaacccaccctccatgggccaacacccctgctatacagactgggcgctgttcagaatgaagtcaccctgacgcacccaatcaccaaatacatcatgacatgcatgtcggccgacctggaggtcgtcacgagcacctgggtgctcgttggcggcgtcctggctgctctggccgcgtattgcctgtcaacaggctgcgtggtcatagtgggcaggattgtcttgtccgggaagccggcaattatacctgacagggaggttctctaccaggagttcgatgagatggaagagtgctctcagcacttaccgtacatcgagcaagggatgatgctcgctgagcagttcaagcagaaggccctcggcctcctgcagaccgcgtcccgccaagcagaggttatcacccctgctgtccagaccaactggcagaaactcgaggtcttctgggcgaagcacatgtggaatttcatcagtgggatacaatacttggcgggcctgtcaacgctgcctggtaaccccgccattgcttcattgatggcttttacagctgccgtcaccagcccactaaccactggccaaaccctcctcttcaacatattgggggggtgggtggctgcccagctcgccgcccccggtgccgctaccgcctttgtgggcgctggcttagctggcgccgccatcggcagcgttggactggggaaggtcctcgtggacattcttgcagggtatggcgcgggcgtggcgggagctcttgtagcattcaagatcatgagcggtgaggtcccctccacggaggacctggtcaatctgctgcccgccatcctctcgcctggagcccttgtagtcggtgtggtctgcgcagcaatactgcgccggcacgttggcccgggcgagggggcagtgcaatggatgaaccggctaatagccttcgcctcccgggggaaccatgtttcccccacgcactacgtgccggagagcgatgcagccgcccgcgtcactgccatactcagcagcctcactgtaacccagctcctgaggcgactgcatcagtggataagctcggagtgtaccactccatgctccggttcctggctaagggacatctgggactggatatgcgaggtgctgagcgactttaagacctggctgaaagccaagctcatgccacaactgcctgggattccctttgtgtcctgccagcgcgggtataggggggtctggcgaggagacggcattatgcacactcgctgccactgtggagctgagatcactggacatgtcaaaaacgggacgatgaggatcgtcggtcctaggacctgcaggaacatgtggagtgggacgttccccattaacgcctacaccacgggcccctgtactccccttcctgcgccgaactataagttcgcgctgtggagggtgtctgcagaggaatacgtggagataaggcgggtgggggacttccactacgtatcgggtatgactactgacaatcttaaatgcccgtgccagatcccatcgcccgaatttttcacagaattggacggggtgcgcctacataggtttgcgcccccttgcaagcccttgctgcgggaggaggtatcattcagagtaggactccacgagtacccggtggggtcgcaattaccttgcgagcccgaaccggacgtagccgtgttgacgtccatgctcactgatccctcccatataacagcagaggcggccgggagaaggttggcgagagggtcacccccttctatggccagctcctcggccagccagctgtccgctccatctctcaaggcaacttgcaccgccaaccatgactcccctgacgccgagctcatagaggctaacctcctgtggaggcaggagatgggcggcaacatcaccagggttgagtcagagaacaaagtggtgattctggactccttcgatccgcttgtggcagaggaggatgagcgggaggtctccgtacccgcagaaattctgcggaagtctcggagattcgcccgggccctgcccgtttgggcgcggccggactacaaccccccgctagtagagacgtggaaaaagcctgactacgaaccacctgtggtccatggctgcccgctaccacctccacggtcccctcctgtgcctccgcctcggaaaaagcgtacggtggtcctcaccgaatcaaccctatctactgccttggccgagcttgccaccaaaagttttggcagctcctcaacttccggcattacgggcgacaatacgacaacatcctctgagcccgccccttctggctgcccccccgactccgacgttgagtcctattcttccatgccccccctggagggggagcctggggatccggatctcagcgacgggtcatggtcgacggtcagtagtggggccgacacggaagatgtcgtgtgctgctcaatgtcttattcctggacaggcgcactcgtcaccccgtgcgctgcggaagaacaaaaactgcccatcaacgcactgagcaactcgttgctacgccatcacaatctggtgtattccaccacttcacgcagtgcttgccaaaggcagaagaaagtcacatttgacagactgcaagttctggacagccattaccaggacgtgctcaaggaggtcaaagcagcggcgtcaaaagtgaaggctaacttgctatccgtagaggaagcttgcagcctgacgcccccacattcagccaaatccaagtttggctatggggcaaaagacgtccgttgccatgccagaaaggccgtagcccacatcaactccgtgtggaaagaccttctggaagacagtgtaacaccaatagacactaccatcatggccaagaacgaggttttctgcgttcagcctgagaaggggggtcgtaagccagctcgtctcatcgtgttccccgacctgggcgtgcgcgtgtgcgagaagatggccctgtacgacgtggttagcaagctccccctggccgtgatgggaagctcctacggattccaatactcaccaggacagcgggttgaattcctcgtgcaagcgtggaagtccaagaagaccccgatggggttctcgtatgatacccgctgttttgactccacagtcactgagagcgacatccgtacggaggaggcaatttaccaatgttgtgacctggacccccaagcccgcgtggccatcaagtccctcactgagaggctttatgttgggggccctcttaccaattcaaggggggaaaactgcggctaccgcaggtgccgcgcgagcggcgtactgacaactagctgtggtaacaccctcacttgctacatcaaggcccgggcagcctgtcgagccgcagggctccaggactgcaccatgctcgtgtgtggcgacgacttagtcgttatctgtgaaagtgcgggggtccaggaggacgcggcgagcctgagagccttcacggaggctatgaccaggtactccgccccccccggggaccccccacaaccagaatacgacttggagcttataacatcatgctcctccaacgtgtcagtcgcccacgacggcgctggaaagagggtctactaccttacccgtgaccctacaacccccctcgcgagagccgcgtgggagacagcaagacacactccagtcaattcctggctaggcaacataatcatgtttgcccccacactgtgggcgaggatgatactgatgacccatttctttagcgtcctcatagccagggatcagcttgaacaggctcttaactgtgagatctacggagcctgctactccatagaaccactggatctacctccaatcattcaaagactccatggcctcagcgcattttcactccacagttactctccaggtgaaatcaatagggtggccgcatgcctcagaaaacttggggtcccgcccttgcgagcttggagacaccgggcccggagcgtccgcgctaggcttctgtccagaggaggcagggctgccatatgtggcaagtacctcttcaactgggcagtaagaacaaagctcaaactcactccaatagcggccgctggccggctggacttgtccggttggttcacggctggctacagcgggggagacatttatcacagcgtgtctcatgcccggccccgctggttctggttttgcctactcctgctcgctgcaggggtaggcatctacctcctccccaaccgatgaaggttggggtaaacactccggcctcttaggccatttcctgtttttttttttttttttttttttttttttttttttttttttttttttttttctttttttttttttttttccttttttttttttttttttttctttccttcttttttcctttcttttccttccttctttaatggtggctccatcttagccctagtcacggctagctgtgaaaggtccgtgagccgcatgactgcagagagtgctgatactggcctctctgcagatcatgt

SEQ ID NO: 631 - DNA, 9599 bp, Hepatitis C Virus
gccagccccctgatgggggcgacactccaccatgaatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggataaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcacgtcggcccgagggcaggacctgggctcagcccgggtacccttggcccctctatggcaatgagggttgcgggtgggcgggatggctcctgtctccccgtggctctcggcctagctggggccccacagacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttctggaagacggcgtgaactatgcaacagggaaccttcctggttgctctttctctatcttccttctggccctgctctcttgcctgactgtgcccgcttcagcctaccaagtgcgcaattcctcggggctttaccatgtcaccaatgattgccctaactcgagtattgtgtacgaggcggccgatgccatcctgcacactccggggtgtgtcccttgcgttcgcgagggtaacgcctcgaggtgttgggtggcggtgacccccacggtggccaccagggacggcaaactccccacaacgcagcttcgacgtcatatcgatctgcttgtcgggagcgccaccctctgctcggccctctacgtgggggacctgtgcgggtctgtctttcttgttggtcaactgtttaccttctctcccaggcgccactggacgacgcaagactgcaattgttctatctatcccggccatataacgggtcatcgcatggcatgggatatgatgatgaactggtcccctacggcagcgttggtggtagctcagctgctccggatcccacaagccatcatggacatgatcgctggtgctcactggggagtcctggcgggcatagcgtatttctccatggtggggaactgggcgaaggtcctggtagtgctgctgctatttgccggcgtcgacgcggaaacccacgtcaccgggggaaatgccggccgcaccacggctgggcttgttggtctccttacaccaggcgccaagcagaacatccaactgatcaacaccaacggcagttggcacatcaatagcacggccttgaattgcaatgaaagccttaacaccggctggttagcagggctcttctatcaacacaaattcaactcttcaggctgtcctgagaggttggccagctgccgacgccttaccgattttgcccagggctggggtcctatcagttatgccaacggaagcggcctcgacgaacgcccctactgctggcactaccctccaagaccttgtggcattgtgcccgcaaagagcgtgtgtggcccggtatattgcttcactcccagccccgtggtggtgggaacgaccgacaggtcgggcgcgcctacctacagctggggtgcaaatgatacggatgtcttcgtccttaacaacaccaggccaccgctgggcaattggttcggttgtacctggatgaactcaactggattcaccaaagtgtgcggagcgcccccttgtgtcatcggaggggtgggcaacaacaccttgctctgccccactgattgcttccgcaaacatccggaagccacatactctcggtgcggctccggtccctggattacacccaggtgcatggtcgactacccgtataggctttggcactatccttgtaccatcaattacaccatattcaaagtcaggatgtacgtgggaggggtcgagcacaggctggaagcggcctgcaactggacgcggggcgaacgctgtgatctggaagacagggacaggtccgagctcagcccgttgctgctgtccaccacacagtggcaggtccttccgtgttctttcacgaccctgccagccttgtccaccggcctcatccacctccaccagaacattgtggacgtgcagtacttgtacggggtagggtcaagcatcgcgtcctgggccattaagtgggagtacgtcgttctcctgttccttctgcttgcagacgcgcgcgtctgctcctgcttgtggatgatgttactcatatcccaagcggaggcggctttggagaacctcgtaatactcaatgcagcatccctggccgggacgcacggtcttgtgtccttcctcgtgttcttctgctttgcgtggtatctgaagggtaggtgggtgcccggagcggtctacgccctctacgggatgtggcctctcctcctgctcctgctggcgttgcctcagcgggcatacgcactggacacggaggtggccgcgtcgtgtggcggcgttgttcttgtcgggttaatggcgctgactctgtcgccatattacaagcgctatatcagctggtgcatgtggtggcttcagtattttctgaccagagtagaagcgcaactgcacgtgtgggttccccccctcaacgtccggggggggcgcgatgccgtcatcttactcatgtgtgtagtacacccgaccctggtatttgacatcaccaaactactcctggccatcttcggacccctttggattcttcaagccagtttgcttaaagtcccctacttcgtgcgcgttcaaggccttctccggatctgcgcgctagcgcggaagatagccggaggtcattacgtgcaaatggccatcatcaagttaggggcgcttactggcacctatgtgtataaccatctcacccctcttcgagactgggcgcacaacggcctgcgagatctggccgtggctgtggaaccagtcgtcttctcccgaatggagaccaagctcatcacgtggggggcagataccgccgcgtgcggtgacatcatcaacggcttgcccgtctctgcccgtaggggccaggagatactgcttgggccagccgacggaatggtctccaaggggtggaggttgctggcgcccatcacggcgtacgcccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctggactgtctaccacggggccggaacgaggaccatcgcatcacccaagggtcctgtcatccagatgtataccaatgtggaccaagaccttgtgggctggcccgctcctcaaggttcccgctcattgacaccctgtacctgcggctcctcggacctttacctggtcacgaggcacgccgatgtcattcccgtgcgccggcgaggtgatagcaggggtagcctgctttcgccccggcccatttcctacttgaaaggctcctcggggggtccgctgttgtgccccgcgggacacgccgtgggcctattcagggccgcggtgtgcacccgtggagtggctaaagcggtggactttatccctgtggagaacctagggacaaccatgagatccccggtgttcacggacaactcctctccaccagcagtgccccagagcttccaggtggcccacctgcatgctcccaccggcagcggtaagagcaccaaggtcccggctgcgtacgcagcccagggctacaaggtgttggtgctcaacccctctgttgctgcaacgctgggctttggtgcttacatgtccaaggcccatggggttgatcctaatatcaggaccggggtgagaacaattaccactggcagccccatcacgtactccacctacggcaagttccttgccgacggcgggtgctcaggaggtgcttatgacataataatttgtgacgagtgccactccacggatgccacatccatcttgggcatcggcactgtccttgaccaagcagagactgcgggggcgagactggttgtgctcgccactgctacccctccgggctccgtcactgtgtcccatcctaacatcgaggaggttgctctgtccaccaccggagagatccccttttacggcaaggctatccccctcgaggtgatcaaggggggaagacatctcatcttctgccactcaaagaagaagtgcgacgagctcgccgcgaagctggtcgcattgggcatcaatgccgtggcctactaccgcggtcttgacgtgtctgtcatcccgaccagcggcgatgttgtcgtcgtgtcgaccgatgctctcatgactggctttaccggcgacttcgactctgtgatagactgcaacacgtgtgtcactcagacagtcgatttcagccttgaccctacctttaccattgagacaaccacgctcccccaggatgctgtctccaggactcaacgccggggcaggactggcagggggaagccaggcatctatagatttgtggcaccgggggagcgcccctccggcatgttcgactcgtccgtcctctgtgagtgctatgacgcgggctgtgcttggtatgagctcacgcccgccgagactacagttaggctacgagcgtacatgaacaccccggggcttcccgtgtgccaggaccatcttgaattttgggagggcgtctttacgggcctcactcatatagatgcccactttttatcccagacaaagcagagtggggagaactttccttacctggtagcgtaccaagccaccgtgtgcgctagggctcaagcccctcccccatcgtgggaccagatgtggaagtgtttgatccgccttaaacccaccctccatgggccaacacccctgctatacagactgggcgctgttcagaatgaagtcaccctgacgcacccaatcaccaaatacatcatgacatgcatgtcggccgacctggaggtcgtcacgagcacctgggtgctcgttggcggcgtcctggctgctctggccgcgtattgcctgtcaacaggctgcgtggtcatagtgggcaggatcgtcttgtccgggaagccggcaattatacctgacagggaggttctctaccaggagttcgatgagatggaagagtgctctcagcacttaccgtacatcgagcaagggatgatgctcgctgagcagttcaagcagaaggccctcggcctcctgcagaccgcgtcccgccatgcagaggttatcacccctgctgtccagaccaactggcagaaactcgaggtcttttgggcgaagcacatgtggaatttcatcagtgggatacaatacttggcgggcctgtcaacgctgcctggtaaccccgccattgcttcattgatggcttttacagctgccgtcaccagcccactaaccactggccaaaccctcctcttcaacatattgggggggtgggtggctgcccagctcgccgcccccggtgccgctactgcctttgtgggtgctggcctagctggcgccgccatcggcagcgttggactggggaaggtcctcgtggacattcttgcagggtatggcgcgggcgtggcgggagctcttgtagcattcaagatcatgagcggtgaggtcccctccacggaggacctggtcaatctgctgcccgccatcctctcgcctggagcccttgtagtcggtgtggtctgcgcagcaatactgcgccggcacgttggcccgggcgagggggcagtgcaatggatgaaccggctaatagccttcgcctcccgggggaaccatgtttcccccacgcactacgtgccggagagcgatgcagccgcccgcgtcactgccatactcagcagcctcactgtaacccagctcctgaggcgactgcatcagtggataagctcggagtgtaccactccatgctccggttcctggctaagggacatctgggactggatatgcgaggtgctgagcgactttaagacctggctgaaagccaagctcatgccacaactgcctgggattccctttgtgtcctgccagcgcgggtataggggggtctggcgaggagacggcattatgcacactcgctgccactgtggagctgagatcactggacatgtcaaaaacgggacgatgaggatcgtcggtcctaggacctgcaggaacatgtggagtgggacgttccccattaacgcctacaccacgggcccctgtactccccttcctgcgccgaactataagttcgcgctgtggagggtgtctgcagaggaatacgtggagataaggcgggtgggggacttccactacgtatcgggtatgactactgacaatcttaaatgcccgtgccagatcccatcgcccgaatttttcacagaattggacggggtgcgcctacacaggtttgcgcccccttgcaagcccttgctgcgggaggaggtatcattcagagtaggactccacgagtacccggtggggtcgcaattaccttgcgagcccgaaccggacgtagccgtgttgacgtccatgctcactgatccctcccatataacagcagaggcggccgggagaaggttggcgagagggtcacccccttctatggccagctcctcggctagccagctgtccgctccatctctcaaggcaacttgcaccgccaaccatgactcccctgacgccgagctcatagaggctaacctcctgtggaggcaggagatgggcggcaacatcaccagggttgagtcagagaacaaagtggtgattctggactccttcgatccgcttgtggcagaggaggatgagcgggaggtctccgtacctgcagaaattctgcggaagtctcggagattcgcccgggccctgcccgtctgggcgcggccggactacaaccccccgctagtagagacgtggaaaaagcctgactacgaaccacctgtggtccatggctgcccgctaccacctccacggtcccctcctgtgcctccgcctcggaaaaagcgtacggtggtcctcaccgaatcaaccctatctactgccttggccgagcttgccaccaaaagttttggcagctcctcaacttccggcattacgggcgacaatacgacaacatcctctgagcccgccccttctggctgcccccccgactccgacgttgagtcctattcttccatgccccccctggagggggagcctggggatccggatctcagcgacgggtcatggtcgacggtcagtagtggggccgacacggaagatgtcgtgtgctgctcaatgtcttattcctggacaggcgcactcgtcaccccgtgcgctgcggaagaacaaaaactgcccatcaacgcactgagcaactcgttgctacgccatcacaatctggtgtattccaccacttcacgcagtgcttgccaaaggcagaagaaagtcacatttgacagactgcaagttctggacagccattaccaggacgtgctcaaggaggtcaaagcagcggcgtcaaaagtgaaggctaacttgctatccgtagaggaagcttgcagcctgacgcccccacattcagccaaatccaagtttggctatggggcaaaagacgtccgttgccatgccagaaaggccgtagcccacatcaactccgtgtggaaagaccttctggaagacagtgtaacaccaatagacactaccatcatggccaagaacgaggttttctgcgttcagcctgagaaggggggtcgtaagccagctcgtctcatcgtgttccccgacctgggcgtgcgcgtgtgcgagaagatggccctgtacgacgtggttagcaagctccccctggccgtgatgggaagctcctacggattccaatactcaccaggacagcgggttgaattcctcgtgcaagcgtggaagtccaagaagaccccgatggggttctcgtatgatacccgctgttttgactccacagtcactgagagcgacatccgtacggaggaggcaatttaccaatgttgtgacctggacccccaagcccgcgtggccatcaagtccctcactgagaggctttatgttgggggccctcttaccaattcaaggggggaaaactgcggctaccgcaggtgccgcgcgagcggcgtactgacaactagctgtggtaacaccctcacttgctacatcaaggcccgggcagcctgtcgagccgcagggctccaggactgcaccatgctcgtgtgtggcgacgacttagtcgttatctgtgaaagtgcgggggtccaggaggacgcggcgagcctgagagccttcacggaggctatgaccaggtactccgccccccccggggaccccccacaaccagaatacgacttggagcttataacatcatgctcctccaacgtgtcagtcgcccacgacggcgctggaaagagggtctactaccttacccgtgaccctacaacccccctcgcgagagccgcgtgggagacagcaagacacactccagtcaattcctggctaggcaacataatcatgtttgcccccacactgtgggcgaggatgatactgatgacccatttctttagcgtcctcatagccagggatcagcttgaacaggctcttaactgtgagatctacggagcctgctactccatagaaccactggatctacctccaatcattcaaagactccatggcctcagcgcattttcactccacagttactctccaggtgaaatcaatagggtggccgcatgcctcagaaaacttggggtcccgcccttgcgagcttggagacaccgggcccggagcgtccgcgctaggcttctgtccagaggaggcagggctgccatatgtggcaagtacctcttcaactgggcagtaagaacaaagctcaaactcactccaatagcggccgctggccggctggacttgtccggttggttcacggctggctacagcgggggagacatttatcacagcgtgtctcatgcccggccccgctggttctggttttgcctactcctgctcgctgcaggggtaggcatctacctcctccccaaccgatgaaggttggggtaaacactccggcctcttaagccatttcctgttttttttttttttttttttttttttttctttttttttttctttcctttccttctttttttcctttctttttcccttctttaatggtggctccatcttagccctagtcacggctagctgtgaaaggtccgtgagccgcatgactgcagagagtgctgatactggcctctctgcagatcatgt

SEQ ID NO: 632 - DNA, 9599 bp, Hepatitis C Virus
gccagccccctgatgggggcgacactccaccatgaatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggataaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcacgtcggcccgagggcaggacctgggctcagcccgggtacccttggcccctctatggcaatgagggttgcgggtgggcgggatggctcctgtctccccgtggctctcggcctagctggggccccacagacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttctggaagacggcgtgaactatgcaacagggaaccttcctggttgctctttctctatcttccttctggccctgctctcttgcctgactgtgcccgcttcagcctaccaagtgcgcaattcctcggggctttaccatgtcaccaatgattgccctaattcgagtattgtgtacgaggcggccgatgccatcctgcacactccggggtgtgtcccttgcgttcgcgagggtaacgcctcgaggtgttgggtggcggtgacccccacggtggccaccagggacggcaaactccccacaacgcagcttcgacgtcatatcgatctgcttgtcgggagcgccaccctctgctcggccctctacgtgggggacctgtgcgggtctgtttttcttgttggtcaactgtttaccttctctcccaggcgccactggacgacgcaaagctgcaattgttctatctatcccggccatataacgggtcatcgcatggcatgggatatgatgatgaactggtcccctacggcagcgttggtggtagctcagctgctccggatcccacaagccatcatggacatgatcgctggtgctcactggggagtcctggcgggcatagcgtatttctccatggtggggaactgggcgaaggtcctggtagtgctgctgctatttgccggcgtcgacgcggaaacccacgtcaccgggggaagtgccggccacaccacggctgggcttgttggtctccttacaccaggcgccaagcagaacatccaactgatcaacaccaacggcagttggcacatcaatagcacggccttgaactgcaacgatagccttaccaccggctggttagcagggctcttctatcgccacaaattcaactcttcaggctgtcctgagaggttggccagctgccgacgccttaccgattttgcccagggctggggtcctatcagttatgccaacggaagcggcctcgacgaacgcccctactgctggcactaccctccaagaccttgtggcattgtgcccgcaaagagcgtgtgtggcccggtatattgcttcactcccagccccgtggtggtgggaacgaccgacaggtcgggcgcgcccacctacagctggggtgcaaatgacacggatgtcttcgtccttaacaacaccaggccaccgctgggcaattggttcggttgtacctggatgaactcaactggattcaccaaagtgcgcggagtgcccccttgtgtcatcggaggggtgggcaacaacaccttgctctgccccactgattgcttccgcaaacatccggaagccacatactctcggtgcggctccggtccctggattacacccaggtgcatggtcgactacccgtataggctttggcactatccttgtaccatcaattacaccatattcaaagtcaggatgtacgtgggaggggtcgagcacaggctggaagcggcctgcaactggacgcggggcggacgctgtgatctggaagacagggacaggtccgagctcagcccattgctgctgtccaccacacagtggcaggtccttccgtgttctttcacgaccctgccagccttgtccaccggcctcatccacctccaccagaacattgtggacgtgcagtacttgtacggggtggggtcaagcatcgcgtcctgggccattaagtgggagtacgtcgttctcctgttccttctgcttgcagacgcgcgcgtctgctcctgcttgtggatgatgttactcatatcccaagcggaggcggctttggagaacctcgtaatactcaatgcagcatccctggccgggacgcatggtcttgtgtccttcctcgtgttcttccgctttgcgtggtatctgaagggtaggtgggtgcccggagcggtctacgccttctacgggatgtggcctctcctcctgctcctgctggcgttgcctcagcgggcatacgcactggacacggaggtggccgcgtcgtgtggcggcgttgttcttgtcgggttaatggcgctgactctgtcaccatattacaagcgctatatcagctggtgcatgtggtggcttcagtattttctgaccagagtagaagcgcaactgcacgtgtgggttccccccctcaacgtccggggggggcgcgatgccgtcatcttactcatgtgtgttgtacacccgactctggtatttgacatcaccaaactactcctggccatcttcggacccctttggattcttcaagccagtttgcttaaagtcccctacttcgtgcgcgttcaaggccttctccggatctgcgcgctagcgcggaagatagccggaggccattacgtgcaaatggccatcatcaagttgggggcgcttactggcacctatgtgtataaccatctcacccctcttcgagactgggcgcacaacggcctgcgagatctggccgtggctgtggaaccagtcgtcttctcccgaatggagaccaagctcatcacgtggggggcagataccgccgcgtgcggtgacatcatcaacggcttgcccgtctctgcccgtaggggtcaggagatactgcttggaccagccgacggaatggtctccaaggggtggaggttgctggcgcccatcacggcgtacgcccagcagacgagaggcctcctagggtgtataatcaccagcctgactagccgggacaaaaaccaagtggagggtgaggtccagatcgtgtcaactgctacccaaaccttcctggcaacgtgcatcaatggggtatgctggactgtctaccacggggccggaacgaggaccatcgcatcacccaagggtcctgtcatccagatgtataccaatgtggaccaagaccttgtgggctggcccgctcctcaaggttcccgctcattgacaccctgcacctgcggctcctcggacctttacctggtcacgaggcacgccgacgtcattcccgtgcgccggcgaggtgatagcaggggtagcctgctttcgccccggcccatttcctacttgaaaggctcctcggggggtccgctgttgtgccccgcgggacacgccgtgggcctattcagggccgcggtgtgcacccgtggagtggccaaggcggtggactttatccctgtggagaacctagggacaaccatgagatccccggtgttcacggacaacccctctccaccagcagtgccccagagcttccaggtggcccacctgcatgctcccaccggcagcggtaagagcaccaaggtcccggctgcgtacgcagcccagggctacaaggtgttggtgctcaacccctctgttgctgcaacgctgggctttggtgcttacatgtccaaggcccatggggtcgatcctaatatcaggaccggggtgagaacaattaccactggcagccccatcacgtactccacctacggcaagttccttgccgacggcgggtgctcaggaggcgcttatgacataataatttgtgacgagtgccactccacggatgccacatccatcttgggcatcggcactgtccttgaccaagcagagactgcgggggcgagattggttgtgctcgccactgctacccctccgggctccgtcactgtgtcccatcctaacatcgaggaggttgctctgtccaccaccggagagatccctttttacggcaaggctatccccctcgaggtgatcaaggggggaagacatctcatcttctgtcactcaaagaagaagtgcgacgagctcgccgcgaagctggtcgcattgggcatcaatgccgtggcctactaccgcggacttgacgtgtctgtcatcccgaccagcggcgatgttgtcgtcgtgtcgaccgatgctctcatgactggctttaccggcgacttcgactctgtgatagactgcaacacgtgtgtcactcagacagtcgatttcagccttgaccctacctttaccattgagacaaccacgctcccccaggatgctgtctccaggactcagcgccggggcaggactggcagggggaagccaggcatctacagatttgtggcaccgggggagcgcccctccggcatgttcgactcgtccgtcctctgtgagtgctatgacgcgggctgtgcttggtatgagctcacgcccgccgagactacagttaggctacgagcgtacatgaacaccccggggcttcccgtgtgccaggaccatcttgaattttgggagggcgtctttacgggcctcacccatatagatgcccactttctatcccagacaaagcagagtggggagaactttccttacctggtagcgtaccaagccaccgtgtgcgctagggctcaagcccctcccccatcgtgggaccagatgtggaagtgtttgatccgccttaaacccaccctccatgggccaacacccctgctatacagactgggcgctgttcagaatgaagtcaccctgacgcacccaatcaccaaatacatcatgacatgcatgtcggccgacctggaggtcgtcacgagcacctgggtgctcgttggcggcgtcctggctgctctggccgcgtattgcctgtcaacaggctgcgtggtcatagtgggcaggattgtcttgtccgggaagccggcaattatacctgacagggaggttctctaccaggagttcgatgagatggaagagtgctctcagcacttaccgtacatcgagcaagggatgatgctcgctgagcagttcaagcagaaggccctcggcctcctgcagaccgcgtcccgccatgcagaggttatcacccctgctgtccagaccaactggcagaaactcgaggtcttctgggcgaagcacatgtggaatttcatcagtgggatacaatacttggcgggcctgtcaacgctgcctggtaaccccgccattgcttcattgatggcttttacagctgccgtcaccagcccactaaccactggccaaaccctcctcttcaacatattgggggggtgggtggctgcccagctcgccgcccccggtgccgctaccgcctttgtgggcgctggcttagctggcgccgccatcggcagcgttggactggggaaggtcctcgtggacattcttgcagggtatggcgcgggcgtggcgggagctcttgtagcattcaagatcatgagcggtgaggtcccctccacggaggacctggtcaatctgctgcccgccatcctctcgcctggagcccttgtagtcggtgtggtctgcgcagcaatactgcgccggcacgttggcccgggcgagggggcagtgcaatggatgaaccggctaatagccttcgcctcccgggggaaccatgtttcccccacgcactacgtgccggagagcgatgtagccgcccgcgtcactgccatactcagcagcctcactgtaacccagctcctgaggcgactgcatcagtggataagctcggagtgtaccactccatgctccggttcctggctaagggacatctgggactggatatgcgaggtgctgagcgactttaagacctggctgaaagccaagctcatgccacaactgcctgggattccctttgtgtcctgccagcgcgggtataggggggtctggcgaggagacggcattatgcacactcgctgccactgtggagctgagatcactggacatgtcaaaaacggggcgatgaggatcgtcggtcctaggacctgcaggaacatgtggagtgggacgttcctcattaacgcctacaccacgggcccctgtactccccttcctgcgccgaactataagttcgcgctgtggagggtgtctgcagaggaatacgtggagataaggcgggtgggggacttccactacatatcgggtatgactactgacaatcttaaatgcccgtgccagatcccatcgcccgaatttttcacagaattggacggggtgcgcctacataggtttgcgcccccttgtaagcccttgctgcgggaggaggtatcattcagagtaggactccacgagtacccggtggggtcgcaattaccttgcgagcccgaaccggacgtagccgtgttgacgtccatgctcactgatccctcccatataacagcagaggaggccgggagaaggttggcgagagggtcacccccttctatggccagctcctcggccagccagctgtccgctccatctctcaaggcaacttgcaccgccaatcatgactcccctgacgccgagctcatagaggctaacctcctgtggaggcaggagatgggcggcaacatcaccagggttgagtcagagaacaaagtggtgattctggactccttcgatccgcttgtggcagaggaggatgagcgggaggtctccgtacccgcagaaattctgcggaagtctcggagattcgccccggccctgcccgtttgggcgcggccggactacaaccccccgctagtagagacgtggaaaaagcctgactacgaaccacctgtggtccatggctgcccgctaccacctccacggtcccctcctgtgcctccgcctcggaaaaaacgtacggtggtcctcaccgaatcaaccctatctactgccttggccgagcttgccaccaaaagttttggcagcccctcaacttccggcattacgggcgacaatacgacaacatcctctgagcccgccccttctggctgcccccccgactccgacgttgagtcctattcttccatgccccccctggagggggagcctggggatccggatttcagcgacgggtcatggtcgacggtcagtagtggggccgacacggaagatgtcgtgtgctgctcaatgtcttatacctggacaggcgcactcgtcaccccgtgcgctgcggaagaacaaaaactgcccatcaacgcactgagcaactcgttgctacgccatcacaatctggtatattccaccacttcacgcagtgcttgccaaaggcagaagaaagtcacatttgacagactgcaagttctggacagccattaccaggacgtgctcaaggaggtcaaagcagcggcgtcaaaagtgaaggctaacttgctatccgtagaggaagcttgcagcctgacgcccccacattcagccaaatccaagtttggctatggggcaaaagacgtccgttgccatgccagaaaggccgtagcccacatcaactccgtgtggaaagaccttctggaagacagtgtaacaccaatagacactaccatcatggccaagaacgaagtcttctgcgttcagcctgagaaggggggtcgtaagccagctcgtctcatcgtgttccccgacctgggcgtgcgcgtgtgcgagaagatggccctgtacgacgtggttagcaaactccccctggccgtgatgggaagctcctacggattccaatactcaccaggacagcgggttgaattcctcgtgcaagcgtggaagtccaagaaaaccccgatggggttctcgtatgatacccgctgttttgactccacagtcactgagagcgacatccgtacggaggaggcaatttaccaatgttgtgacctggacccccaagcccgcgtggccatcaagtccctcactgagaggctttatgttgggggccctcttaccaattcaaggggggaaaactgcggctaccgcaggtgccgcgcgagcggcgtactgacaactagctgtggtaacaccctcacttgctacatcaaggcccgggcagcctgtcgagccgcagggctccaggactgcaccatgctcgtgtgtggcgacgacttagtcgttatctgtgaaagtgcgggggtccaggaggacgcggcgagcctgagagccttcacggaggctatgaccaggtactccgccccccccggggaccccccacaaccagaatacgacttggagcttataacatcatgctcctccaacgtgtcagtcgcccacgacggcgccggaaaaagggtctactaccttacccgtgaccctacaacccccctcgcgagagctgcgtgggagacagcaagacacactccagtcaattcctggctaggcaacataatcatgtttgcccccacactgtgggcgaggatgatactgatgacccatttctttagcgtcctcatagccagggatcagcttgaacaggctcttaactgtgagatctacggagcctgctactccatagaaccactggatctacctccaatcattcaaagactccatggcctcagcgcattttcactccacagttactctccaggtgaaatcaatagggtggccgcatgcctcagaaaacttggggtcccgcccttgcgagcttggagacaccgggcccggagcgtccgcgctaggcttctgtccaggggaggcagggctgccatatgtggcaagtacctcttcaactgggcagtaagaacaaagctcaaactcactccaatagcggccgctggccggctggacttgtccggttggttcacggctggctacagcgggggagacatttatcacagcgtgtctcatgcccggccccgctggttctggttttgcctactcctgctcgctgcaggggtaggcatctacctcctccccaaccgatgaaggttggggtaaacactccggcctcttaagccatttcctgttttttttttttttttttttttttttttctttttttttttctttcctttccttctttttttcctttctttttcccttctttaatggtggctccatcttagccctagtcacggctagctgtgaaaggtccgtgagccgcatgactgcagagagtgctgatactggcctctctgcagatcatgt

SEQ ID NO: 633 - DNA, 9599 bp, Hepatitis C Virus
gccagccccctgatgggggcgacactccaccatgaatcactcccctgtgaggaactattgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggataaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcacgtcggcccgagggcaggacctgggctcagcccgggtacccttggcccctctatggcaatgagggttgcgggtgggcgggatggctcctgtctccccgtggctctcggcctagctggggccccacagacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttctggaagacggcgtgaactatgcaacagggaaccttcctggttgctctttctctatcttccttctggccctgctctcttgcctgactgtgcccgcttcagcctaccaagtgcgcaattcctcggggctttaccatgtcaccaatgattgccctaactcgagtattgtgtacgaggcggccgatgccatcctgcacactccggggtgtgtcccttgcgttcgcgagggtaacgcctcgaggtgttgggtggcggtgacccccacggtggccaccagggacggcaaactccccacaacgcagcttcgacgtcatatcgatctgcttgtcgggagcgccaccctctgctcggccctctacgtgggggacctgtgcgggtctgtctttcttgttggtcaactgtttaccttctctcccaggcgccactggacgacgcaagactgcaattgttctatctatcccggccatataacgggtcatcgcatggcatgggatatgatgatgaactggtcccctacggcagcgttggtggtagctcagctgctccggatcccacaagccatcatggacatgatcgctggtgctcactggggagtcctggcgggcatagcgtatttctccatggtggggaactgggcgaaggtcctggtagtgctgctgctatttgccggcgtcgacgcggaaacccacgtcaccgggggaaatgccggccgcaccacggctgggcttgttggtctccttacaccaggcgccaagcagaacatccaactgatcaacaccaacggcagttggcacatcaatagcacggccttgaactgcaatgaaagccttaacaccggctggttagcagggctcttctatcagcacaaattcaactcttcaggctgtcctgagaggttgaccagctgccgacgccttaccgattttgcccagggctggggtcctatcagttatgccaacggaagcggcctcgacgaacgcccctactgctggcactaccctccaagaccttgtggcattgtgcccgcaaagagcgtgtgtggcccggtatattgcttcactcccagccccgtggtggtgggaacgaccgacaggtcgggcgcgcctacctacagctggggtgcaaatgatacggacgtcttcgtccttaacaacaccaggccaccgctgggcaattggttcggttgtacctggatgaactcaactggattcaccaaagtgtgcggagcgcccccttgtgtcatcggaggggtgggcaacaacaccttgctctgccccactgattgcttccgcaaacatccggaagccacatactctcggtgcggctccggtccctggattacacccaggtgcatggtcgactacccgtataggctttggcactatccttgtaccatcaattacaccatattcaaagtcaggatgtacgtgggaggggtcgagcacaggctggaagcggcctgcaactggacgcggggcgaacgctgtgatctggaagacagggacaggtccgagctcagcccgttgctgctgtccaccacacagtggcaggtccttccgtgttctttcacgaccctgccagccttgtccaccggcctcatccacctccaccagaacattgtggacgtgcagtacttgtacggggtagggtcaagcatcgcgtcctgggccattaagtgggagtacgtcgttctcctgttccttctgcttgcagacgcgcgcgtctgctcctgcttgtggatgatgttactcatatcccaagcggaggcggctttggagaacctcgtaatactcaatgcagcatccctggccgggacgcacggtcttgtgtccttcctcgtgttcttctgctttgcgtggtatctgaagggtaggtgggtgcccggagcggcctacgccttctacgggatgtggcctctcctcctgctcctgctggcgttgcctcagcgggcatacgcactggacacggaggtggccgcgtcgtgtggcggcgttgttcttgtcgggttaatggcgctgactctgtcgccatattacaagcgctatatcagctggtgcatgtggtggcttcagtattttctgaccagagtagaagcgcaactgcacgtgtgggttccccccctcaacgtccggggggggcgcgatgccgtcatcttactcatgtgtgtagtacacccgaccctggtatttgacatcaccaaactactcctggccatcttcggacccctttggattcttcaagccagtttgcttaaagtcccctacttcgtgcgcgttcaaggccttctccggatctgcgcgctagcgcggaagatagccggaggtcattacgtgcaaatggccatcatcaagttaggggcgcttactggcacctatgtgtataaccatctcacccctcttcgagactgggcgcacaacggcctgcgagatctggccgtggctgtggaaccagtcgttttctcccgaatggagaccaagctcatcacgtggggggcagataccgccgcgtgcggtgacatcatcaacggcttgcccgtctctgcccgtaggggccaggagatactgcttgggccagccgacggaatggtctccaaggggtggaggttgcaggcgcccatcacggcgtacacccagcagacgagaggcctcctagggtgtataatcaccagcctgactggccgggacaaaaaccaagtggagggtgaggtccagatcgtgtcaactgctacccaaaccttcctggcaacgtgcatcaatggggtatgctggactgtctaccacggggccggaacgaggaccatcgcatcacccaagggtcctgtcatccagatgtataccaatgtggaccaagaccttgtgggctggcccgctcctcaaggttcccgctcattggcaccctgcacctgcggctcctcggacctttacctggtcacgaggcacgccgatgtcattcccgtgcgccggcgaggtgatagcaggggtagcctgctttcgccccggcccatttcctacttgaaaggctcctcggggggtccgctgttgtgccccgcgggacacgccgtgggcctattcagggccgcggtgtgcacccgtggagtggctaaggcggtggactttatccctgtggagaacctagggacaaccatgagatccccggtgttcacggacaactcctctccaccagcagtgccccagagcttccaggtggcccacctgcatgctcccaccggcagcggtaagagcaccaaggtcccggctgcgtacgcagcccagggctacaaggtgttggtgctcaacccctctgttgctgcaacgctgggctttggtgcttacatgtccaaggcccatggggttgatcctaatatcaggaccggggtgagaacaattaccactggcagccccatcacgtactccacctacggcaagttccttgccgacggcgggtgctcaggaggtgcttatgacataataatttgtgacgagtgccactccacggatgccacatccatcttgggcatcggcactgtccttgaccaagcagagactgcgggggcgagactggttgtgctcgccactgctacccctccgggctccgtcactgtgtcccatcctaacatcgaggaggttgctctgtccaccaccggagagatccccttttacggcaaggctatccccctcgaggtgatcaaggggggaagacatctcatcttctgccattcaaagaagaagtgcgacgagctcgccgcgaagctggtcgcattgggcatcaatgccgtggcctactaccgcggtcttgacgtgtctgtcatcccgaccagcggcgatgttgtcgtcgtgtcgaccgatgctctcatgactggctttaccggcgacttcgactctgtgatagactgcaacacgtgtgtcactcagacagtcgatttcagccttgaccctacctttaccattgagacaaccacgctcccccaggatgctgtctccaggactcaacgccggggcaggaccggcagggggaagccaggcatctatagatttgtggcaccgggggagcgcccctccggcatgttcgactcgtccgtcctctgtgagtgctatgacgcgggctgtgcttggtatgagctcacgcccgccgagactacagttaggctacgagcgtacatgaacaccccggggcttcccgtgtgccaggaccatcttgaattttgggagggcgtctttacgggcctcactcatatagatgcccactttctatcccagacaaagcagagtggggagaactttccttacctggtagcgtaccaagccaccgtgtgcgctagggctcaagcccctcccccatcgtgggaccagatgtggaagtgtttgatccgccttaaacccaccctccatgggccaacacccctgctatacagactgggcgctgttcagaatgaagtcaccctgacgcacccaatcaccaaatacatcatgacatgcatgtcggccgacctggaggtcgtcacgagcacctgggtgctcgttggcggcgtcctggctgctctggccgcgtattgcctgtcaacaggctgcgtggtcatagtgggcaggatcgtcttgtccgggaagccggcaattatacctgacagggaggttctctaccaggagttcgatgagatggaagagtgctctcagcacttaccgtacatcgagcaagggatgatgctcgctgagcagttcaagcagaaggccctcggcctcctgcagaccgcgtcccgccatgcagaggttatcacccctgctgtccagaccaactggcagaaactcgaggtcttttgggcgaagcacatgtggaatttcatcagtgggatacaatacttggcgggcctgtcaacgctgcctggtaaccccgccattgcttcattgatggcttttacagctgccgtcaccagcccactaaccactggccaaaccctcctcttcaacatattgggggggtgggtggctgcccagctcgccgcccccggtgccgctactgcctttgtgggcgctggcctagctggcgccgccatcggcagcgttggactggggaaggtcctcgtggacattcttgcagggtatggcgcgggcgtggcgggagctcttgtagcattcaagatcatgagcggtgaggtcccctccacggaggacctggtcaatctgctgcccgccatcctctcgcctggagcccttgtagtcggtgtggtctgcgcagcaatactgcgccggcacgttggcccgggcgagggggcagtgcaatggatgaaccggctaatagccttcgcctcccgggggaaccatgtttcccccacgcactacgtgccggagagcgatgcagccgcccgcgtcactgccatactcagcagcctcactgtaacccagctcctgaggcgactgcatcagtggataagctcggagtgtaccactccatgctccggttcctggctaagggacatctgggactggatatgcgaggtgctgagcgactttaagacctggctgaaagccaagctcatgccacaactgcctgggattccctttgtgtcctgccagcgcgggtataggggggtctggcgaggagacggcattatgcacactcgctgccactgtggagctgagatcactggacatgtcaaaaacgggacgatgaggatcgtcggtcctaggacttgcaggaacatgtggagtgggacgttccccattaacgcctacaccacgggcccctgtactccccttcctgcgccgaactataagttcgcgctgtggagggtgtctgcagaggaatacgtggagataaggcgggtgggggacttccactacgtatcgggtatgactactgacaatcttaaatgcccgtgccagatcccatcgcccgaatttttcacagaattggacggggtgcgcctacacaggtttgcgcccccttgcaagcccttgctgcgggaggaggtatcattcagagtaggactccacgagtacccggtggggtcgcaattaccttgcgagcccgaaccggacgtagccgtgttgacgtccatgctcactgatccctcccatataacagcagaggcggccgggagaaggttggcgagagggtcacccccttctatggccagctcctcggctagccagctgtccgctccatctctcaaggcaacttgcaccgccaaccatgactcccctgacgccgagctcatagaggctaacctcctgtggaggcaggagatgggcggcaacatcaccagggttgagtcagagaacaaagtggtgattctggactccttcgatccgcttgtggcagaggaggatgagcgggaggtctccgtacctgcagaaattctgcggaagtctcggagattcgcccgggccctgcccgtctgggcgcggccggactacaaccccccgctagtagagacgtggaaaaagcctgactacgaaccacctgtggtccatggctgcccgctaccacctccacggtcccctcctgtgcctccgcctcggaaaaagcgtacggtggtcctcaccgaatcaaccctatctactgccttggccgagcttgccaccaaaagttttggcagctcctcaacttccggcattacgggcgacaatacgacaacatcctctgagcccgccccttctggctgcccccccgactccgacgttgagtcctattcttccatgccccccctggagggggagcctggggatccggatctcagcgacgggtcatggtcgacggtcagtagtggggccgacacggaagatgtcgtgtgctgctcaatgtcttattcctggacaggcgcactcgtcaccccgtgcgctgcggaagaacaaaaactgcccatcaacgcactgagcaactcgttgctacgccatcacaatctggtgtattccaccacttcacgcagtgcttgccaaaggcagaagaaagtcacatttgacagactgcaagttctggacagccattaccaggacgtgctcaaggaggtcaaagcagcggcgtcaaaagtgaaggctaacttgctatccgtagaggaagcttgcagcctgacgcccccacattcagccaaatccaagtttggctatggggcaaaagacgtccgttgccatgccagaaaggccgtagcccacatcaactccgtgtggaaagaccttctggaagacagtgtaacaccaatagacactaccatcatggccaagaacgaggttttctgcgttcagcctgagaaggggggtcgtaagccagctcgtctcatcgtgttccccgacctgggcgtgcgcgtgtgcgagaagatggccctgtacgacgtggttagcaagctccccctggccgtgatgggaagctcctacggattccaatactcaccaggacagcgggttgaattcctcgtgcaagcgtggaagtccaagaagaccccgatggggttctcgtatgatacccgctgttttgactccacagtcactgagagcgacatccgtacggaggaggcaatttaccaatgttgtgacctggacccccaagcccgcgtggccatcaagtccctcactgagaggctttatgttgggggccctcttaccaattcaaggggggaaaactgcggctaccgcaggtgccgcgcgagcggcgtactgacaactagctgtggtaacaccctcacttgctacatcaaggcccgggcagcctgtcgagccgcagggctccaggactgcaccatgctcgtgtgtggcgacgacttagtcgttatctgtgaaagtgcgggggtccaggaggacgcggcgaacctgagagccttcacggaggctatgaccaggtactccgccccccccggggaccccccacaaccagaatacgacttggagcttataacatcatgctcctccaacgtgtcagtcgcccacgacggcgctggaaagagggtctactaccttacccgtgaccctacaacccccctcgcgagagccgcgtgggagacagcaagacacactccagtcaattcctggctaggcaacataatcatgtttgcccccacactgtgggcgaggatgatactgatgacccatttctttagcgtcctcatagccagggatcagcttgaacaggctcttaactgtgagatctacggagcctgctactccatagaaccactggatctacctccaatcattcaaagactccatggcctcagcgcattttcactccacagttactctccaggtgaaatcaatagggtggccgcatgcctcagaaaacttggggtcccgcccttgcgagcttggagacaccgggcccggagcgtccgcgctaggcttctgtccagaggaggcagggctgccatatgtggcaagtacctcttcaactgggcagtaagaacaaagctcaaactcaccccaataacggccgctggccggctggacttgtccggttggttcacggctggctacagcgggggagacatttatcacagcgtgtctcatgcccggccccgctggttctggttttgcctactcctgctcgctgcaggggtaggcatctacctcctccccaaccgatgaaggttggggtaaacactccggcctcttaagccatttcctgttttttttttttttttttttttttttttctttttttttttctttcctttccttctttttttcctttctttttcccttctttaatggtggctccatcttagccctagtcacggctagctgtgaaaggtccgtgagccgcatgactgcagagagtgctgatactggcctctctgcagatcatgt

SEQ ID NO: 634 - DNA, 9425 bp, Hepatitis C Virus
acctgcctcttacgaggcgacactccaccatggatcactcccctgtgaggaacttctgtcttcacgcggaaagcgcctagccatggcgttagtacgagtgtcgtgcagcctccaggcccccccctcccgggagagccatagtggtctgcggaaccggtgagtacaccggaatcgctggggtgaccgggtcctttcttggaacaacccgctcaatacccagaaatttgggcgtgcccccgcgagatcactagccgagtagtgttgggtcgcgaaaggccttgtggtactgcctgatagggtgcttgcgagtgccccgggaggtctcgtagaccgtgcaacatgagcacacttcctaaaccacaaagaaaaaccaaaagaaacaccatccgtcgcccacaggacgttaagttcccgggtggcggacagatcgttggtggagtatacgtgttgccgcgcaggggcccacgattgggtgtgtgcgcgacgcgtaaaacttctgaacggtcacagccccgcagacgacgacagcctatccccaaggcgcgtcagagcggaggccggtcctgggctcagcccgggtacccttggcccctctatggtaatgagggctgcgggtgggcagggtggctcctgtccccgcgcggctcccgtccatcttggggcccaaatgacccccggcggaggtcccgcaatttgggtaaagtcatcgatacccttacgtgtggattcgccgacctcatggggtacatcccgctcgtcggcgcccccgtgggaggcgtcgcaagagccctcgcgcatggcgtgagggcccttgaagacgggataaatttcgcgacagggaacttgcccggttgctccttttctatcttccttcttgctctgttctcttgcttaattcatccagcagccagtctagagtggcggaatacgtctggcctctacgtcctcaccaacgactgttccaatagcagtattgtgtatgaggccgatgacgtcattctgcacacacccggctgcgtaccttgtgttcagaacgacaatatatccacgtgctggaccccagtgacacctacagtggcagtcaggtacgtcggagcaaccaccgcttcgatacgtagtcatgtggacctattagtgggcgcggccacgatgtgctctgcgctctacgtgggtgatatgtgtggggccgtctttcttgtgggacaagccttcacgttcagacctcgtcgccaccaaacagtccagacctgtaactgctcactgtacccaggccatctttcaggacatcgaatggcttgggatatgatgatgaattggttccccgctctgggtatggcggtggcgcacgtcctgcgggtgccccagaccttgttcgacataatagccggggcccattggggcatcttggcgggcctagcctattactccatgcagggcaattgggccaaagttgctatcatcatggttatgttttcaggggtcgatgccgtaacatataccaccggtggctctgcagctcatgccaccagagggcttactagcctttttagtgtgggcgcccaacagaaactgcagctggttaacaccaatggctcgtggcacatcaacagcactgccctgaactgtaatgagtccataaacaccgggttcatagctgggttgttttattatcataggttcaactccactggatgccctcaaaggctcagcagctgcaagcccatcactttcttcaagcaggggtggggtcccttgacagatgctaacatctccggtccttctgatgacaaaccgtactgctggcactacgcacctagaccttgtaaagttgtcccggcatcaggtgtctgcggtcctgtatactgcttcacaccatcgccagtggtcgtaggcactactgatgccaagggcgtgccaacctacacctggggtgcgaatgataccgatgtgttcctgctggagtccctgcggcctcccggtggtcggtggtttgggtgcacgtggatgaactccacggggtttgtcaagacgtgcggggcttccccttgtgacatctatgggggtggggggaattccggaaatgagtcagacctcttctgccccaccgactgcttcaggaaacatcctgaggccacatacagccggtgtggtgcggggccctggttgacaccccgctgcatggtcgactatccataccggctttggcattacccatgtacagtcaatttcacattgttcaaggtgaggatgttcgtgggtgggttcgagcaccggtttaccgccgcttgcaactggaccaggggggagcgctgcgatatcgaagatcgtgaccgcagcgagcaacatccactgttgcattcaacaaccgagcttgccatactgccttgctctttcacgcccatgcctgcactgtcaacaggtctaatacacctccaccaaaacatcgtggatgtccaatacctttatggcgttggatctggcatggtgggatgggcgctgaaatgggagttcgtcatcctcattttcctcctcctagcggaccgacgcgtgtgcgttgccctttggctgatgctgatgataacacaagcagaagcagccttggagaaccttgtcacgctgaacgccgtcgccgctgctgggacacacggtatcggctggtacctggtggccttttgtgcggcgtggtacgtgcggggcaaacttgtcccggtggtgacctacagcctgacgggcctctggcccctagctttgctcgtcctcatgctcccccaacgggcgtatgcgtggtcgggtgaagacagcgctactctcggcgctggggtcttggccctcttcggcttctttaccttatcaccctggtacaagcattggatcggccgccttatatggtggaaccagtacaccatatgtagatgcgagtccgccctccaagtgtgggtcccccccttacttgcacgcgggagtagggacggtgtcatcctgctaacaagcctgctttatccatcattaatttttgacatcactaagctactgatagcagtactgggcccactatatttaatacaggccgccgtcactaccaccccctactttgtgcgcgcgcaagtactggttcgcctttgcatgctcgtgcgctccgtgatgggggggaaatacttccagatgatcatactgagcattggcagatggttcaacacctacctatatgaccacctagcgcctatgcaacattgggccgcagctggccttaaagacctagcagtggccactgaacccgtaatatttagtcccatggaaatcaaggtcatcacctggggcgcggatacagcagcttgcggagatattctttgcgggctgcctgtctctgcgcgattaggccgtgaggtgttgttgggacctgctgatgactatcgggagatgggttggcgactgttggccccgatcacagcatacgcccagcaaactaggggccttcttgggactattgtgaccagcttgactggcagggataagaacgtggtgaccggtgaagtgcaggtgctttctacggctacccagaccttcctaggtacaacagtggggggggttacgtggactgtttaccatggtgcaggttcgagaacgctcgcgggcgccaaacatcccgcgctccaaatgtacacaaatgtagatcaggacctcgttgggtggccagcccccccaggggctaagtctcttgaaccgtgcgcctgcggctctgcagacttatacttggttacccgcgatgccgatgtcatccctgctcggcgcaggggggactccacagcgagcttgctcagtcctagacctctcgcctgtctcaaaggttcctctggaggtcctgttatgtgcccttcggggcatgttgcagggatctttagggctgctgtgtgcaccagaggtgtagcaaaagccctacagttcataccagtggaaaccctcagcacacagactaggtccccatctttctctgacaattcaactcctcctgctgttccacagagctatcaggtaggataccttcatgccccgaccggcagcggtaaaagcacaaaggtcccggccgcttacgtggcacaaggatatactgttctcgtgctgaatccatcggtggcggccacactaggctttggctctttcatgtcgcgtgcctatgggatcgaccccaacatccgcactgggaaccgcaccgttacaactggtgccaaactgacctattccacctacggtaagtttctcgcggacgggggttgctccgggggggcatacgatgtgattatctgtgatgaatgtcatgcccaagacgctactagcatactgggtatcggcacggtcttagatcaagctgagacggctggggtgaggctgacggttttagcgacacgaactcccccaggcagcatcactgtgccacattctaacatcgaagaagtggccttgggctctgaaggtgagatccccttctacggtaaggctataccgatagccctgctcaagggggggaggcaccttatcttttgccattccaagaaaaaatgtgatgagatagcgtccaaactcagaggtatggggctcaacgctgtagcgtactataggggtctcgatgtgtccgtcataccaacaacaggagacgtcgtagtttgcgctactgacgccctcatgactggatacacaggagacttcgattctgtcatagattgcaacgtggctgttgaacagtacgtcgacttcagcctggaccccaccttttccatcgagacccgcactgctccccaagatgcggtttcccgcagccaacgtcgtggccgtacgggccgaggtagactcggtacataccgatatgtcgcccccggtgaaagaccgtctggaatgtttgactcggttgttctctgtgagtgctatgacgcgggctgctcgtggtacgatctccagcccgctgagaccacagtcagactgagagcttacttatccacaccggggctacctgtctgccaagaccatttagacttttgggagagcgtcttcactggactaactcacatagatgcccactttctgtcacagactaagcagcagggacttaacttctcgtacctgactgcctaccaagccactgtgtgcgctcgcgcgcaggctcctcccccaagttgggacgagacgtggaagtgtctcgtgcggcttaagccaacactacatggacctacgccccttttatatcggttggggcctgtccaaaatgaaatctgcttgtcacaccccatcacaaaatacgtcatggcatgcatgtcagctgatctggaagtaaccaccagcacctgggtgttgcttggaggggtccttgcggccctagcggcctactgcttgtcagtcggctgcgttgtgattgtgggtcatattgagctggggggcaagccggcactcgttccagacaaagaggtgttgtatcaacaatacgatgagatggaggagtgctcacaagccgccccgtacatcgagcaagctcaggcaatagcccaccagttcaaggaaaaagtccttggattgctgcagcgagccacccagcaacaagctgtcattgagcccatagtagctaccaactggcaaaagcttgaggccttctggcacaagcatatgtggaattttgtgagtgggatccagtacctagcaggcctctccactctgcccggcaaccctgctgtggcgtctcttatggcgttcaccgcttcagtcaccagtcccctgacgaccaaccaaactatgtttttcaacatactcggggggtgggttgccacccatttggcagggccccagagctcttccgcgtttgtggtaagtggcttggccggcgctgccatagggggtataggcctgggcagagtcttgcttgacatcctggcaggatatggagctggtgtctcaggcgccttggtggcttttaagatcatgggaggagaactccccaccgctgaggacatggtcaacctgttgcccgccatactatctccgggtgctctcgtcgtcggtgtgatatgcgctgccatactacgccgacacgtaggacctggggagggggcggtacagtggatgaacaggctcatcgcattcgcatcccggggcaaccacgtttcaccaacgcactatgttcccgagagcgatgctgcagcgagggtcaccgcattgctgagttctctaactgtcacaagcctgctccggcggttacaccagtggatcaatgaagactacccaagcccttgtagtgacgactggctgcgtatcatctgggactgggtttgttcggtgctgtccgacttcaagtcatggctctctgctaagattatgccagcgctccccgggctgcccttcatttcctgtcaaaagggatacaagggcgtgtggcggggggacggcgtgatgtcgacacgctgtccttgcggggcaacaataaccggtcatgtgaagaatgggtccatgcggcttgcagggccgcgtacatgtgctaacatgtggcacggtactttccccatcaatgagtacaccaccggacccagtacaccttgtccatcacccaactacactcgcgcgctatggcgcgtggctgccaacagctacgttgaagtgcgccgagtgggggacttccattatattacgggggccacagaagatgagctcaagtgtccgtgccaagtaccggctgctgagttcttcactgaagtggatggggtgagactccaccgttacgcccctccatgtaagcccctgttaagagaggagatcactttctcggtagggttgaattcctacacgataggatctcaactcccctgtgagccagaaccagatgtttctgtgctgacctcgatgttgagagacccttctcatatcaccgccgagacggcagcgcgccgccttgcgcgtgggtcccctccatcagaggcaagctcgtccgccagccaactatcagctccgtcgttgaaggccacttgccagacgcataggcctcatccagacgctgagctggtgaacgccaacttgttgtggcggcaagagatgggcagcaacatcacacgggtggagtctgaaacaaaggttgtgattcttgattcattcgaacctctgagggccgaaactgatgacgccgagctctcggtggctgcagagtgtttcaagaaacctcccaagtatcctccagcccttcctatctgggctaggccagactacaatcctccactgttggaccgctggaaagctccggattatgtaccaccaactgtccatggatgtgccttaccaccacggggcgctccgccggtccctcctcctcggaggaaaagaacaattcagctggacggttccaatgtgtccgcggcgttacgtgcgctagcggaaaaatcatttccgtccttgaaaccgcaggaagagaataactcttcctctggggtcgacacacagtccagcactacttccaaggtgcccccctccccgggaggggagtccgactcagagtcatgctcatccatgcctcctctcgagggagaaccgggcgatccggacttgagttgcgactcttggtccaccgttagtgacagcgaggagcagagcgtggtctgctgctctatgtcgtactcttggaccggcgccctgataacaccgtgtagtgctgaggaggagaaactgcccatcagcccactcagcaactccttgctgagacatcataacctagtctattcaacgtcgtctagaagcgcttctcagcgtcagaggaaggttaccttcgacagactgcaggtgctcgacgaccattacaagactgtattaaaggaggtaaaggagcgagcgtctagggtaaaggctcgcatgctcaccatcgaggaagcgtgcgcgctcgtccctcctcactctgcccggtcgaaattcgggtatagtgcgaaggacgttcgctccttgtctagcagggccattaaccagatccgctccgtctgggaggacttgctagaagacaccacaactccaattccaaccaccatcatggcgaagaacgaggtgttttgtgtggaccccgctaaagggggccgcaagcccgctcgccttatcgtgtaccctgacctgggggttcgtgtctgcgagaaacgcgccctatatgacgtgatacagaagttggcaattgagacgattggttctgcttacggattccaatactcgcctcaacagcgggtcgaacgtctgctcaagatgtggacctcaaagaaaacccccttggggttctcgtatgacacccgctgctttgactcaactgtcactgaacaggacatcagggtggaagaggagatataccaatgctgcaaccttgaaccggaggccaggaaagtgatctcctccctcacggagcggctttactgcgggggccctatgttcaacagcaagggggctcagtgtggtgaccgtcgttgccgtgccagtggagttttgcctaccagctttggcaatacaatcacttgttacatcaaagccacagcggctgcgaacggcgcaggcctccgggacccggactttcttgtctgcggagatgatctggtcgtggtggccgagagtgacggcgtcgatgaggatggggcagccctgagagccttcacggaggctatgaccaggtattctgctccacccggagatgctccacagcccacctacgaccttgagctcatcacatcttgctcctccaacgtctccgtggcacgggacgacaaggggaggaggtactattacctcacccgtgatgccaccactcccctagcccgtgcggcttgggaaacagctcgtcacactccagttaactcctggttaggtaacatcatcatgtacgcgcctaccatctgggtgcgcatggtaatgatgacacactttttctccatactccaatcccaggagatacttgatcgaccccttgacttcgaaatgtacggggccacttactcggtcacgccgctggatttaccagcaatcattgaaagactccatggtctaagcgcgttcacgctccacagttactctccagtagagctcaatagggtcgcggggacactcaggaagctggggtgcccccccctacgagcttggagacatcgggcacgagcagggcgcgctaagcttatcgcccagggagggaaggccaaaatatgcggcctttatctctttaattgggcggtacgcaccaagaccaaactcactccgctgccacgcgctggccagttggatttatccatctggtttacggttggcgtcggcgggaacgacatttatcacagcgtgtcgcgtgcccgaacccgctatttgctgctttgcctactcctactaacggtaggggtaggcatctttctcctgccagctcggtgagctggtaagataacactcca

SEQ ID NO: 635 - DNA, 9595 bp, Hepatitis C Virus
gccagccccctgatgggggcgacactccaccatgaatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaaggcttccgagcggtcgcaacctcgtggaaggcgacaacctatcccaaaggctcgccgacccgagggcagggcctgggctcagcccgggtacccttggcccctctatggcaatgagggcctggggtgggcaggatggctcctgtcaccccgcggctcccggcctagttggggccccacggacccccggcgtaggtcgcgtaacttgggtaaggtcatcgatacccttacatgcggcttcgccgatctcatggggtacattccgctcgtcggcgcccccctagggggcgctgccagggccttggcacacggtgtccgggttctggaggacggcgtgaactatgcaacagggaacttgcccggttgctctttctctatcttcctcttggctctgctgtcctgtttgaccatcccagcttccgcttatgaagtgcgcaacgtgtccgggatataccatgtcacgaacgactgctccaactcaagcattgtgtatgaggcagcggacgtgatcatgcatactcccgggtgcgtgccctgtgttcaggagggtaacagctcccgttgctgggtagcgctcactcccacgctcgcggccaggaatgccagcgtccccactacgacaatacgacgccacgtcgacttgctcgttgggacggctgctttctgctccgctatgtacgtgggggatctctgcggatctattttcctcgtctcccagctgttcaccttctcgcctcgccggcatgagacagtgcaggactgcaactgctcaatctatcccggccatgtatcaggtcaccgcatggcttgggatatgatgatgaactggtcacctacaacagccctagtggtgtcgcagttgctccggatcccacaagctgtcgtggacatggtggcgggggcccactggggagtcctggcgggccttgcctactattccatggtagggaactgggctaaggttctgattgtggcgctactctttgccggcgttgacggggagacccacacgacggggagggtggccggccacaccacctccgggttcacgtcccttttctcatctggggcgtctcagaaaatccagcttgtgaataccaacggcagctggcacatcaacaggactgccctaaattgcaatgactccctccaaactgggttctttgccgcgctgttttacgcacacaagttcaactcgtccgggtgcccggagcgcatggccagctgccgccccattgactggttcgcccaggggtggggccccatcacctatactaagcctaacagctcggatcagaggccttattgctggcattacgcgcctcgaccgtgtggtgtcgtacccgcgtcgcaggtgtgtggtccagtgtattgtttcaccccaagccctgttgtggtggggaccaccgatcgttccggtgtccctacgtatagctggggggagaatgagacagacgtgatgctcctcaacaacacgcgtccgccacaaggcaactggttcggctgtacatggatgaatagtactgggttcactaagacgtgcggaggtcccccgtgtaacatcgggggggtcggtaaccgcaccttgatctgccccacggactgcttccggaagcaccccgaggctacttacacaaaatgtggctcggggccctggttgacacctaggtgcctagtagactacccatacaggctttggcactacccctgcactctcaatttttccatctttaaggttaggatgtatgtggggggcgtggagcacaggctcaatgccgcatgcaattggactcgaggagagcgctgtaacttggaggacagggataggtcagaactcagcccgctgctgctgtctacaacagagtggcagatactgccctgtgctttcaccaccctaccggctttatccactggtttgatccatctccatcagaacatcgtggacgtgcaatacctgtacggtgtagggtcagcgtttgtctcctttgcaatcaaatgggagtacatcctgttgcttttccttctcctggcagacgcgcgcgtgtgtgcctgcttgtggatgatgctgctgatagcccaggctgaggccgccttagagaacttggtggtcctcaatgcggcgtccgtggccggagcgcatggtattctctcctttcttgtgttcttctgcgccgcctggtacattaagggcaggctggctcctggggcggcgtatgctttttatggcgtatggccgctgctcctgctcctactggcgttaccaccacgagcttacgccttggaccgggagatggctgcatcgtgcgggggtgcggttcttgtaggtctggtattcttgaccttgtcaccatactacaaagtgtttctcactaggctcatatggtggttacaatactttatcaccagagccgaggcgcacatgcaagtgtgggtcccccccctcaacgttcggggaggccgcgatgccatcatcctcctcacgtgtgcggttcatccagagttaatttttgacatcaccaaactcctgctcgccatactcggcccgctcatggtgctccaggctggcataacgagagtgccgtacttcgtgcgcgctcaagggctcattcgtgcatgcatgttagtgcgaaaagtcgccgggggtcattatgtccaaatggtcttcatgaagctgggcgcgctgacaggtacgtacgtttataaccatcttaccccactgcgggactgggcccacgcgggcctacgagaccttgcggtggcggtagagcccgtcgtcttctccgccatggagaccaaggtcatcacctggggagcagacaccgctgcgtgtggggacatcatcttgggtctacccgtctccgcccgaagggggaaggagatatttttgggaccggctgatagtctcgaagggcaagggtggcgactccttgcgcccatcacggcctactcccaacaaacgcggggcgtacttggttgcatcatcactagcctcacaggccgggacaagaaccaggtcgaaggggaggttcaagtggtttctaccgcaacacaatctttcctggcgacctgcatcaacggcgtgtgctggactgtctaccatggcgctggctcgaagaccctagccggtccaaaaggtccaatcacccaaatgtacaccaatgtagacctggacctcgtcggctggcaggcgccccccggggcgcgctccatgacaccatgcagctgtggcagctcggacctttacttggtcacgagacatgctgatgtcattccggtgcgccggcgaggcgacagcaggggaagtctactctcccccaggcccgtctcctacctgaaaggctcctcgggtggtccattgctttgcccttcggggcacgtcgtgggcgtcttccgggctgctgtgtgcacccggggggtcgcgaaggcggtggacttcatacccgttgagtctatggaaactaccatgcggtctccggtcttcacagacaactcaacccccccggctgtaccgcagacattccaagtggcacatctgcacgctcctactggcagcggcaagagcaccaaagtgccggctgcgtatgcagcccaagggtacaaggtgctcgtcctgaacccgtccgttgccgccaccttagggtttggggcgtatatgtccaaggcacacggtatcgaccctaacatcagaactggggtaaggaccattaccacgggcggctccattacgtactccacctatggcaagttccttgccgacggtggctgttctgggggcgcctatgacatcataatatgtgatgagtgccactcaactgactcgactaccatcttgggcatcggcacagtcctggaccaagcggagacggctggagcgcggctcgtcgtgctcgccaccgctacacctccgggatcggttaccgtgccacaccccaatatcgaggaaataggcctgtccaacaatggagagatccccttctatggcaaagccatccccattgaggccatcaagggggggaggcatctcattttctgccattccaagaagaaatgtgacgagctcgccgcaaagctgacaggcctcggactgaacgctgtagcatattaccggggccttgatgtgtccgtcataccgcctatcggagacgtcgttgtcgtggcaacagacgctctaatgacgggtttcaccggcgattttgactcagtgatcgactgcaatacatgtgtcacccagacagtcgacttcagcttggatcccaccttcaccattgagacgacgaccgtgccccaagacgcggtgtcgcgctcgcaacggcgaggtagaactggcaggggtaggagtggcatctacaggtttgtgactccaggagaacggccctcgggcatgttcgattcttcggtcctgtgtgagtgctatgacgcgggctgtgcttggtatgagctcacgcccgctgagacctcggttaggttgcgggcttacctaaatacaccagggttgcccgtctgccaggaccatctggagttctgggagagcgtcttcacaggcctcacccacatagatgcccacttcctgtcccagactaaacaggcaggagacaactttccttacctggtggcatatcaagctacagtgtgcgccagggctcaagctccacctccatcgtgggaccaaatgtggaagtgtctcatacggctgaaacctacactgcacgggccaacacccctgctgtataggctaggagccgtccaaaatgaggtcatcctcacacaccccataactaaatacatcatggcatgcatgtcggctgacctggaggtcgtcactagcacctgggtgctggtaggcggagtccttgcagctttggccgcatactgcctgacgacaggcagtgtggtcattgtgggcaggatcatcttgtccgggaagccagctgtcgttcccgacagggaagtcctctaccaggagttcgatgagatggaagagtgtgcctcacaacttccttacatcgagcagggaatgcagctcgccgagcaattcaagcaaaaggcgctcgggttgttgcaaacggccaccaagcaagcggaggctgctgctcccgtggtggagtccaagtggcgagcccttgagaccttctgggcgaagcacatgtggaatttcatcagcggaatacagtacctagcaggcttatccactctgcctggaaaccccgcgatagcatcattgatggcatttacagcttctatcactagcccgctcaccacccaaaacaccctcctgtttaacatcttggggggatgggtggctgcccaactcgctcctcccagcgctgcgtcagctttcgtgggcgccggcatcgccggagcggctgttggcagcataggccttgggaaggtgctcgtggacatcttggcgggctatggggcaggggtagccggcgcactcgtggcctttaaggtcatgagcggcgaggtgccctccaccgaggacctggtcaacttactccctgccatcctctctcctggtgccctggtcgtcggggtcgtgtgcgcagcaatactgcgtcggcacgtgggcccgggagagggggctgtgcagtggatgaaccggctgatagcgttcgcttcgcggggtaaccacgtctcccctacgcactatgtgcctgagagcgacgctgcagcacgtgtcactcagatcctctctagccttaccatcactcaactgctgaagcggctccaccagtggattaatgaggactgctctacgccatgctccggctcgtggctaagggatgtttgggattggatatgcacggtgttgactgacttcaagacctggctccagtccaaactcctgccgcggttaccgggagtccctttcctgtcatgccaacgcgggtacaagggagtctggcggggggacggcatcatgcaaaccacctgcccatgcggagcacagatcgccggacatgtcaaaaacggttccatgaggatcgtagggcctagaacctgcagcaacacgtggcacggaacgttccccatcaacgcatacaccacgggaccttgcacaccctccccggcgcccaactattccagggcgctatggcgggtggctgctgaggagtacgtggaggttacgcgtgtgggggatttccactacgtgacgggcatgaccactgacaacgtaaagtgcccatgccaggttccggcccccgaattcttcacggaggtggatggagtgcggttgcacaggtacgctccggcgtgcaaacctcttctacgggaggacgtcacgttccaggtcgggctcaaccaatacttggtcgggtcgcagctcccatgcgagcccgaaccggacgtaacagtgcttacttccatgctcaccgatccctcccacattacagcagagacggctaagcgtaggctggctagagggtctcccccctctttagccagctcatcagctagccagttgtctgcgccttctttgaaggcgacatgcactacccaccatgactccccggacgctgacctcatcgaggccaacctcttgtggcggcaggagatgggcggaaacatcactcgcgtggagtcagagaataaggtagtaattctggactctttcgaaccgcttcacgcggagggggatgagagggagatatccgtcgcggcggagatcctgcgaaaatccaggaagttcccctcagcgttgcccatatgggcacgcccggactacaatcctccactgctagagtcctggaaggacccggactacgtccctccggtggtacacggatgcccattgccacctaccaaggctcctccaataccacctccacggagaaagaggacggttgtcctgacagaatccaatgtgtcttctgccttggcggagctcgccactaagaccttcggtagctccggatcgtcggccgttgatagcggcacggcgaccgcccttcctgacctggcctccgacgacggtgacaaaggatccgacgttgagtcgtactcctccatgcccccccttgaaggggagccgggggaccccgatctcagcgacgggtcttggtctaccgtgagtgaggaggctagtgaggatgtcgtctgctgctcaatgtcctatacgtggacaggcgccctgatcacgccatgcgctgcggaggaaagtaagctgcccatcaacccgttgagcaactctttgctgcgtcaccacaacatggtctacgccacaacatcccgcagcgcaagcctccggcagaagaaggtcacctttgacagattgcaagtcctggatgatcattaccgggacgtactcaaggagatgaaggcgaaggcgtccacagttaaggctaagcttctatctatagaggaggcctgcaagctgacgcccccacattcggccaaatccaaatttggctatggggcaaaggacgtccggaacctatccagcagggccgttaaccacatccgctccgtgtgggaggacttgctggaagacactgaaacaccaattgacaccaccatcatggcaaaaagtgaggttttctgcgtccaaccagagaagggaggccgcaagccagctcgccttatcgtattcccagacctgggagttcgtgtatgcgagaagatggccctttacgacgtggtctccacccttcctcaggccgtgatgggctcctcatacggatttcaatactcccccaagcagcgggtcgagttcctggtgaatacctggaaatcaaagaaatgccctatgggcttctcatatgacacccgctgttttgactcaacggtcactgagagtgacattcgtgttgaggagtcaatttaccaatgttgtgacttggcccccgaggccagacaggccataaggtcgctcacagagcggctttacatcgggggtcccctgactaactcaaaagggcagaactgcggttatcgccggtgccgcgcaagtggcgtgctgacgactagctgcggtaataccctcacatgttacttgaaggccactgcagcctgtcgagctgcaaagctccaggactgcacgatgctcgtgaacggagacgaccttgtcgttatctgtgaaagcgcgggaacccaggaggatgcggcggccctacgagccttcacggaggctatgactaggtattccgccccccccggggatccgccccaaccagaatacgacctggagctgataacatcatgttcctccaatgtgtcagtcgcgcacgatgcatctggcaaaagggtatactacctcacccgtgaccccaccaccccccttgcacgggctgcgtgggagacagctagacacactccaatcaactcttggctaggcaatatcatcatgtatgcgcccaccctatgggcaaggatgattctgatgactcactttttctccatccttctagctcaagagcaacttgaaaaagccctggattgtcagatctacggggcttgctactccattgagccacttgacctacctcagatcattgaacgactccatggtcttagcgcatttacactccacagttactctccaggtgagatcaatagggtggcttcatgcctcaggaaacttggggtaccacccttgcgaacctggagacatcgggccagaagtgtccgcgctaagctactgtcccagggggggagggccgccacttgtggcagatacctctttaactgggcagtaaggaccaagcttaaactcactccaatcccggccgcgtcccagctggacttgtctggctggttcgtcgctggttacagcgggggagacatatatcacagcctgtctcgtgcccgaccccgctggtttccgttgtgcctactcctactttctgtaggggtaggcatttacctgctccccaaccgatgaacggggagctaaccactccaggccttaagccatttcctgttttttttttttttttttttttttttttctttttttttttctttcctttccttctttttttcctttctttttcccttctttaatggtggctccatcttagccctagtcacggctagctgtgaaaggtccgtgagccgcatgactgcagagagtgctgatactggcctctctgcagatcatgt

SEQ ID NO: 636 - DNA, 9595 bp, Hepatitis C Virus
gccagccccctgatgggggcgacactccaccatgaatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgtgcgactaggaaggcttccgagcggtcgcaacctcgtggaaggcgacaacctatcccaaaggctcgccgacccgagggcagggcctgggctcagcccgggtacccttggcccctctatggcaatgagggcctggggtgggcaggatggctcctgtcaccccgcggctcccggcctagttggggccccacggacccccggcgtaggtcgcgtaacttgggtaaggtcatcgatacccttacatgcggcttcgccgatctcatggggtacattccgctcgtcggcgcccccctagggggcgctgccagggccttggcacacggtgtccgggttctggaggacggcgtgaactatgcaacagggaacttgcccggttgctctttctctatcttcctcttggctctgctgtcctgtttgaccatcccagcttccgcttatgaagtgcgcaacgtgtccgggatataccatgtcacgaacgactgctccaactcaagcattgtgtatgaggcagcggacgtgatcatgcatactcccgggtgcgtgccctgtgttcaggagggtaacagctcccgttgctgggtagcgctcactcccacgctcgcggccaggaatgccagcgtccccactacgacaatacgacgccacgtcgacttgctcgttgggacggctgctttctgctccgctatgtacgtgggggatctctgcggatctattttcctcgtctcccagctgttcaccttctcgcctcgccggcatgagacagtgcaggactacaactgctcaatctatcccggccatgtatcaggtcaccgcatggcttgggatatgatgatgaactggtcacctacaacagccctagtggtgtcgcagttgctccggatcccacaagctgtcgtggacatggtggcgggggcccactggggagtcctggcgggccttgcctactattccatggtagggaactgggctaaggttctgattgtggcgctactctttgccggcgttgacggggagacccacacgacggggagggtggccggccacaccacctccgggttcacgtcccttttctcatctggggcgtctcagaaaatccagcttgtgaataccaacggcagctggcacatcaacaggactgccctaaattgcaatgactccctccaaactgggttctttgccgcgctgttttacgcacacaagttcaactcgtccgggtgcccggagcgcatggccagctgccgccccattgactggttcgcccaggggtggggccccatcacctatactaagcctaacagctcggatcagaggccttattgctggcattacgcgcctcgaccgtgtggtgtcgtacccgcgtcgcaggtgtgtggtccagtgtattgtttcaccccaagccctgttgtggtggggaccaccgatcgttccggtgtccctacgtatagctggggggagaatgagacagacatgatgctcctcaacaacacgcgtccgccacaaggcaactggttcggctgtacatggatgaatagtactgggttcactaagacgtgcggaggtcccccgtgtaacatcgggggggtcggtaaccgcaccttgatctgccccacggactgcttccggaagcaccccgaggctacttacacaaaatgtggctcggggccctggttgacacctaggtgcctagtagactacccatacaggctctggcactacccctgcactctcaatttttccatctttaaggttaggatgtatgtggggggcgtggagcacaggctcaatgccgcatgcaattggactcgaggagagcgctgtaacttggaggacagggataggtcagaactcagcccgctgctgctgtctacaacagagtggcagatactgccctgtgctttcaccaccctaccggctttatccactggtttgatccatctccatcagaacatcgtggacgtgcaatacctgtacggtgtagggtcagcgtttgtctcctttgcaatcaaatgggagtacatcctgttgcttttccttctcctggcagacgcgcgcgtgtgtgcctgcttgtggatgatgctgctgatagcccaggctgaggccgccttagagaacttggtggtcctcaatgcggcgtccgtggccggagcgcatggtattctctcctttcttgtgttcttctgcgccgcctggtacattaagggcaggctggctcctggggcggcgtatgctttttatggcgtatggccgctgctcctgctcctactggcgttaccaccacgagcttacgccttggaccgggagatggctgcatcgtgcgggggtgcggttcttgtaggcctggtattcttgaccttgtcaccatactacaaagtgtttctcactaggctcatatggtggttacaatactttatcaccagagccgaggcgcacatgcaagtgtgggtcccccccctcaacgttcggggaggccgcgatgccatcatcctcctcacgtgtgcggttcatccagagttaatttttgacatcaccaaactcctgctcgccatactcggcccgctcatggtgctccaggctggcataacgagagtgccgtacttcgtgcgcgctcaagggctcattcgtgcatgcatgttagtgcgaaaagtcgccgggggtcattatatccaaatggccttcatgaagctgggcgcgctgacaggtacgtacgtttataaccatcttaccccactgcgggactgggcccacgcgggcctacgagaccttgcggtggcggtagagcccgtcgtcttctccgccatggagaccaaggtcatcacctggggagcagacaccgctgcgtgtggggacatcatcttgggtctacccgtctccgcccgaagggggaaggagatatttctgggaccggctgatagtctcgaagggcaagggtggcgactccttgcgcccatcacggcctactcccaacaaacgcggggcgtacttggttgcgtcatcactagcctcacaggccgggacaagaaccaggtcgaaggggaggttcaagtggtttctaccgcaacacaatctttcctggcgacctgcatcaatggcgtgtgttggactgtctaccatggcgctggctcgaagaccctagccggtccaaaaggtccaatcacccaaatgtacaccaatgtagacctggacctcgtcggctggcaggcgccccccggggcgcgctccatgacaccatgcagctgtggcagctcggacctttacttggtcacgagacatgctgatgtcattccggtgcgccggcgaggcgacagcaggggaagtctactctcccccaggcccgtctcctacctgaagggctcctcgggcggtccattgctttgcccttcggggcacgtcgtgggcgtcttccgggctgctgtgtgcacccggggggtcgcgaaggcggtggacttcatacccgtcgagtctatggaaactaccatgcggtccccggtcttcacagacaactcatcccccccggctgtaccgcagacatcccaagtggcacatctgcacgctcctactggcagcggcaagagcactaaagtgccggctgcgtatgcagcccaagggtacaaggtgctcgtcctgaacccgtccgttgccgccaccttagggtttggggcgtatatgtccaaggcacacggtatcgaccctaacatcagaactggggtaaggaccattaccacgggcggctccattacgtactccacctatggcaagttccttgccgacggtggctgctctgggggcgcctacgacatcataatatgtgatgagtgccactcaactgactcgactaccatcttgggcatcggcacagtcctggaccaagcggagacggctggagcgcggcttgtcgtgctcgccaccgctacacctccgggatcggttaccgtgccacaccccaatatcgaggaaataggcctgtccaacaatggagagatccccttctatggcaaagccatccccattgaggccatcaagggggggaggcatctcattttctgccattccaagaagaaatgcgacgagctcgccgcaaagctgacaggcctcggactgaacgctgtagcatattaccggggccttgatgtgtccgtcataccgcctatcggagacgtcgttgtcgtggcaacagacgctctaatgacgggtttcaccggcgattttgactcagtgatcgactgcaatacatgtgtcacccagacagtcgacttcagcttggatcccaccttcaccattgagacgacgaccgtgccccaagacgcggtgtcgcgctcgcaacggcgaggtagaactggcaggggtaggagtggcatctacaggtttgtgactccaggagaacggccctcgggcatgttcgattcttcggtcctgtgtgagtgctatgacgcgggctgtgcttggtatgagctcacgcccgctgagacctcggttaggttgcgggcttacctaaatacaccggggttgcccgtctgccaggaccatctggagttctgggagagcgtcttcacaggcctcacccacatagatgcccacttcctgtcccagactaaacaggcaggagacaactttccttacctggtggcatatcaagctacagtgtgcgccagggctcaagctccacctccatcgtgggaccaaatgtggaagtgtctcatacggctgaaacctacactgcacgggccaacacccctgctgtataggctaggagccgtccaaaatgaggtcatcctcacacaccccataactaaatacatcatggcatgcatgtcggctgacctggaggtcgtcactagcacctgggtgccggtaggcggagtccttgcagctttggccgcatactgcctgacgacaggcagtgtggtcattgtgggcaggatcattttgtccgggaagccagctgtcgttcccgacagggaagtcctctaccaggagttcgatgagatggaagagtgtgcctcacaacttccttacatcgagcagggaatgcagctcgccgagcaattcaagcaaaaggcgctcgggttgttgcaaacggccaccaagcaagcggaggctgctgctcccgtggtggagtccaggtggcgagcccttgagaccttctgggcgaagcacatgtggaatttcatcagcggaatacagtacctagcaggcttatccactctgcctggaaaccccgcgatagcatcattgatggcatttacagcttctatcactagcccgctcaccacccaacacaccctcctgtttaacatcttggggggatgggtggctgcccagctcgctcctcccagcgctgcgtcagctttcgtgggcgccggcatcgccggagcggctgttggcagcataggccttgggaaggtgctcgtggacatcttggcgggctatggggcaggggtagccggcgcactcgtggcctttaaggtcatgagtggcgaggtgccctccaccgaggacctggtcaacttactccctgccatcctctctcctggtgccctggtcgtcggggtcgtgtgcgcagcaatactgcgtcggcacgtgggcccgggagagggagctgtgcagtggatgaaccggctgatagcgttcgcttcgcggggtaaccacgtctcccccacgcactatgtgcctgagagcgacgctgcagcacgtgtcactcagatcctctctagccttaccatcactcaactgctgaagcggcttcaccagtggattaatgaggactgctctacgccatgctccggctcgtggctaagggatgtttgggattggatatgcacggtgttgactgacttcaagacctggctccagtccaagctcctgccgcggttaccgggagtccctttcctgtcatgccaacgcgggtacaagggagtctggcggggggacggcatcatgcaaaccacctgcccatgtggagcacagatcgccggacatgtcaaaaacggttccatgaggatcgtagggcctagaacctgcagcaacacgtggcacggaacgttccccatcaacgcatacaccacgggaccttgcacaccctccccggcgcccaactattccagggcgctatggcgggtggctgctgaggagtacgtggaggttacgcgtgtgggggatttccactacgtgacgggcatgaccactgacaacgtaaagtgcccatgccaggttccggcccccgaattcttcacggaggtggatggagtgcggttgcacaggtacgctccggcgtgcaaacctctcctacgggaggacgtcacgttccaggtcgggctcaaccaatacttggtcgggtcgcagctcccatgcgagcccgaaccggacgtaacggtgcttacttccatgctcaccgatccctcccacattacagcagagacggctaagcgtaggctggctagagggtcccccccctctttagccagctcatcagctagccagttgtctgcgccttctttgaaggcgacatgcactacccaccatgactccccggacgctgacctcatcgaggccaacctcttgtggcggcaggagatgggcggaaacatcactcgcgtggagtcagagaataaggtagtaattctggactctttcgaaccgcttcacgcggagggggatgagagggagatatccgtcgcggcggagatcctgcgaaaatccaggaagttcccctcagcgttgcccatatgggcacgcccggactacaatcctccactgctagagtcctggaaggacccggactacgtccctccggtggtacacggatgcccattgccacctaccaaggctcctccaataccacctccacggagaaagaggacggttgtcctgacagaatccaatgtgtcttctgccttggcggagctcgccactaagaccttcggtagctccggatcgtcggccgttgatagcggcacggcgaccgcccttcctgacctggcctccgacgacggtgacaaagggtccgacgttgagtcgtactcctccatgcccccccttgaaggggagccgggggaccccgatctcagcgacgggtcttggtctaccgtgagtgaggaggctagtgaggacgtcgtctgctgctcaatgtcctatacgtggacaggcgccctgatcacgccatgcgctgcggaggaaagtaagctgcccatcaacccgttgagcaactctttgctgcgtcaccacaacatggtctacgccacaacatcccgcagcgcaagcctccggcagaagaaggtcacctttgacagattgcaagtcctggatgaccattaccgggacgtgctcaaggagatgaaggcgaaggcgtccacagttaaggctaagcttctatctatagaggaggcctgcaagctgacgcccccacattcggccaaatccaaatttggctatggggcaaaggacgtccggaacctatccagcagggccgttaaccacatccgctccgtgtgggaggacttgctggaagacactgaaacaccaattgacaccaccatcatggcaaaaagtgaggttttctgcgtccaaccagagaagggaggccgcaagccagctcgccttatcgtattcccagacctgggagttcgtgtatgcgagaagatggccctttacgacgtggtctccacccttcctcaggccgtgatgggctcctcatacgggttccaatactcccccaagcagcgggtcgagttcctggtgaatacctggaaatcaaagaaatgccctatgggcttctcatatgacacccgctgttttgactcaacggtcactgagagtgacattcgtgttgaggagtcaatttaccaatgttgtgacttggcccccgaggccagacaggccataaggtcgctcacagagcggctttacatcgggggtcccctgactaactcaaaagggcaaaactgcggttatcgccggtgccgcgcaagtggcgtgctgacgactagctgcggtaataccctcacatgttacttgaaggccactgcggcctgtcgagctgcaaagctccaggactgcacgatgctcgtgaacggagacgaccttgtcgttatctgtgaaagcgcgggaacccaggaggatgcggcggccctacgagccttcacggaggctatgactaggtattccgccccccccggggatccgccccaaccagaatacgacctggagctgataacatcacgttcctccaatgtgtcagtcgcacacgatgcatctggcaaaagggtatactacctcacccgtgaccccaccaccccccttgcacgggctgcgtgggagacagctagacacactccagtcaactcttggctaggcaatatcatcatgtatgcgcccaccctatgggcaaggatgattctgatgactcactttttctccatccttctagctcaagagcaacttgaaaaagccctggattgtcagatctacggggcttgctactccattgagccacttgacctacctcagatcattgaacgactccatggtcttagcgcatttacactccacagttactctccaggtgagatcaatagggtggcttcatgcctcaggaaacttggggtaccacccttgcgaacctggagacatcgggccagaagtgtccgcgctaagctactgtcccagggggggagggccgccacttgtggcagatacctctttaactgggcagtaaggaccaagcttaaactcactccaatcccggccgcgtcccagctggacttgtctggctggttcgtcgctggttacagcgggggagacatatatcacagcctgtctcgtgcccgaccccgctggtttccgttgtgcctactcctactttctgtaggggtaggcatttacctgctccccaaccgatgaacggggagctaaccactccaggccttaagccatttcctgttttttttttttttttttttttttttttctttttttttttctttcctttccttctttttttcctttctttttcccttctttaatggtggctccatcttagccctagtcacggctagctgtgaaaggtccgtgagccgcatgactgcagagagtgctgatactggcctctctgcagatcatgt

SEQ ID NO: 637 - DNA, 9596 bp, Hepatitis C Virus
gccagccccctgatgggggcgacactccaccatgaatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcaaatcgttggtggagtttacctgttgccgcgcaggggccccaggttgggtgtgcgcgcgactaggaagacttccgagcggtcgcaacctcgtggaaggcgacaacctatcccaaaggctcgccgacccgagggcagggcctgggctcagcccgggtacccttggcccctctatggcaatgagggcttggggtgggcaggatggctcctgtcaccccgcggctcccggcctagttggggccccacggacccccggcgtaggtcgcgtaacttgggtaaggtcatcgatacccttacatgcggcttcgccgatctcatggggtacattccgctcgtcggcgcccccctagggggcgctgccagggccttggcacacggtgtccgggttctggaggacggcgtgaactatgcaacagggaacttgcccggttgctctttctctatcttcctcttggctctgctgtcctgtttgaccatcccagcttccgcttatgaagtgcgcaacgtgtccgggatataccatgtcacgaacgactgctccaactcaagcattgtgtatgaggcagcggacgtgatcatgcatactcccgggtgcgtgccctgtgttcgggagggcaacagctcccgttgctgggtagcgctcactcccacgctcgcggccagagatgccagcgtccccactacgacaatacgacgccacgtcgacttgctcgttgggacggctgctttctgctccgctatgtacgtgggggatctctgcggatctattttcctcgtctcccagctgttcaccttctcgcctcgccggcatgagacagtgcaggactgcaactgctcaatctatcccggccatgtatcaggtcaccgcatggcttgggatatgatgatgaactggtcacctacaacagccctagtggtgtcgcagttgctccggatcccacaagctgtcgtggacatggtggcgggggcccactggggagtcctggcgggccttgcctactattccatggtagggaactgggctaaggttctgattgtggcgctactctttgccggcgttgacggggagacccacacgacggggagggtggtcggccgcaccacctccgggtttacgtcccttttctcatctggggcgtctcagaaaatccagcttgtgaataccaacggcagctggcacatcaacaggactgctctaaattgcaatgactccctccagactgggttccttgccgcgctgttctacacacacaagttcaactcgcccgggtgcccggagcgcatggccagctgccgccccattgactggttcgcccaggggtggggccccatcacctatactgagcctaacagctcggatcagaggccttattgctggcattacgcgcctcgaccgtgtggtatcgtacccgcgtcgcaggtgtgtggtccagtgtattgtttcaccccaagccctgttgtggtggggaccaccgatcgttccggtgtccctacgtatagctggggggagaatgagacagacgtgatgctcctgaacaacacgcgtccgccacaaggcaactggttcggctgtacatggatgaatagtactgggttcactaagacgtgcggaggccccccgtgtaacatcgggggggtcggtaaccgcaccttgatctgccccacggactgcttccggaagcaccccgaggctacttacacaaaatgtggctcggggccctggttgacacctaggtgcctagtagactacccatacaggctctggcactacccctgcaccctcaatttttccatctttaaggttaggatgtatgtggggggcgtggagcacaggctcaatgccgcatgcaattggactcgaggagagcgctgtaacttggaggacagggataggtcagaactcagcccgctgctgctgtctacaacagagtggcagatactgccctgtgccttcaccaccctaccggctttatccactggtttgatccatctccatcagaacatcgtggacgtgcaatacctgtacggtgtagggtcagcgtttgtctcctttgcaatcaaatgggagtacatcctgttgcttttccttctcctggcagacgcgcgagtgtgtgcctgcttgtggatgatgctgctgatagcccaggctgaggccgccttagagaacttggtggtcctcaatgcggcgtccgtggccggagcgcatggtattctctcctttcttgtgttcttctgcgccgcctggtacattaagggcaggctggctcctggggcggcgtatgctttttatggcgtatggccgctgctcctgctcctactggcgttaccaccacgagcttacgccttggaccgggagatggctgcatcgtgcgggggtgcggttcttgtaggtctggtattcttgaccttatcaccatactacaaagtgtttctcactaggctcatatggtggttacaatactttatcaccagagccgaggcgcacatgcaagtgtgggtcccccccctcaacgttcggggaggccgcgatgccatcatcctcctcacgtgtgcggttcatccagagttaatttttgacatcaccaaactcctgctcgccatactcggcccgctcatggtgctccaggctggcataacgagagtgccgtacttcgtgcgcgctcaagggctcattcgtgcatgcatgttagtgcgaaaagtcgccgggggtcattatgtccaaatggccttcatgaagctgggcgcgctgacaggtacgtacgtttataaccatcttaccccactgcgggactgggcccacgcgggcctacgagaccttgcggtggcggtagagcccgtcgtcttctccgccatggagaccaaggtcatcacctggggagcagacaccgctgcgtgtggggacatcatcttgggtctacccgtctccgcccgaagggggaaggagatatttttgggaccggctgatagtctcgaagggcaagggtggcgactccttgcgcccatcacggcctactcccaacaaacgcggggcgtacttggttgcgtcatcactagcctcacaggccgggacaagaaccaggtcgaaggggaggttcaagtggtttctaccgcaacacaatctttcctggcgacctgcatcaacggcgtgtgctggactgtctaccatggcgctggctcaaagaccctagccggtccaaaaggtccaatcacccaaatgtacaccaatgtagacctggacctcgtcggctggcaggcgccccccggggcgcgctccatgacaccatgcagctgtggcagctcggacctttacttggtcacgagacatgctgatgtcatcccggtgcgccggcgaggcgacagcagggggagtctactctcccccaggcccgtctcctacctgaagggctcctcgggtggtcctttgctttgcccttcggggcacgtcgtgggcgtcttccgggctgctgtgtgcacccggggggtcgcgaaggcggtggacttcatacccgttgagtctatggaaactaccatgcggtctccggtcttcacagacaactcatcccccccggctgtaccgcagacattccaagtggcacatctgcacgctcctactggcagcggcaagagcaccaaagtgccggctgcgtatgcagcccaagggtacaaggtgctcgtcctgaatccgtccgttgccgccaccttagggtttggggcgtatatgtccaaggcacacggtatcgaccctaacatcagaactggggtaaggaccattaccacgggcggctccattacgtactccacctatggcaagttccttgccgacggtggctgctccgggggcgcctatgacatcataatatgtgatgagtgccactcaactgactcgactaccatcttgggcattggcacagtcctggaccaagcggagacggctggagcgcggcttgtcgtgctcgccaccgctacacctccgggatcggttaccgtgccacaccccaatatcgaggaaataggcctgtccaacaatggagagatccccttctatggcaaagccatccccattgaggccatcaagggggggaggcatctcattttctgccattccaagaagaaatgtgacgagctcgccgcaaagctgacaggcctcggactgaacgctgtagcatattaccggggccttgatgtgtccgtcataccgcctatcggagacgtcgttgtcgtggcaacagacgctctaatgacgggtttcaccggcgattttgactcagtgatcgactgcaatacatgtgtcactcagacagtcgacttcagcttggatcccaccttcaccattgagacgacgaccgtgccccaagacgcggtgtcgcgctcgcaacggcgaggtagaactggcaggggtaggagtggcatctacaggtttgtgactccaggagaacggccctcgggcatgttcgattcttcggtcctgtgtgagtgctatgacgcgggctgtgcttggcatgagctcacgcccgctgagacctcggttaggttgcgggcttacctaaatacaccaggattgcccgtctgccaggaccatctggagttctgggagagcgtcttcacaggcctcacccacatagatgcccacttcctgtcccagactaaacaggcaggagacaactttccttacctggtggcatatcaagctacagtgtgcgccagggctcaagctccacctccatcgtgggaccaaatgtggaagtgtctcatacggctgaaacctacactgcacgggccaacacccctgctgtataggctaggagccgtccaaaatgaggtcatcctcacacaccccataactaaatacatcatggcatgcatgtcggctgacctggaggtcgtcactagcacctgggtgctggtgggcggagtccttgcagctttggccgcatactgcctgacgacaggcagtgtggtcattgtgggcaggatcatcttgtccgggaagccagctgtcgttcccgacagggaagtcctctaccaggagttcgatgagatggaagagtgtgcctcacaacttccttacatcgagcagggaatgcagctcgccgagcaatttaagcagaaggcgctcggattgttgcaaacggccaccaagcaagcggaggctgctgctcccgtggtggagtccaagtggcgagccctcgagaccttctgggcgaagcacatgtggaatttcatcagcggaatacagtacctagcaggcttatccactctgcctggaaaccccgcgatagcatcattgatggcatttacagcttctatcactagcccgctcaccacccaaaacaccctcctgtttaacatcttggggggatgggtggctgcccaactcgctcctcccagcgctgcgtcagctttcgtgggcgccggcatcgccggagcggctgttggcagcataggccttgggaaggtgctcgtggacatcctggcgggctatggggcgggggtagccggcgcactcgtggcctttaaggtcatgagcggcgaggtgccctccaccgaggacctggtcaacttactccctgccatcctctctcctggtgccctggtcgtcggggtcgtgtgcgcagcaatactgcgccggcacgtgggcccgggagagggggctgtgcagtggatgaaccggctgatagcgttcgcttcgcggggtaaccacgtctcccccacgcactatgtgcctgagagcgacgctgcagcacgtgtcactcagatcctccctagccttaccatcactcaactgctgaagcggcttcaccagtggattaatgaggactgctctacgccatgctccggctcgtggctaagggatgtttgggattggatatgcacggtgttgactgacttcaagacctggctccagtccaagctcctgccgcggttaccgggagtccctttcctgtcatgccaacgcgggtacaagggagtctggcggggggacggcatcatgcaaaccacctgcccatgtggagcacagatcgccggacatgtcaaaaacggttccatgaggatcgtagggcctaggacctgcagcaacacgtggcacggaacgttccccatcaacgcatacaccacgggaccttgcacaccttccccggcgcccaactattccagggcgctatggcgggtggctgctgaggagtacgtggaggttacgcgtgtgggggatttccactacgtgacgggcatgaccactgacaacgtaaagtgcccatgccaggttccggcccccgaattcttcacggaggtggatggagtgcggttgcacaggtacgctccggcgtgcagacctctcctacgggaggacgtcacgttccaggtcgggctcaaccaatacttggtcgggtcgcagctcccatgcgagcccgaaccggacgtaacagtgcttacttccatgctcaccgatccctcccacattacagcagagacggctaagcgtaggctggctagagggtctcccccctctttagccagctcatcagctagccagttgtctgcgccttctttgaaggcgacatgcactacccaccatgactccccggacgctgacctcatcgaggccaacctcttgtggcggcaggagatgggcggaaacatcactcgcgtggagtcagagaataaggtagtaattctggactctttcgaaccgcttcacgcggagggggatgagagggagatatccgtcgcggcggagatcctgcgaaaatccaggaagttcccctcagcgttgcccatatgggcacgcccggactacaatcctccactgttagagtcctggaaggacccggactacgtccctccggtggtacacggatgcccattgccacctaccaaggctcctccaataccacctccacggagaaagaggacggttgtcctgacagaatccaatgtgtcttctgccttggcggagctcgccactaagaccttcggtagctccggatcgtcggccgtcgatagcggcacggcgaccgcccttcctgacctggcctccgacgacggtgacaaaggatccgacgttgagtcgcactcctccatgcccccccttgaaggggagccgggggaccccgatctcagcgacgggtcttggtctaccgtgagtgaggaggctagtgaggacgtcgtctgctgctcaatgtcctatacgtggacaggcgccctgatcacgccatgcgctgcggaggaaagtaagctgcccatcaacccgttgagcaactctttgctgcgtcaccacaacatggtctacgccacaacatcccgcagcgcaagcctccggcagaagaaggtcacctttgacagattgcaagtcctggacgaccattaccgggacgtgctcaaggagatgaaggcgaaggcgtccacagttaaggctaagcttctatctatagaggaggcctgcaagctgacgcccccacattcggccaaatccaaatttggctatggggcaaaggacgtccggaacctatccagcagggccgttaaccacatccgctccgtgtgggaggacttgctggaagacactgaaacaccaattgacaccaccatcatggcaaaaagtgaggttttctgcgtccaaccagagaagggaggccgcaagccagctcgccttatcgtattcccagacctgggagttcgtgtatgcgagaagatggccctttacgacgtggtctccacccttcctcaggccgtgatgggctcctcatacggatttcaatactcccccaagcagcgggtcgagttcctggtgaatacctggaaatcaaagaaatgccctatgggcttctcatatgacactcgctgttttgactcaacggtcaccgagagtgacattcgtgttgaggagtcaatttaccaatgttgtgacttggcccccgaggccagacaggccataaggtcgctcacagagcggctttacatcgggggtcccctgactaactcaaaagggcagaactgcggttatcgccggtgccgcgcaagtggcgtgctgacgactagctgcggtaataccctcacatgttacttgaaggccactgcggcctgtcgagctgcaaagctccaggactgcacgatgctcgtgaacggagacgaccttgtcgttatctgtgaaagcgcgggaacccaggaggatgcggcggccctacgagccttcacggaggctatgactaggtattccgccccccccggggatccgccccaaccagaatacgacctggagctgataacatcatgttcctccaatgtgtcagtcgcgcacgatgcatccggcaaaagggtatactacctcacccgtgaccccaccaccccccttgcacgggctgcgtgggagacagctagacacactccaatcaactcttggctaggcaatatcatcatgtatgcgcccaccctatgggcaaggatgattctgatgactcactttttctccatccttctagctcaagagcaacttgaaaaagccctggattgtcagatctacggggcttgctactccattgagccacttgacctacctcagatcattgaacgactccatggtcttagcgcatttacactccacagttactctccaggtgagatcaatagggtggcttcatgcctcaggaaacttggggtaccacccttgcgaacctggagacatcgggccagaagtgtccgcgctaagctactgtcccagggggggagggccgccacttgtggcagatacctctttaactgggcagtaaggaccaagcttaaactcactccaatcccggccgcgtcccagctggacttgtctggctggttcgtcgctggttacagcgggggagacatatatcacagcctgtctcgtgcccgaccccgctggtttccgttgtgcctactcctactttctgtaggggtaggcatttacctgctccccaaccgatgaacggggagctaaccactccaggccttaagccatttcctgttttttttttttttttttttttttttttctttttttttttctttcctttccttctttttttcctttctttttcccttctttaatggtggctccatcttagccctagtcacggctagctgtgaaaggtccgtgagccgcatgactgcagagagtgctgatactggcctctctgcagatcatgt

SEQ ID NO: 638 - DNA, 9580 bp, Hepatitis C Virus
gattgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagrcttccgagcggtcgcaacctcgtggaaggcgacaacctatcccaaaggctcgccracccgagggcagggcctgggctcagcccgggtacccttggcccctctatggcaatgagggcytggggtgggcaggatggctcctgtcaccccgcggctcccggcctagttggggccccacggacccccggcgtaggtcgcgtaacttgggtaaggtcatcgatacccttacatgcggcttcgccgatctcatggggtacattccgctcgtcggcgcccccctagggggcgctgccagggccttggcacacggtgtccgggttctggaggacggcgtgaactatgcaacagggaacttgcccggttgctctttctctatcttcctcttggctctgctgtcctgtttgaccatcccagcttccgcttatgaagtgcgcaacgtgtccgggatataccatgtcacgaacgactgctccaactcaagcattgtgtatgaggcagcggacgtgatcatgcatactcccgggtgcgtgccctgtgttcgggagggyaacagctcccgttgctgggtagcgctcactcccacgctcgcggccaggaatgccagcgtccccactacgacaatacgacgccacgtcgacttgctcgttgggacggctgctttctgctccgctatgtacgtgggggatctctgcggatctattttcctcgtctcccagctgttcaccttctcgcctcgccggcatgagacagtgcaggactgcaactgctcaatctatcccggccatgtatcaggtcaccgcatggcttgggatatgatgatgaactggtcacctacaacagccctagtggtgtcgcagttgctccggatcccacaagctgtcgtggacatggtggcgggggcccactggggagtcctggcgggccttgcctactattccatggtagggaactgggctaaggttctgattgtggcgctactctttgccggcgttgacgggrmgaccyacacgwcggggrgggtggycggccacaccacctccgggttcacgtccctyttctcatctggggcgtctcagaaaatccagcttgtgaataccaacggcagctggcacatcaacaggactgccctaaattgcaatgactccctccamactgggttcyttgccgcgctgttytacrcacacaagttcaactcgtccgggtgcccggagcgcatggccagctgccgccccattgactggttcgyccagggrtggggccccatcacctatactragcctaacagctcggatcagaggccttattgctggcattacgcgcctcgaccgtgtggtrtcgtacccgcgtcgcaggtgtgtggtccagtgtattgtttcaccccaagccctgttgtggtggggaccaccgatcgttccggtgtccctacgtatagctggggggagaatgagacagacgtgatgctcctcaacaacacgcgtccgccacaaggcaactggttcggctgtacatggatgaatagtactgggttcactaagacgtgcggaggccccccgtgtaacatcgggggggtcggtaaccgcaccttgatctgccccacggactgcttccggaagcaccccgaggctacttacacaaaatgtggctcggggccctggttgacacctaggtgcctagtagactacccatacaggctctggcactacccctgcactctcaatttttccatctttaaggttaggatgtatgtggggggcgtggagcacaggctcaatgccgcatgcaattggactcgaggagagcgctgtaacttggaggacagggataggtcagaactcagcccgctgctgctgtctacaacagagtggcagatactgccctgtgcyttcaccaccctaccggctttatccactggtttgatccatctccatcagaacatcgtggacgtgcaatacctgtacggtgtagggtcagcgtttgtctcctttgcaatcaaatgggagtacatcctgttgcttttccttctcctggcagacgcgcgcgtgtgtgcctgcttgtggatgatgctgctgatagcccaggctgaggccgccttagagaacttggtggtcctcaatgcggcgtccgtggccggagcgcatggtattctctccttycttgtgttcttctgygccgcctggtacattaagggcaggctggctcctggggcggcgtatgctttytatggcgtatggccgctgctcctgctcctactggcgttaccaccacgagcttacgccttggaccgggagatggctgcatcgtgcgggggtgcggttcttgtaggtctggtattcttgaccttgtcaccatactacaaagtgtttctcactaggctcatatggtggttacaatactttatcaccagagccgaggcgcacatgcaagtgtgggtcccccccctcaacgttcggggaggccgcgatgccatcatcctcctcacgtgtgcggttcatccagagttaatttttgacatcaccaaactcctgctcgccatactcggcccgctcatggtgctccaggctggcataacgagagtgccgtacttcgtgcgcgctcaagggctcattcgtgcatgcatgttagtgcgraaagtcgccgggggtcattatgtccaaatggccttcatgaagctgggygcgctgacaggtacgtacgtttataaccatcttacyccactgcgggactgggcccacgcgggcctacgagaccttgcggtggcggtagagcccgtcgtcttctccgmcatggagaccaaggtcatcacctggggwgcagacaccgcwgcgtgtggggacatcatcttgggtctacccgtctccgcccgaagggggaaggagatatttttgggaccggctgatagtctcgaagggcaagggtggcgactccttgcgcccatcacggcctactcccaacaaacgcggggcgtacttggttgcrtcatcactagcctcacaggccgggacaagaaccaggtcgarggggaggttcaagtggtttctaccgcaacacamtctttcctggcgacctgcatcaacggcgtgtgctggactgtctaccatggcgctggctcgaagaccctagccggtccaaaaggtccaatcacccaaatgtacaccaatgtagacctggacctcgtcggctggcaggcgccccccggggcgcgctccatgacaccatgcagctgtggcagctcggacctttacttggtcacgagacatgctgatgtcattccggtrcgccggcgaggcgacagcaggggaagtctactctcccccaggcccgtctcctacctgaagggctcctcgggtggtccattgctttgcccttcggggcaygtcgtgggcgtcttccgggctgctgtgtgcacccggggggtcgcgaaggcggtggacttcatacccgttgagtctatggaaactaccatgcggtctccggtcttcacagacaactcatcccccccggctgtaccgcagacattccaagtggcacatctgcacgctcctactggcagcggcaagagcactaaagtgccggctgcgtatgcagcccaagggtacaaggtgctcgtcctgaacccgtccgttgccgccaccttagggtttggggcgtatatgtccaaggcacacggtatcgaccctaacatcagaactggggtaaggaccattaccacgggcggctccattacgtactccacctatggcaagttccttgccgayggtggctgctcygggggcgcctatgacatcataatatgtgatgagtgccactcaactgactcgactaccatcttgggcatcggcacagtcctggaccaagcggagacggctggagcgcggcttgtcgtgctcgccaccgctacacctccgggatcggttaccgtgccacaccccaatatcgaggaaataggcctgtccaacaatggagagatccccttctatggcaaagccatccccattgaggccatcaagggggggaggcatctcattttctgccattccaagaagaaatgtgacgarctcgccgcaaagctgacaggcctcggactsaaygctgtagcatattaccggggccttgatgtgtccgtcataccgcctatcggagacgtcgttgtcgtggcaacagacgctctaatgacgggtttcaccggcgattttgactcagtgatcgactgcaayacatgtgtcacccagacagtcgacttcagcttggatcccaccttcaccattgagacgacgaccgtgccccaagacgcggtgtcgcgctcgcarcggcgaggtagaactggcaggggtaggagtggcatctacaggtttgtgactccaggagaacggccctcgggcatgttcgaytcttcggtcctgtgtgagtgctatgacgcgggctgtgcttggtatgagctcacgcccgctgagacctcggttaggttgcgggcttacctaaatacaccagggttgcccgtctgccaggaccatctggagttctgggagagcgtcttcacaggcctcacccacatagatgcccacttcctgtcccagactaaacaggcaggagacaactttccttacctggtggcatatcaagctacagtrtgcgccagggctcaagctccacctccatcgtgggaccaaatgtggaagtgtctcatacggctgaaacctacactgcacgggccaacacccctgctgtataggctaggagccgtccaaaatgaggtcatcctcacacaccccataactaaatacatcatggcatgcatgtcggctgacctrgaggtcgtcactagcacctgggtgctggtaggcggagtccttgcagctytggccgcataytgcctgacgacaggcagtgtggtcattgtgggcaggatcatcttgtccgggaagccagctgtcgttcccgacagggaagtcctctaccaggagttcgatgagatggaagagtgtgcctcacaacttccttacatcgagcagggaatgcagctcgccgagcaattyaagcaaaaggcgctcgggttgttgcaaacggccaccaagcaagcggaggctgctgctccygtggtggagtccaagtggcgagccctygagaccttctgggcgaagcacatgtggaatttcatcagcggratacagtacctagcaggcttatccactctgcctggaaaccccgcgatagcatcattgatggcatttacagcttctatcactagcccgctcaccacccaamacaccctcctgtttaacatcttggggggatgggtggctgcccaactcgctcctcccagcgctgcgtcagctttcgtgggcgccggcatcgccggagcggctgttggcagcataggccttgggaaggtgctcgtggacatcttggcgggctatggggcaggggtagccggcgcactcgtggcctttaaggtcatgagcggcgaggtgccctccaccgaggacctggtcaacttactccctgccatcctctctcctggtgccctggtcgtcggggtcgtgtgcgcagcaatactgcgtcggcacgtgggcccgggagagggggctgtgcagtggatgaaccggctgatagcgttcgcttcgcggggtaaccacgtctcccccacgcactatgtgcctgagagcgacgctgcagcacgtgtcactcagatcctctctagccttaccatcactcaactgctgaagcggcttcaccartggatyaatgaggactgctctacsccatgctccggctcgtggctaagggatgtttgggattggatatgcacggtgttgactgacttcaagacctggctccagtccaagctcctgccgcggttaccgggagtccctttcctgtcatgccaacgcgggtacaagggagtctggcggggggacggcatcatgcaaaccacctgcccatgtggagcacagatcgccggacatgtcaaaaacggttccatgaggatcgtagggcctagaacctgcagcaacacgtggcacggaacgttccccatcaacgcatacaccacgggaccytgcacaccctccccggcgcccaactattccagggcgctatggcgggtggctgctgaggagtacgtggaggttacgcgtgtgggrgatttccactacgtgacgggcatgaccactgacaacgtaaagtgcccatgccaggttccggcccccgaattcttcacggaggtggatggagtgcggttgcacaggtacgctccggcgtgcaaaccyctcctacgggaggacgtcrcgttccaggtcgggctcaaccaatacttggtcgggtcgcagctyccatgcgagcccgaaccggacgtaacagtgcttacttccatgctcaccgayccctcccacattacagcagagacggctaagcgtaggctggctagagggtctcccccctcyttagccagctcatcagctagccagttgtctgcgccttctttgaaggcgacatgcactacccaccatgactccccggacgctgacctcatcgaggccaacctcttgtggcggcaggagatgggcggaaacatcactcgcgtggagtcagagaataaggtagtaattctggactctttcgaaccgcttcacgcggakggggatgagagggagatatccgtcgcggcggagatcctgcgaaaatccaggaagttcccctcagcgttgcccatatgggcacgcccggactacaatcctccactgctagagtcctggaaggacccggactacgtccctccggtggtacacggatgcccattgccacctaccaaggctcctccaataccacctccacggagaaagaggacggttgtcctgacagaatccaatgtgtcttctgccttggcggagctcgccactaagaccttcggtagctccggatcgtcggccgttgatagcggcacggcgaccgcccttcctgaccwggcctccgacgacggtgacaaaggatccgacgttgagtcgtactcctccatgcccccycttgaaggggagccgggggaccccgatctcagcgacgggtcttggtctaccgtgagtgaggaggctagtgaggacgtcgtctgctgctcaatgtcctatacgtggacaggcgcyctgatcacgccatgcgctgcggaggaaagtaagctgcccatcaacccgttgagcaactctttgctgcgtcaccacaacatggtctacgccacaacatcccgcagcgcaagcctccggcagaagaaggtcacctttgacagattgcaagtcctggaygaccattaccgggacgtgctcaaggagatgaaggcgaaggcgtccacagttaaggctaagcttctatctatagaggaggcctgcaagctgacgcccccacattcggccaaatccaaatttggctatggggcaaaggacgtccggaacctatccagcagggccgttaaccacatccgctccgtgtgggaggacttgctggaagacactgaaacaccaattgacaccaccatcatggcaaaaagtgaggttttctgcgtccaaccagagaarggaggccgcaagccagctcgccttatcgtattcccagacctgggagttcgtgtatgcgagaagatggccctttacgacgtggtctccacccttcctcaggccgtgatgggctcctcatacggrtttcaatactcccccaagcagcgggtcgagttcctggtgaatacctggaaatcaaagaaatgccctatgggcttctcatatgacacccgctgttttgactcaacggtcactgagagtgacattcgtgttgaggagtcaatttaccaatgttgtgacttggcccccgaggccagacaggccataaggtcgctcacagagcggctttacatcgggggtcccctgactaactcaaaagggcagaactgcggttatcgccggtgccgcgcaagtggcgtgctgacgactagctgcggtaataccctcacatgttacttgaargccactgcggcctgtcgagctgcaaagctccaggactgcacgatgctcgtgaacggagacgaccttgtcgttatctgtgaaagcgcgggaacccaggaggatgcggcggccctacgagccttcacggaggctatgactaggtaytccgccccccccggggatccgccccaaccagaatacgacctggagctgataacatcatgttcctccaatgtgtcagtcgcrcacgatgcatctggcaaaagggtatactacctcacccgtgaccccaccaccccccttgcacgggctgcgtgggagacagctagacacactccaatcaactcttggctaggcaatatcatcatgtatgcgcccaccctatgggcaaggatgattctgatgactcactttttctccatccttctagctcaagagcaacttgaaaaagccctggattgtcagatctacggggcttgctactccattgagccacttgacctacctcagatcattgaacgactccatggtcttagcgcatttacactccacagttactctccaggtgagatcaatagggtggcttcatgcctcaggaaacttggggtaccacccttgcgaacctggagacatcgggccagaagtgtccgcgctaagctactgtcccagggggggagggccgccacttgtggcagatacctctttaactgggcagtaaggaccaagcttaaactcactccaatcccggctgcgtcccagctggacttgtccggctggttcgtcgctggttacagcgggggagacatatatcacagcctgtctcgtgcccgaccccgctggtttccgttgtgcctactcctactttctgtaggggtaggcatttacctgctccccaaccgatgaacggggagctaaccactccaggccwataggccwtcctgttttttttttttttttttttttttttttttttttttttttttttttttttttttttttttttttttttttttttttttttttttttttttttttttttttttttttttttttttttttttttttttttttttttttttttcttttttttttttccctctttcggtggctccatcttag

SEQ ID NO: 639 - DNA, 8779 bp, Hepatitis C Virus
ccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccagccgccgcccacaggacgtcaagttcccgggcggtggtcagatcgttggtggagtttacctgttgccgcgcaggggccccaggttgggtgtgcgcgcgactaggaaggcttccgagcggtcgcaacctcgtggaaggcgacaacctatcccaaaggctcgccgacccgagggcagggcctgggctcagcccgggtacccttggcccctctatggcaatgagggcctggggtgggcaggatggctcctgtcaccccgcggctcccggcctagttggggccccacggacccccggcgtaggtcgcgtaacttgggtaaggtcatcgatacccttacatgcggcttcgccgatctcatggggtacattccgctcgtcggcgcccccctagggggcgctgccagggccttggcgcacggtgtccgggttctggaggacggcgtgaactatgcaacagggaacttgcccggttgctctttctctatcttcctcttggctctgctgtcctgtttgaccatcccagcttccgcttatgaagtgcgcaacgtgtccgggatataccatgtcacgaacgactgctccaactcaagcattgtgtatgaggcagcggacgtgatcatgcatactcccgggtgcgtgccctgtgttcgggagggtaacagctcccgttgctgggtagcgctcactcccacgctcgcggccaggaatgccagcgtccccactacgacaatacgacgccacgtcgacttgctcgttgggacggctgctttctgctccgctatgtacgtgggggatctctgcggatctattttcctcgtctcccagctgttcactttctcgcctcgccggcatgcgacagtgcaggactgcaactgctcaatctatcccggccatgtatcaggtcaccgcatggcttgggatatgatgatgaactggtcacctacaacagccctagtggtgtcgcagttgctccggatcccacaagctgtcgtggacatggtggcgggggcccactggggagtcctggcgggccttgcctactattccatggtagggaactgggctaaggttctgattgtggcgctactctttgccggcgttgacggggagacccacacgacggggagggtggtcggccacaccacctccgggttcacgtcccttttctcatctggggcgtctcagaaaatccagcttgtgaataccaacggcagctggcacatcaacaggactgccctaaattgcaatgactccctccaaactgggttctttgccgcgctgttttacgcacacaagttcaactcgtccgggtgcccggagcgcatggccagctgccgccccattgactggttcgcccaggggtggggccccatcacctatactaagcctaacagctcggatcagaggccttattgctggcactacgcgcctcgaccgtgtggtgtcgtacccgcgtcgcaggtgtgtggtccagtgtattgtttcaccccaagccctgttgtggtggggaccaccgatcgttccggtgtccctacgtatagctggggggagaatgagacagacgtgatgctcctcaacaacacgcgtccgccacaaggcaactggttcggctgtacatggatgaatagtactgggttcactaagacgtgcggaggccccccgtgtaacatcgggggggtcggtaaccgcaccttgatctgccccacggactgcttccggaagcaccctgaggctacttacacaaaatgtggctcggggccctggttgacacctaggtgcctagtagactacccatacaggctctggcactacccctgcactgtcaatttttccatctttaaggttaggatgtatgtggggggcgtggagcacaggctcaatgccgcatgcaattggactcgaggagagcgctgtaacttggaggacagggataggtcagaactcagcccgctgctgctgtctacaacagagtggcagatactgccctgtgctttcaccaccctaccggctttatccactggtttgatccatctccatcagaacatcgtggacgtgcaatacctgtacggtgtagggtcagcgtttgtctcctttgcaatcaaatgggagtacatcctgttgcttttccttctcctggcagacgcgcgcgtgtgtgcctgcttgtggatgatgctgctgatagcccaggctgaggccgccttagagaacttggtggtcctcaatgcggcgtccgtggccggagcgcatggtatcctctcctttcttgtgttcttctgcgccgcctggtacattaagggcaggctggctcctggggcggcgtatgctttttatggcgtatggccgctgctcctgctcctactggcgttaccaccacgagcttacgccttggaccgggagatggctgcatcgtgcgggggtgcggttcttgtaggtctggtattcttgaccttgtcaccatactacaaagtgtttctcactaggctcatatggtggttacaatactttatcaccagagccgaggcgcacatgcaagtgtgggtcccccccctcaacgttcggggaggccgcgatgccatcatcctcctcacgtgtgcggttcatccagagttaatttttgacatcaccaaactcctgctcgccatactcggcccgctcatggtgctccaggctggcataacgagagtgccgtacttcgtgcgcgctcaagggctcattcgtgcatgcatgttagtgcgaaaagtcgccgggggtcattatatccaaatggccttcatgaagctgggcgcgctgacaggtacgtacgtttataaccatcttaccccactgcgggactgggcccacgcgggcctacgagaccttgcggtggcggtagagcccgtcgtcttctccgccatggagaccaaggtcatcacctggggagcagacaccgctgcgtgtggggacatcatcttgggtctacccgtctccgcccggagggggaaggagatatttctgggaccggctgatagtctcgaagggcaagggtggcgactccttgcgcccatcacggcctactcccaacaaacgcggggcgtacttggttgcgtcatcactagcctcacaggccgggacaagaaccaggtcgaaggggaggttcaagtggtttctaccgcaacacaatctttcctggcgacctgcatcaacggcgtgtgctggactgtctaccatggcgctggctcgaagaccctagccggtccaaaaggtccatcacccaaatgtacaccaatgtagacctggacctcgtcggctggcaggcgccccccggggcgcgctccatgacaccatgcagctgtggcagctcggacctttacttggtcacgagacatgctgatgtcatcccggtgcgccggcgaggcgacagcaggggaagtctactctcccccaggcccgtctcctacctgaagggctcctcgggtggtccattgctttgcccttcggggcacgtcgtgggcgtcttccgggctgctgtgtgcacccggagggtcgcgaaggcggtggacttcatacccgttgagtctatggaaactaccatgcggtccccggtcttcacagacaactcatcccccccggctgtaccgcagacattccaagtggcacatctgcacgctcctactggcagcggcaagagcactaaagtgccggctgcgtatgcagcccaagggtacaaggtgctcgtcctgaacccgtccgttgccgccaccttagggtttggggcgtatatgtccaaggcacacggtatcgaccctaacatcagaactggggtaaggaccattaccacgggcggctccattacgtactccacctatggcaagttccttgccgacggtggctgctctgggggcgcctatgacatcataatatgtgatgagtgccattcaactgactcgactaccatcttgggcatcggcacagtcctggaccaagcggagacggttggagcgcggcttgtcgtgctcgccaccgctacacctccgggatcggttaccgtgccacaccccaatatcgaggaaataggcctgtccaacaatggagagatccccttctatggcaaagccatccccattgaggccatcaagggggggaggcatctcattttctgccattccaagaagaactgcgacgagctcgccgcaaagctgacaggcctcggactgaacgctgtagcgtattaccggggccttgatgtgtccgtcataccgcctatcggagacgtcgttgtcgtggcaacagacgctctaatgacgggtttcaccggcgattttgactcagtgatcgactgcaatacatgtgtcacccagacagtcgacttcagcttggatcccaccttcaccattgagacgacgaccgtgccccaggacgcggtgtcgcgctcgcaacggcgaggtagaactggcaggggtaggagtggcatctacaggtttgtgactccaggagaacggccctcgggcatgttcgattcttcggtcctgtgtgagtgctatgacgcgggctgtgcttggtatgagctcacgcccgctgaggcctcggttaggttgcgggcttacctaaatacaccagggttgcccgtctgccaggaccatctggagttctgggagagcgtcttcacaggcctcacccacatagatgcccacttcctgtcccagactaaacaggcaggagacaactttccttacctggtggcatatcaagctacagtgtgcgccagggctcaagctccacctccatcgtgggaccaaatgtggaagtgtctcatacggctgaaacctacactgcacgggccaacacccctgctgtataggctaggagccgtccaaaatgaagtcatcctcacacaccccataactaaatacatcatggcatgcatgtcggctgacctggaggtcgtcactagcacctgggtgctggtaggcggagtccttgcagctttggccgcatactgcctgacgacaggcagtgtggtcattgtgggcaggatcatcttgtccgggaagccagctgtcgttcccgacagggaagtcctctaccaggagttcgatgagatggaagagtgtgcctcacaacttccttacatcgagcagggaatgcagctcgccgagcaattcaagcaaaaggcgctcgggttgttgcaaacggccaccaagcaagcggaggctgctgctcccgtggtggagtccaagtggcgagcccttgagaccttctgggcgaagcacatgtggaatttcatcagcggaatacagtacctagcaggcttatccactctgcctggaaaccccgcgatagcatcattgatggcttttacagcttctatcactagcccgctcaccacccaacacaccctcctgtttaacatcttggggggatgggtggctgcccaactcgctcctcccagcgctgcgtcagctttcgtgggcgccggcatcgccggagcggctgttggcagcataggccttgggaaggtgctcgtggacatcttggcgggctatggggcaggggtagccggcgcactcgtggcctttaaggtcatgagcggcgaggtgccctccaccgaggacctggtcaacttactccctgccatcctctctcctggtgccctggtcgtcggggtcgtgtgcgcagcaatactgcgtcggcacgtgggcccgggagagggggctgtgcagtggatgaaccggctgatagcgttcgcttcgcggggtaaccacgtctcccccacgcactatgtgcctgagagcgacgctgcagcacgtgtcactcagatcctctctagccttaccatcactcaactgctgaagcggcttcaccagtggattaatgaggactgctctacgccatgctccggctcgtggctaagggatgtttgggattggatatgcacggtgttgactgacttcaagacctggctccagtccaagctcctgccgcggttaccgggagtccctttcctgtcatgccaacgcgggtacaagggagtctggcggggggacggcatcatgcaaaccacctgcccatgtggagcacagatcgccggacatgtcaaaaacggttccatgaggatcgtagggcctagaacctgcagcaacacgtggcacggaacgttccccatcaacgcatacaccacgggaccttgcacaccctccccggcgcccaactattccagggcgctatggcgggtggctgctgaggagtacgtggaggttacgcgtgtgggggatttccactacgtgacgggcatgaccactgacaacgtaaagtgcccatgccaggttccggcccccgaattcttcacggaggtggatggagtgcggttgcacaggtacgctccggcgtgcaaacctctcctacgggaggacgtcacgtttcaggtcgggctcaaccaatacttggtcgggtcgcagctcccatgcgagcccgaaccggacgtaacagtgcttacttccatgctcaccgatccctcccacattacagcagagacggctaagcgtaggctggctagagggtcccccccctctttagccagctcatcagctagccagttgtctgcgccttctttgaaggcgacatgcactacccaccatgactccccggacgctgacctcatcgaggccaacctcttgtggcggcaggagatgggtgggaacatcactcgcgtggagtcagagaataaggtagtaattctggactctttcgaaccgcttcacgcggagggggatgagagggagatatccgtcgcggcggagatcctgcgaaaatccaggaagttcccctcagcgttgcccatatgggcacgcccggactacaatcctccactgctagagtcctggaaggacccggactacgtccctccggtggtacacggatgcccattgccacctaccaaggctcctccaataccacctccacgaagaaagaggacggttgtcctgacagaatccaatgtgtcttctgccttggcggagctcgccactaagaccttcggtagctccggatcgtcggccgttgatagcggcacggcgaccgcccttcctgacctggcctccgacgacggtgacaaagggtccgacgttgagtcgtactcctccatgcccccccttgaaggggagccgggggaccccgatctcagcgacgggtcttggtctaccgtgagtgaggaggctagtgaggacgtcgtctgctgctcaatgtcctatacgtggacaggcgccctgatcacgccatgcgctgcggaggaaagtaagctgcccatcaacccgttgagcaactctttgctgcgtcaccacaacatggtctacgccacaacatcccgcagcgcaagcctccggcagaagaaggtcacctttgacagattgcaagtcctggatgaccattaccgggacgtgctcaaggagatgaaggcgaaggcgtccacagttaaggctaagcttctatctatagaggaggcctgcaagctgacgcccccacattcggccaaatccaaatttggctatggggcaaaggacgtccggaacctatccagcagggccgttaaccacatccgctccgtgtgggaggacttgctggaagacactgaaacaccaattgacaccaccatcatggcaaaaagtgaggttttctgcgtccaaccagagaagggaggccgcaagccagctcgccttatcgtattcccagacctgggagttcgtgtatgcgagaagatggccctttacgacgtggtctccacccttcctcaggccgtgatgggctcctcatacgggtttcaatactcccccaagcagcgggtcgagttcctggtgaatacctggaaatcaaagaaatgccctatgggcttctcatatgacacccgctgttttgactcaacggtcactgagagtgacattcgtgttgaggagtcaatttaccaatgttgtgacttggcccccgaggccagacaggccataaggtcgctcacagagcggctttacatcgggggtcccctgactaactcaaaagggcagaactgcggttatcgccggtgccgcgcaagtggcgtgctgacgactagctgcggtaataccctcacatgttacttgaaggccactgcggcctgtcgagctgcaaagctccaggactgcacgatgctcgtgaacggagacgaccttgtcgttatctgtgaaagcgcgggaacccaggaggatgcggcggccctacgagccttcacggaggctatgactaggtattccgccccccccggggatccgccccaaccagaatacgacctggagctgataacatcatgttcctccaatgtgtcagtcgcacacgatgcatctggcaaaagggtatactacctcacccgtgaccccaccaccccccttgcacgggctgcgtgggagacagctagacacactccaatcaactcttggctaggcaatatcatcatgtatgcgcccaccctatgggcaaggatgattctgatgactcactttttctccatccttctagctcaagagcaacttgaaaaagccctggattgtca

SEQ ID NO: 640 - DNA, 8780 bp, Hepatitis C Virus
ccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgtgcgactaggaaggcttccgagcggtcgcaacctcgtggaaggcgacaacctatcccaaaggctcgccgacccgagggcagggcctgggctcagcccgggtacccttggcccctctatggcaatgagggcctggggtgggcaggatggctcctgtcaccccgcggctcccggcctagttggggccccacggacccccggcgtaggtcgcgtaacttgggtaaggtcatcgatacccttacatgcggcttcgccgatctcatggggtacattccgctcgtcggcgcccccctagggggcgctgccagggccttggcacacggtgtccgggttctggaggacggcgtgaactatgcaacagggaacttgcccggttgctctttctctatcttcctcttggctctgctgtcctgtttgaccatcccagcttccgcttatgaagtgcgcaacgtgtccgggatataccatgtcacgaacgactgctccaactcaagcattgtgtatgaggcagcggacgtgatcatgcatactcccgggtgcgtgccctgtgttcaggagggtaacagctcccgttgctgggtagcgctcactcccacgctcgcggccaggaatgccagcgtccccactacgacaatacgacgccacgtcgacttgctcgttgggacggctgctttctgctccgctatgtacgtgggggatctctgcggatctattttcctcgtctcccagctgttcaccttctcgcctcgccggcatgagacagtgcaggactacaactgctcaatctatcccggccatgtatcaggtcaccgcatggcttgggatatgatgatgaactggtcacctacaacagccctagtggtgtcgcagttgctccggatcccacaagctgtcgtggacatggtggcgggggcccactggggagtcctggcgggccttgcctactattccatggtagggaactgggctaaggttctgattgtggcgctactctttgccggcgttgacggggagacccacacgacggggagggtggccggccacaccacctccgggttcacgtcccttttctcatctggggcgtctcagaaaatccagcttgtgaataccaacggcagctggcacatcaacaggactgccctaaattgcaatgactccctccaaactgggttctttgccgcgctgttttacgcacacaagttcaactcgtccgggtgcccggagcgcatggccagctgccgccccattgactggttcgcccaggggtggggccccatcacctatactaagcctaacagctcggatcagaggccttattgctggcattacgcgcctcgaccgtgtggtgtcgtacccgcgtcgcaggtgtgtggtccagtgtattgtttcaccccaagccctgttgtggtggggaccaccgatcgttccggtgtccctacgtatagctggggggagaatgagacagacatgatgctcctcaacaacacgcgtccgccacaaggcaactggttcggctgtacatggatgaatagtactgggttcactaagacgtgcggaggtcccccgtgtaacatcgggggggtcggtaaccgcaccttgatctgccccacggactgcttccggaagcaccccgaggctacttacacaaaatgtggctcggggccctggttgacacctaggtgcctagtagactacccatacaggctctggcactacccctgcactctcaatttttccatctttaaggttaggatgtatgtggggggcgtggagcacaggctcaatgccgcatgcaattggactcgaggagagcgctgtaacttggaggacagggataggtcagaactcagcccgctgctgctgtctacaacagagtggcagatactgccctgtgctttcaccaccctaccggctttatccactggtttgatccatctccatcagaacatcgtggacgtgcaatacctgtacggtgtagggtcagcgtttgtctcctttgcaatcaaatgggagtacatcctgttgcttttccttctcctggcagacgcgcgcgtgtgtgcctgcttgtggatgatgctgctgatagcccaggctgaggccgccttagagaacttggtggtcctcaatgcggcgtccgtggccggagcgcatggtattctctcctttcttgtgttcttctgcgccgcctggtacattaagggcaggctggctcctggggcggcgtatgctttttatggcgtatggccgctgctcctgctcctactggcgttaccaccacgagcttacgccttggaccgggagatggctgcatcgtgcgggggtgcggttcttgtaggcctggtattcttgaccttgtcaccatactacaaagtgtttctcactaggctcatatggtggttacaatactttatcaccagagccgaggcgcacatgcaagtgtgggtcccccccctcaacgttcggggaggccgcgatgccatcatcctcctcacgtgtgcggttcatccagagttaatttttgacatcaccaaactcctgctcgccatactcggcccgctcatggtgctccaggctggcataacgagagtgccgtacttcgtgcgcgctcaagggctcattcgtgcatgcatgttagtgcgaaaagtcgccgggggtcattatatccaaatggccttcatgaagctgggcgcgctgacaggtacgtacgtttataaccatcttaccccactgcgggactgggcccacgcgggcctacgagaccttgcggtggcggtagagcccgtcgtcttctccgccatggagaccaaggtcatcacctggggagcagacaccgctgcgtgtggggacatcatcttgggtctacccgtctccgcccgaagggggaaggagatatttctgggaccggctgatagtctcgaagggcaagggtggcgactccttgcgcccatcacggcctactcccaacaaacgcggggcgtacttggttgcgtcatcactagcctcacaggccgggacaagaaccaggtcgaaggggaggttcaagtggtttctaccgcaacacaatctttcctggcgacctgcatcaatggcgtgtgttggactgtctaccatggcgctggctcgaagaccctagccggtccaaaaggtccaatcacccaaatgtacaccaatgtagacctggacctcgtcggctggcaggcgccccccggggcgcgctccatgacaccatgcagctgtggcagctcggacctttacttggtcacgagacatgctgatgtcattccggtgcgccggcgaggcgacagcaggggaagtctactctcccccaggcccgtctcctacctgaagggctcctcgggcggtccattgctttgcccttcggggcacgtcgtgggcgtcttccgggctgctgtgtgcacccggggggtcgcgaaggcggtggacttcatacccgtcgagtctatggaaactaccatgcggtccccggtcttcacagacaactcatcccccccggctgtaccgcagacatcccaagtggcacatctgcacgctcctactggcagcggcaagagcactaaagtgccggctgcgtatgcagcccaagggtacaaggtgctcgtcctgaacccgtccgttgccgccaccttagggtttggggcgtatatgtccaaggcacacggtatcgaccctaacatcagaactggggtaaggaccattaccacgggcggctccattacgtactccacctatggcaagttccttgccgacggtggctgctctgggggcgcctacgacatcataatatgtgatgagtgccactcaactgactcgactaccatcttgggcatcggcacagtcctggaccaagcggagacggctggagcgcggcttgtcgtgctcgccaccgctacacctccgggatcggttaccgtgccacaccccaatatcgaggaaataggcctgtccaacaatggagagatccccttctatggcaaagccatccccattgaggccatcaagggggggaggcatctcattttctgccattccaagaagaaatgcgacgagctcgccgcaaagctgacaggcctcggactgaacgctgtagcatattaccggggccttgatgtgtccgtcataccgcctatcggagacgtcgttgtcgtggcaacagacgctctaatgacgggtttcaccggcgattttgactcagtgatcgactgcaatacatgtgtcacccagacagtcgacttcagcttggatcccaccttcaccattgagacgacgaccgtgccccaagacgcggtgtcgcgctcgcaacggcgaggtagaactggcaggggtaggagtggcatctacaggtttgtgactccaggagaacggccctcgggcatgttcgattcttcggtcctgtgtgagtgctatgacgcgggctgtgcttggtatgagctcacgcccgctgagacctcggttaggttgcgggcttacctaaatacaccggggttgcccgtctgccaggaccatctggagttctgggagagcgtcttcacaggcctcacccacatagatgcccacttcctgtcccagactaaacaggcaggagacaactttccttacctggtggcatatcaagctacagtgtgcgccagggctcaagctccacctccatcgtgggaccaaatgtggaagtgtctcatacggctgaaacctacactgcacgggccaacacccctgctgtataggctaggagccgtccaaaatgaggtcatcctcacacaccccataactaaatacatcatggcatgcatgtcggctgacctggaggtcgtcactagcacctgggtgccggtaggcggagtccttgcagctttggccgcatactgcctgacgacaggcagtgtggtcattgtgggcaggatcattttgtccgggaagccagctgtcgttcccgacagggaagtcctctaccaggagttcgatgagatggaagagtgtgcctcacaacttccttacatcgagcagggaatgcagctcgccgagcaattcaagcaaaaggcgctcgggttgttgcaaacggccaccaagcaagcggaggctgctgctcccgtggtggagtccaggtggcgagcccttgagaccttctgggcgaagcacatgtggaatttcatcagcggaatacagtacctagcaggcttatccactctgcctggaaaccccgcgatagcatcattgatggcatttacagcttctatcactagcccgctcaccacccaacacaccctcctgtttaacatcttggggggatgggtggctgcccagctcgctcctcccagcgctgcgtcagctttcgtgggcgccggcatcgccggagcggctgttggcagcataggccttgggaaggtgctcgtggacatcttggcgggctatggggcaggggtagccggcgcactcgtggcctttaaggtcatgagtggcgaggtgccctccaccgaggacctggtcaacttactccctgccatcctctctcctggtgccctggtcgtcggggtcgtgtgcgcagcaatactgcgtcggcacgtgggcccgggagagggagctgtgcagtggatgaaccggctgatagcgttcgcttcgcggggtaaccacgtctcccccacgcactatgtgcctgagagcgacgctgcagcacgtgtcactcagatcctctctagccttaccatcactcaactgctgaagcggcttcaccagtggattaatgaggactgctctacgccatgctccggctcgtggctaagggatgtttgggattggatatgcacggtgttgactgacttcaagacctggctccagtccaagctcctgccgcggttaccgggagtccctttcctgtcatgccaacgcgggtacaagggagtctggcggggggacggcatcatgcaaaccacctgcccatgtggagcacagatcgccggacatgtcaaaaacggttccatgaggatcgtagggcctagaacctgcagcaacacgtggcacggaacgttccccatcaacgcatacaccacgggaccttgcacaccctccccggcgcccaactattccagggcgctatggcgggtggctgctgaggagtacgtggaggttacgcgtgtgggggatttccactacgtgacgggcatgaccactgacaacgtaaagtgcccatgccaggttccggcccccgaattcttcacggaggtggatggagtgcggttgcacaggtacgctccggcgtgcaaacctctcctacgggaggacgtcacgttccaggtcgggctcaaccaatacttggtcgggtcgcagctcccatgcgagcccgaaccggacgtaacggtgcttacttccatgctcaccgatccctcccacattacagcagagacggctaagcgtaggctggctagagggtcccccccctctttagccagctcatcagctagccagttgtctgcgccttctttgaaggcgacatgcactacccaccatgactccccggacgctgacctcatcgaggccaacctcttgtggcggcaggagatgggcggaaacatcactcgcgtggagtcagagaataaggtagtaattctggactctttcgaaccgcttcacgcggagggggatgagagggagatatccgtcgcggcggagatcctgcgaaaatccaggaagttcccctcagcgttgcccatatgggcacgcccggactacaatcctccactgctagagtcctggaaggacccggactacgtccctccggtggtacacggatgcccattgccacctaccaaggctcctccaataccacctccacggagaaagaggacggttgtcctgacagaatccaatgtgtcttctgccttggcggagctcgccactaagaccttcggtagctccggatcgtcggccgttgatagcggcacggcgaccgcccttcctgacctggcctccgacgacggtgacaaagggtccgacgttgagtcgtactcctccatgcccccccttgaaggggagccgggggaccccgatctcagcgacgggtcttggtctaccgtgagtgaggaggctagtgaggacgtcgtctgctgctcaatgtcctatacgtggacaggcgccctgatcacgccatgcgctgcggaggaaagtaagctgcccatcaacccgttgagcaactctttgctgcgtcaccacaacatggtctacgccacaacatcccgcagcgcaagcctccggcagaagaaggtcacctttgacagattgcaagtcctggatgaccattaccgggacgtgctcaaggagatgaaggcgaaggcgtccacagttaaggctaagcttctatctatagaggaggcctgcaagctgacgcccccacattcggccaaatccaaatttggctatggggcaaaggacgtccggaacctatccagcagggccgttaaccacatccgctccgtgtgggaggacttgctggaagacactgaaacaccaattgacaccaccatcatggcaaaaagtgaggttttctgcgtccaaccagagaagggaggccgcaagccagctcgccttatcgtattcccagacctgggagttcgtgtatgcgagaagatggccctttacgacgtggtctccacccttcctcaggccgtgatgggctcctcatacgggttccaatactcccccaagcagcgggtcgagttcctggtgaatacctggaaatcaaagaaatgccctatgggcttctcatatgacacccgctgttttgactcaacggtcactgagagtgacattcgtgttgaggagtcaatttaccaatgttgtgacttggcccccgaggccagacaggccataaggtcgctcacagagcggctttacatcgggggtcccctgactaactcaaaagggcaaaactgcggttatcgccggtgccgcgcaagtggcgtgctgacgactagctgcggtaataccctcacatgttacttgaaggccactgcggcctgtcgagctgcaaagctccaggactgcacgatgctcgtgaacggagacgaccttgtcgttatctgtgaaagcgcgggaacccaggaggatgcggcggccctacgagccttcacggaggctatgactaggtattccgccccccccggggatccgccccaaccagaatacgacctggagctgataacatcacgttcctccaatgtgtcagtcgcacacgatgcatctggcaaaagggtatactacctcacccgtgaccccaccaccccccttgcacgggctgcgtgggagacagctagacacactccagtcaactcttggctaggcaatatcatcatgtatgcgcccaccctatgggcaaggatgattctgatgactcactttttctccatccttctagctcaagagcaacttgaaaaagccctggattgtca

SEQ ID NO: 641 - DNA, 8780 bp, Hepatitis C Virus
ccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatcccaaaggctcgccaacccgagggcagggcctgggctcagcccgggtacccttggcccctctatggcaatgagggcttggggtgggcaggatggctcctgtcaccccgcggctcccggcctagttggggccccacggacccccggcgtaggtcgcgtaacttgggtaaggtcatcgatacccttacatgcggcttcgccgatctcatggggtacattccgctcgtcggcgcccccctagggggcgctgccagggccttggcacacggtgtccgggttctggaggacggcgtgaactatgcaacagggaacttgcccggttgctctttctctatcttcctcttggctctgctgtcctgtttgaccatcccagcttccgcttatgaagtgcacaacgtgtccgggatataccatgtcacgaacgactgctccaactcaagcattgtgtatgaggcagcggacgtgatcatgcatactcccgggtgcgtgccctgcgttcgggaggccgacagctcccgttgctgggtagcgctcactcccacgctcgcggccaggaatgccagcgtccccactacgacaatacgacgccatgtcgacttgctcgttgggacggccgctttctgctccgctatgtacgtgggggatctctgcggatctattttcctcgtctcccagctgttcaccttctcgcctcgccgacatgagacagtgcaggactgcaactgctcaatctatcccggccatgtatcaggtcaccgcatggcttgggatatgatgatgaactggtcacctacaacagccctagtggtgtcgcagttgctccggatcccacaagctgtcgtggacatggtggcgggggcccactggggagtcctggcgggccttgcctactattccatggtagggaactgggctaaggttctgattgtggcgctactctttaccggcgttgacgggacgacctacacgtcggggggggtggccggccgcaccacctccgggttcacgtccctcttctcatctggggcgtctcagaaaatccagcttgtgaataccaacggcagctggcacatcaacaggactgccctaaattgcaatgactccctccacactgggttccttgccgcgctgttctacacacacaagttcaactcgtccgggtgcccggagcgcatggccagctgccgccccattgactggttcgtccagggatggggccccatcacccatactgagcctaacagctcggatcagaggccttattgctggcattacgcgccccgaccgtgtggtatcgtacccgcgtcacaggtgtgtggtccagtgtattgtttcaccccaagccctgttgtggtggggaccaccgatcgttccggtgtccctacgtatagctggggggagaatgagacagacgtgatgctcctcaacaacacgcgtccgccacaaggcaactggttcggctgtacatggatgaatagtactgggttcactaagacgtgcggaggccccccgtgtaacatcgggggggtcggtaaccgcaccttgatctgccccacggactgcttccggaagcaccccgaggctacttacacaaaatgtggctcggggccctggttgacacctaggtgcctagtagactacccatacaggctctggcactacccctgcactctcaatttttccatctttaaggttaggatgtatgtggggggcgtggagcacaggctcaatgccgcatgcaattggactcgaggagagcgctgtaacttggaggacagggataggtcagaactcagcccgctgctgctgtctacaacagagtggcagatactgccctgtgccttcaccaccctaccggctttatccactggtttgatccatctccatcagaacatcgtggacgtgcaatacctgtacggtgtagggtcagcgtttgtctcctttgcaatcaaatgggagtacatcctgttgcttttccttctcctggcagacgcgcgcgtgtgtgcctgcttgtggatgatgctgctgatagcccaggctgaggccgccttagagaacttggtggtcctcaatgcggcgtccgtggccggagcgcatggtattctctccttccttgtgttcttctgtgccgcctggtacattaagggcaggctggctcctggggcggcgtatgctttctatggcgtatggccgctgctcctgctcctactggcgttaccaccacgagcttacgccttggaccgggagatggctgcatcgtgcgggggtgcggttcttgtaggtctggtattcttgaccttgtcaccatactacaaagtgtttctcactaggctcatatggtggttacaatactttatcaccagagccgaggcgcacatacaagtgtgggtcccccccctcaacgttcggggaggccgcgatgccatcatcctcctcacgtgtgcggttcatccagagttaatttttgacatcaccaaactcctgctcgccatactcggcccgctcatggtgctccaggctggcataacgagagtgccgtacttcgtgcgcgctcaagggctcattcgtgcatgcatgttagtgcggaaagtcgccgggggtcattatgtccaaatggccttcatgaagctgggcgcgctgacaggtacgtacgtttataaccatcttactccactgcgggactgggcccacgcgggcctacgagaccttgcggtggcggtagagcccgtcgtcttctccgacatggagaccaaggtcatcacctggggtgcagacaccgcagcgtgtggggacatcatcttgggtctacccgtctccgcccgaagggggaaggagatatttttgggaccggctgatagtctcgaagggcaagggtggcgactccttgcgcccatcacggcctactcccaacaaacgcggggcgtacttggttgcatcatcactagcctcacaggccgggacaagaaccaggtcgagggggaagttcaagtggtttctaccgcaacacactctttcctggcgacctgcatcaacggcgtgtgctggactgtctaccatggcgctggctcgaagaccctagccggtccaaaaggtccaatcacccaaatgtacaccaatgtagacctggacctcgtcggctggcaggcgccccccggggcgcgctccatgacaccatgcagctgtggcagctcggacctttacttggtcacgagacatgctgatgtcattccggtacgccggcgaggcgacagcaggggaagtctactctcccccaggcccgtctcctacctgaagggctcctcgggtggcccattgctttgcccttcggggcatgtcgtgggcgtcttccgggctgctgtgtgcacccggggggtcgcgaaggcggtggacttcatacccgttgagtctatggaaactaccatgcggtctccggtcttcacagacaactcatcccccccggctgtaccgcagacattccaagtggcacatctgcacgctcctactggcagcggcaagagcactaaagtgccggctgcgtatgcagcccaagggtacaaggtgctcgtcctgaacccgtccgttgccgccaccttagggtttggggcgtatatgtccaaggcacacggtatcgaccctaacatcagaactggggtaaggaccattaccacgggcggctccattacgtactccacctatggcaagttccttgccgatggtggctgctccgggggcgcctatgacatcataatatgtgatgagtgccactcaactgactcgactaccatcttgggcatcggcacagtcctggaccaagcggagacggctggagcgcggcttgtcgtgctcgccaccgctacacctccgggatcggttaccgtgccacaccccaatatcgaggaaataggcctgtccaacaatggagagatccccttctatggcaaagccatccccattgaggccatcaagggggggaggcatctcattttctgccattccaagaagaaatgtgacgaactcgccgcaaagctgacaggcctcggactcaatgctgtagcatattaccggggccttgatgtgtccgtcataccgcctatcggagacgtcgttgtcgtggcaacagacgctctaatgacgggtttcaccggcgattttgactcagtgatcgactgcaacacatgtgtcacccagacagtcgacttcagcttggatcccaccttcaccattgagacgacgaccgtgccccaagacgcggtgtcgcgctcgcagcggcgaggtagaactggcaggggtaggagcggcatctacaggtttgtgtctccaggagaacggccctcgggcatgttcgactcttcggtcctgtgtgagtgctatgacgcgggctgtgcttggtatgagctcacgcccgctgagacctcggttaggttgcgggcttacctaaatacaccagggttgcccgtctgccaggaccatctggagttctgggagagcgtcttcacaggcctcacccacatagatgcccacttcctgtcccagactaaacaggcaggagacaactttccttacctggtggcatatcaagctacagtatgcgccagggctcaagctccacctccatcgtgggaccaaatgtggaagtgtctcatacggctgaaacctacactgcacgggccaacacccctgctgtataggctaggagccgtccaaaatgaggtcatcctcacacaccccataactaaatacatcatggcatgcatgtcggctgacctagaggtcgtcactagcacctgggtgctggtaggcggagtccttgcagctctggccgcatattgcctgacgacaggcagtgtggtcattgtgggcaggatcatcttgtccgggaagccagctgtcgttcccgacagggaagtcctataccaggagttcgatgagatggaagagtgtgcctcacaacttccttacatcgagcagggaatgcagctcgccgagcaatttaagcaaaaggcgctcgggttgttgcaaacggccaccaagcaagcggaggctgctgctcctgtggtggagtccaagtggcgagcccttgagaccttctgggcgaagcacatgtggaatttcatcagcgggatacagtacctagcaggcttatccactctgcctggaaaccccgcgatagcatcattgatggcatttacagcttctattactagcccgctcaccacccaaaacaccctcctgtttaacatcttggggggatgggtggctgcccaactcgctcctcccagcgctgcgtcagctttcgtaggcgccggcatcgccggagcggctgttggcagcataggccttgggaaggtgctcgtggacatcttggcgggctatggggcaggggtagccggcgcactcgtggcctttaaggtcatgagcggcgaggtgccctccaccgaggacttggtcaacttacttcctgccatcctctctcctggtgccctggtcgtcggggtcgtgtgcgcagcaatactgcgtcggcacgtgggcccgggagagggggctgtgcagtggatgaaccggctgatagcgttcgcttcgcggggtaaccacgtctcccccacgcactatgtgcctgagagcgacgctgcagcgcgtgtcactcagatcctctctagccttaccatcactcaactgctgaagcggcttcaccaatggatcaatgaggactgctctacgccatgctccggctcgtggctaagggatgtttgggattggatatgcacggtgttgactgacttcaagacctggctccagtccaagctcctgccgcggttaccgggagtccctttcctgtcatgccaacgcgggtacaagggagtctggcggggggatggcatcatgcaaaccacctgcccatgtggagcacagatcgccggacatgtcaaaaacggttccatgaggatcgtagggcctagaacctgcagcaacacgtggcacggaacattccccatcaacgcgtacaccacgggaccctgcacaccctccccggcgcccaactattccagggcgctatggcgggtggctgctgaggagtacgtggaggttacgcgtgtgggagatttccactacgtgacgggcataaccactgacaacgtaaagtgcccatgccaggttccggcccccgaattcttcacggaggtggatggagtgcggttgcacaggtacgctccggcgtgcaaacccctcctacgggaggacgtcgcgttccaggtcgggctcaaccaatacttggtcgggtcgcagcttccatgcgagcccgaaccggacgtaacagtgcttacttccatgctcaccgacccctcccacattacagcagagacggctaagcgtaggctggctagagggtctcccccctccttagccagctcatcagctagccagttgtctgcgccttctttgaaggcgacatgcactacccaccatgactccccggacgctgaccccatcgaggccaacctcttgtggcggcaggagatgggcggaaacatcactcgcgtggagtcagagaataaggtagtaattctggactctttcgaaccgtttcacgcggatggggatgagagggagatatccgtcgcggcggagatcctgcgaaaatccaggaagttcccctcagcgttgcccatatgggcacgcccggactacaatcctccactgctagagtcctggaaggacccggactacgtccctccggtggtgcacggatgcccattgccacctaccaaggctcctccaataccacctccacggagaaagaggacggttatcctgacagaatccaatgtgtcttctgccttggcggagctcgccactaagaccttcggtagctccggatcgtcggccgttgatagcggcacggcgaccgcccttcctgaccaggcctccgacgacggtgacaaaggatccgacgttgagtcgtactcctccatgccccctcttgaaggggagccgggggaccccgatctcagcgacgggtcttggtctaccgtgagtgaggaggctagtgaggacgtcgtctgctgctcaatgtcctatacgtggacaggcgctctgatcacgccatgcgctgcggaggaaagtaagctgcccatcaacccgttgagcaactctttgctgcgtcaccacaacatggtgtacgccacaacatcccgcagcgcaagcctccggcagaagaaggtcacctttgacagactgcaagtcctggacgaccattaccgggacgtgctcaaggagatgaaggcgaaggcgtccacagttaaggctaagcttctatctatagaggaggcctgcaagctgacgcccccacattcggccaaatccaaatttggctatggggcaaaggacgtccggaacctatccagcagggccgttaaccacatccgctccgtgtgggaggacttgctggaagacactgaaacaccaattgacaccaccatcatggcaaaaagtgaggttttctgcgtccaaccagagaaaggaggccgcaagccagctcgccttatcgtattcccagacctgggagttcgtgtatgcgagaagatggccctttacgacgtggtctccacccttcctcaggccgtgatgggctcctcatacgggtttcaatactcccccaagcagcgggtcgagttcctggtgaatacctggaaatcaaagaaatgccctatgggcttctcatatgacacccgctgttttgactcaacggtcactgagagtgacattcgtgttgaggagtcaatttaccaatgttgtgacttggcccccgaggccagacaggccataaggtcgctcacagagcggctttacatcgggggtcccctgaccaactcaaaagggcagaactgcggttatcgccggtgccgcgcaagtggcgtgctgacgactagctgcggtaataccctcacatgttacttgaaggccactgcggcctgtcgagctgcaaagctccaggactgcacgatgctcgtgaacggagacgaccttgtcgttatctgtgaaagcgcgggaacccaggaggatgcggcggccctacgagccttcacggaggctatgactaggtactccgccccccccggggatccgccccaaccagaatacgacctggagctgataacatcatgttcctccaatgtgtcagtcgcgcacgatgcatctggcaaaagggtgtactacctcacccgtgaccccaccaccccccttgcacgggctgcgtgggagacagctagacacactccaatcaactcttggctaggcaatatcatcatgtatgcgcccaccctatgggcaaggatgattctgatgactcactttttctccatccttctagctcaagagcaacttgaaaaagtcctggattgtca

SEQ ID NO: 642 - DNA, 8781 bp, Hepatitis C Virus
ccggtgagtacaccggaattgccaggacgaccgggtcctttcttggatcaaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcaaatcgttggtggagtttacctgttgccgcgcaggggccccaggttgggtgtgcgcgcgactaggaagacttccgagcggtcgcaacctcgtggaaggcgacaacctatcccaaaggctcgccgacccgagggcagggcctgggctcagcccgggtacccttggcccctctatggcaatgagggcttggggtgggcaggatggctcctgtcaccccgcggctcccggcctagttggggccccacggacccccggcgtaggtcgcgtaacttgggtaaggtcatcgatacccttacatgcggcttcgccgatctcatggggtacattccgctcgtcggcgcccccctagggggcgctgccagggccttggcacacggtgtccgggttctggaggacggcgtgaactatgcaacagggaacttgcccggttgctctttctctatcttcctcttggctctgctgtcctgtttgaccatcccagcttccgcttatgaagtgcgcaacgtgtccgggatataccatgtcacgaacgactgctccaactcaagcattgtgtatgaggcagcggacgtgatcatgcatactcccgggtgcgtgccctgtgttcgggagggcaacagctcccgttgctgggtagcgctcactcccacgctcgcggccagagatgccagcgtccccactacgacaatacgacgccacgtcgacttgctcgttgggacggctgctttctgctccgctatgtacgtgggggatctctgcggatctattttcctcgtctcccagctgttcaccttctcgcctcgccggcatgagacagtgcaggactgcaactgctcaatctatcccggccatgtatcaggtcaccgcatggcttgggatatgatgatgaactggtcacctacaacagccctagtggtgtcgcagttgctccggatcccacaagctgtcgtggacatggtggcgggggcccactggggagtcctggcgggccttgcctactattccatggtagggaactgggctaaggttctgattgtggcgctactctttgccggcgttgacggggagacccacacgacggggagggtggtcggccgcaccacctccgggtttacgtcccttttctcatctggggcgtctcagaaaatccagcttgtgaataccaacggcagctggcacatcaacaggactgctctaaattgcaatgactccctccagactgggttccttgccgcgctgttctacacacacaagttcaactcgcccgggtgcccggagcgcatggccagctgccgccccattgactggttcgcccaggggtggggccccatcacctatactgagcctaacagctcggatcagaggccttattgctggcattacgcgcctcgaccgtgtggtatcgtacccgcgtcgcaggtgtgtggtccagtgtattgtttcaccccaagccctgttgtggtggggaccaccgatcgttccggtgtccctacgtatagctggggggagaatgagacagacgtgatgctcctgaacaacacgcgtccgccacaaggcaactggttcggctgtacatggatgaatagtactgggttcactaagacgtgcggaggccccccgtgtaacatcgggggggtcggtaaccgcaccttgatctgccccacggactgcttccggaagcaccccgaggctacttacacaaaatgtggctcggggccctggttgacacctaggtgcctagtagactacccatacaggctctggcactacccctgcaccctcaatttttccatctttaaggttaggatgtatgtggggggcgtggagcacaggctcaatgccgcatgcaattggactcgaggagagcgctgtaacttggaggacagggataggtcagaactcagcccgctgctgctgtctacaacagagtggcagatactgccctgtgccttcaccaccctaccggctttatccactggtttgatccatctccatcagaacatcgtggacgtgcaatacctgtacggtgtagggtcagcgtttgtctcctttgcaatcaaatgggagtacatcctgttgcttttccttctcctggcagacgcgcgagtgtgtgcctgcttgtggatgatgctgctgatagcccaggctgaggccgccttagagaacttggtggtcctcaatgcggcgtccgtggccggagcgcatggtattctctcctttcttgtgttcttctgcgccgcctggtacattaagggcaggctggctcctggggcggcgtatgctttttatggcgtatggccgctgctcctgctcctactggcgttaccaccacgagcttacgccttggaccgggagatggctgcatcgtgcgggggtgcggttcttgtaggtctggtattcttgaccttatcaccatactacaaagtgtttctcactaggctcatatggtggttacaatactttatcaccagagccgaggcgcacatgcaagtgtgggtcccccccctcaacgttcggggaggccgcgatgccatcatcctcctcacgtgtgcggttcatccagagttaatttttgacatcaccaaactcctgctcgccatactcggcccgctcatggtgctccaggctggcataacgagagtgccgtacttcgtgcgcgctcaagggctcattcgtgcatgcatgttagtgcgaaaagtcgccgggggtcattatgtccaaatggccttcatgaagctgggcgcgctgacaggtacgtacgtttataaccatcttaccccactgcgggactgggcccacgcgggcctacgagaccttgcggtggcggtagagcccgtcgtcttctccgccatggagaccaaggtcatcacctggggagcagacaccgctgcgtgtggggacatcatcttgggtctacccgtctccgcccgaagggggaaggagatatttttgggaccggctgatagtctcgaagggcaagggtggcgactccttgcgcccatcacggcctactcccaacaaacgcggggcgtacttggttgcgtcatcactagcctcacaggccgggacaagaaccaggtcgaaggggaggttcaagtggtttctaccgcaacacaatctttcctggcgacctgcatcaacggcgtgtgctggactgtctaccatggcgctggctcaaagaccctagccggtccaaaaggtccaatcacccaaatgtacaccaatgtagacctggacctcgtcggctggcaggcgccccccggggcgcgctccatgacaccatgcagctgtggcagctcggacctttacttggtcacgagacatgctgatgtcatcccggtgcgccggcgaggcgacagcagggggagtctactctcccccaggcccgtctcctacctgaagggctcctcgggtggtcctttgctttgcccttcggggcacgtcgtgggcgtcttccgggctgctgtgtgcacccggggggtcgcgaaggcggtggacttcatacccgttgagtctatggaaactaccatgcggtctccggtcttcacagacaactcatcccccccggctgtaccgcagacattccaagtggcacatctgcacgctcctactggcagcggcaagagcaccaaagtgccggctgcgtatgcagcccaagggtacaaggtgctcgtcctgaatccgtccgttgccgccaccttagggtttggggcgtatatgtccaaggcacacggtatcgaccctaacatcagaactggggtaaggaccattaccacgggcggctccattacgtactccacctatggcaagttccttgccgacggtggctgctccgggggcgcctatgacatcataatatgtgatgagtgccactcaactgactcgactaccatcttgggcattggcacagtcctggaccaagcggagacggctggagcgcggcttgtcgtgctcgccaccgctacacctccgggatcggttaccgtgccacaccccaatatcgaggaaataggcctgtccaacaatggagagatccccttctatggcaaagccatccccattgaggccatcaagggggggaggcatctcattttctgccattccaagaagaaatgtgacgagctcgccgcaaagctgacaggcctcggactgaacgctgtagcatattaccggggccttgatgtgtccgtcataccgcctatcggagacgtcgttgtcgtggcaacagacgctctaatgacgggtttcaccggcgattttgactcagtgatcgactgcaatacatgtgtcactcagacagtcgacttcagcttggatcccaccttcaccattgagacgacgaccgtgccccaagacgcggtgtcgcgctcgcaacggcgaggtagaactggcaggggtaggagtggcatctacaggtttgtgactccaggagaacggccctcgggcatgttcgattcttcggtcctgtgtgagtgctatgacgcgggctgtgcttggcatgagctcacgcccgctgagacctcggttaggttgcgggcttacctaaatacaccaggattgcccgtctgccaggaccatctggagttctgggagagcgtcttcacaggcctcacccacatagatgcccacttcctgtcccagactaaacaggcaggagacaactttccttacctggtggcatatcaagctacagtgtgcgccagggctcaagctccacctccatcgtgggaccaaatgtggaagtgtctcatacggctgaaacctacactgcacgggccaacacccctgctgtataggctaggagccgtccaaaatgaggtcatcctcacacaccccataactaaatacatcatggcatgcatgtcggctgacctggaggtcgtcactagcacctgggtgctggtgggcggagtccttgcagctttggccgcatactgcctgacgacaggcagtgtggtcattgtgggcaggatcatcttgtccgggaagccagctgtcgttcccgacagggaagtcctctaccaggagttcgatgagatggaagagtgtgcctcacaacttccttacatcgagcagggaatgcagctcgccgagcaatttaagcagaaggcgctcggattgttgcaaacggccaccaagcaagcggaggctgctgctcccgtggtggagtccaagtggcgagccctcgagaccttctgggcgaagcacatgtggaatttcatcagcggaatacagtacctagcaggcttatccactctgcctggaaaccccgcgatagcatcattgatggcatttacagcttctatcactagcccgctcaccacccaaaacaccctcctgtttaacatcttggggggatgggtggctgcccaactcgctcctcccagcgctgcgtcagctttcgtgggcgccggcatcgccggagcggctgttggcagcataggccttgggaaggtgctcgtggacatcctggcgggctatggggcgggggtagccggcgcactcgtggcctttaaggtcatgagcggcgaggtgccctccaccgaggacctggtcaacttactccctgccatcctctctcctggtgccctggtcgtcggggtcgtgtgcgcagcaatactgcgccggcacgtgggcccgggagagggggctgtgcagtggatgaaccggctgatagcgttcgcttcgcggggtaaccacgtctcccccacgcactatgtgcctgagagcgacgctgcagcacgtgtcactcagatcctccctagccttaccatcactcaactgctgaagcggcttcaccagtggattaatgaggactgctctacgccatgctccggctcgtggctaagggatgtttgggattggatatgcacggtgttgactgacttcaagacctggctccagtccaagctcctgccgcggttaccgggagtccctttcctgtcatgccaacgcgggtacaagggagtctggcggggggacggcatcatgcaaaccacctgcccatgtggagcacagatcgccggacatgtcaaaaacggttccatgaggatcgtagggcctaggacctgcagcaacacgtggcacggaacgttccccatcaacgcatacaccacgggaccttgcacaccttccccggcgcccaactattccagggcgctatggcgggtggctgctgaggagtacgtggaggttacgcgtgtgggggatttccactacgtgacgggcatgaccactgacaacgtaaagtgcccatgccaggttccggcccccgaattcttcacggaggtggatggagtgcggttgcacaggtacgctccggcgtgcagacctctcctacgggaggacgtcacgttccaggtcgggctcaaccaatacttggtcgggtcgcagctcccatgcgagcccgaaccggacgtaacagtgcttacttccatgctcaccgatccctcccacattacagcagagacggctaagcgtaggctggctagagggtctcccccctctttagccagctcatcagctagccagttgtctgcgccttctttgaaggcgacatgcactacccaccatgactccccggacgctgacctcatcgaggccaacctcttgtggcggcaggagatgggcggaaacatcactcgcgtggagtcagagaataaggtagtaattctggactctttcgaaccgcttcacgcggagggggatgagagggagatatccgtcgcggcggagatcctgcgaaaatccaggaagttcccctcagcgttgcccatatgggcacgcccggactacaatcctccactgttagagtcctggaaggacccggactacgtccctccggtggtacacggatgcccattgccacctaccaaggctcctccaataccacctccacggagaaagaggacggttgtcctgacagaatccaatgtgtcttctgccttggcggagctcgccactaagaccttcggtagctccggatcgtcggccgtcgatagcggcacggcgaccgcccttcctgacctggcctccgacgacggtgacaaaggatccgacgttgagtcgcactcctccatgcccccccttgaaggggagccgggggaccccgatctcagcgacgggtcttggtctaccgtgagtgaggaggctagtgaggacgtcgtctgctgctcaatgtcctatacgtggacaggcgccctgatcacgccatgcgctgcggaggaaagtaagctgcccatcaacccgttgagcaactctttgctgcgtcaccacaacatggtctacgccacaacatcccgcagcgcaagcctccggcagaagaaggtcacctttgacagattgcaagtcctggacgaccattaccgggacgtgctcaaggagatgaaggcgaaggcgtccacagttaaggctaagcttctatctatagaggaggcctgcaagctgacgcccccacattcggccaaatccaaatttggctatggggcaaaggacgtccggaacctatccagcagggccgttaaccacatccgctccgtgtgggaggacttgctggaagacactgaaacaccaattgacaccaccatcatggcaaaaagtgaggttttctgcgtccaaccagagaagggaggccgcaagccagctcgccttatcgtattcccagacctgggagttcgtgtatgcgagaagatggccctttacgacgtggtctccacccttcctcaggccgtgatgggctcctcatacggatttcaatactcccccaagcagcgggtcgagttcctggtgaatacctggaaatcaaagaaatgccctatgggcttctcatatgacactcgctgttttgactcaacggtcaccgagagtgacattcgtgttgaggagtcaatttaccaatgttgtgacttggcccccgaggccagacaggccataaggtcgctcacagagcggctttacatcgggggtcccctgactaactcaaaagggcagaactgcggttatcgccggtgccgcgcaagtggcgtgctgacgactagctgcggtaataccctcacatgttacttgaaggccactgcggcctgtcgagctgcaaagctccaggactgcacgatgctcgtgaacggagacgaccttgtcgttatctgtgaaagcgcgggaacccaggaggatgcggcggccctacgagccttcacggaggctatgactaggtattccgccccccccggggatccgccccaaccagaatacgacctggagctgataacatcatgttcctccaatgtgtcagtcgcgcacgatgcatccggcaaaagggtatactacctcacccgtgaccccaccaccccccttgcacgggctgcgtgggagacagctagacacactccaatcaactcttggctaggcaatatcatcatgtatgcgcccaccctatgggcaaggatgattctgatgactcactttttctccatccttctagctcaagagcaacttgaaaaagccctggattgtca

SEQ ID NO: 643 - DNA, 8780 bp, Hepatitis C Virus
ccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaaggcttccgagcggtcgcaacctcgtggaaggcgacaacctatcccaaaggctcgccgacccgagggcagggcctgggctcagcccgggtacccttggcccctctatggcaatgagggcctggggtgggcaggatggctcctgtcaccccgcggctcccggcctagttggggccccacggacccccggcgtaggtcgcgtaacttgggtaaggtcatcgatacccttacatgcggcttcgccgatctcatggggtacattccgctcgtcggcgcccccctagggggcgctgccagggccttggcacacggtgtccgggttctggaggacggcgtgaactatgcaacagggaacttgcccggttgctctttctctatcttcctcttggctctgctgtcctgtttgaccatcccagcttccgcttatgaagtgcgcaacgtgtccgggatataccatgtcacgaacgactgctccaactcaagcattgtgtatgaggcagcggacgtgatcatgcatactcccgggtgcgtgccctgtgttcaggagggtaacagctcccgttgctgggtagcgctcactcccacgctcgcggccaggaatgccagcgtccccactacgacaatacgacgccacgtcgacttgctcgttgggacggctgctttctgctccgctatgtacgtgggggatctctgcggatctattttcctcgtctcccagctgttcaccttctcgcctcgccggcatgagacagtgcaggactgcaactgctcaatctatcccggccatgtatcaggtcaccgcatggcttgggatatgatgatgaactggtcacctacaacagccctagtggtgtcgcagttgctccggatcccacaagctgtcgtggacatggtggcgggggcccactggggagtcctggcgggccttgcctactattccatggtagggaactgggctaaggttctgattgtggcgctactctttgccggcgttgacggggagacccacacgacggggagggtggccggccacaccacctccgggttcacgtcccttttctcatctggggcgtctcagaaaatccagcttgtgaataccaacggcagctggcacatcaacaggactgccctaaattgcaatgactccctccaaactgggttctttgccgcgctgttttacgcacacaagttcaactcgtccgggtgcccggagcgcatggccagctgccgccccattgactggttcgcccaggggtggggccccatcacctatactaagcctaacagctcggatcagaggccttattgctggcattacgcgcctcgaccgtgtggtgtcgtacccgcgtcgcaggtgtgtggtccagtgtattgtttcaccccaagccctgttgtggtggggaccaccgatcgttccggtgtccctacgtatagctggggggagaatgagacagacgtgatgctcctcaacaacacgcgtccgccacaaggcaactggttcggctgtacatggatgaatagtactgggttcactaagacgtgcggaggtcccccgtgtaacatcgggggggtcggtaaccgcaccttgatctgccccacggactgcttccggaagcaccccgaggctacttacacaaaatgtggctcggggccctggttgacacctaggtgcctagtagactacccatacaggctttggcactacccctgcactctcaatttttccatctttaaggttaggatgtatgtggggggcgtggagcacaggctcaatgccgcatgcaattggactcgaggagagcgctgtaacttggaggacagggataggtcagaactcagcccgctgctgctgtctacaacagagtggcagatactgccctgtgctttcaccaccctaccggctttatccactggtttgatccatctccatcagaacatcgtggacgtgcaatacctgtacggtgtagggtcagcgtttgtctcctttgcaatcaaatgggagtacatcctgttgcttttccttctcctggcagacgcgcgcgtgtgtgcctgcttgtggatgatgctgctgatagcccaggctgaggccgccttagagaacttggtggtcctcaatgcggcgtccgtggccggagcgcatggtattctctcctttcttgtgttcttctgcgccgcctggtacattaagggcaggctggctcctggggcggcgtatgctttttatggcgtatggccgctgctcctgctcctactggcgttaccaccacgagcttacgccttggaccgggagatggctgcatcgtgcgggggtgcggttcttgtaggtctggtattcttgaccttgtcaccatactacaaagtgtttctcactaggctcatatggtggttacaatactttatcaccagagccgaggcgcacatgcaagtgtgggtcccccccctcaacgttcggggaggccgcgatgccatcatcctcctcacgtgtgcggttcatccagagttaatttttgacatcaccaaactcctgctcgccatactcggcccgctcatggtgctccaggctggcataacgagagtgccgtacttcgtgcgcgctcaagggctcattcgtgcatgcatgttagtgcgaaaagtcgccgggggtcattatgtccaaatggtcttcatgaagctgggcgcgctgacaggtacgtacgtttataaccatcttaccccactgcgggactgggcccacgcgggcctacgagaccttgcggtggcggtagagcccgtcgtcttctccgccatggagaccaaggtcatcacctggggagcagacaccgctgcgtgtggggacatcatcttgggtctacccgtctccgcccgaagggggaaggagatatttttgggaccggctgatagtctcgaagggcaagggtggcgactccttgcgcccatcacggcctactcccaacaaacgcggggcgtacttggttgcatcatcactagcctcacaggccgggacaagaaccaggtcgaaggggaggttcaagtggtttctaccgcaacacaatctttcctggcgacctgcatcaacggcgtgtgctggactgtctaccatggcgctggctcgaagaccctagccggtccaaaaggtccaatcacccaaatgtacaccaatgtagacctggacctcgtcggctggcaggcgccccccggggcgcgctccatgacaccatgcagctgtggcagctcggacctttacttggtcacgagacatgctgatgtcattccggtgcgccggcgaggcgacagcaggggaagtctactctcccccaggcccgtctcctacctgaaaggctcctcgggtggtccattgctttgcccttcggggcacgtcgtgggcgtcttccgggctgctgtgtgcacccggggggtcgcgaaggcggtggacttcatacccgttgagtctatggaaactaccatgcggtctccggtcttcacagacaactcaacccccccggctgtaccgcagacattccaagtggcacatctgcacgctcctactggcagcggcaagagcaccaaagtgccggctgcgtatgcagcccaagggtacaaggtgctcgtcctgaacccgtccgttgccgccaccttagggtttggggcgtatatgtccaaggcacacggtatcgaccctaacatcagaactggggtaaggaccattaccacgggcggctccattacgtactccacctatggcaagttccttgccgacggtggctgttctgggggcgcctatgacatcataatatgtgatgagtgccactcaactgactcgactaccatcttgggcatcggcacagtcctggaccaagcggagacggctggagcgcggctcgtcgtgctcgccaccgctacacctccgggatcggttaccgtgccacaccccaatatcgaggaaataggcctgtccaacaatggagagatccccttctatggcaaagccatccccattgaggccatcaagggggggaggcatctcattttctgccattccaagaagaaatgtgacgagctcgccgcaaagctgacaggcctcggactgaacgctgtagcatattaccggggccttgatgtgtccgtcataccgcctatcggagacgtcgttgtcgtggcaacagacgctctaatgacgggtttcaccggcgattttgactcagtgatcgactgcaatacatgtgtcacccagacagtcgacttcagcttggatcccaccttcaccattgagacgacgaccgtgccccaagacgcggtgtcgcgctcgcaacggcgaggtagaactggcaggggtaggagtggcatctacaggtttgtgactccaggagaacggccctcgggcatgttcgattcttcggtcctgtgtgagtgctatgacgcgggctgtgcttggtatgagctcacgcccgctgagacctcggttaggttgcgggcttacctaaatacaccagggttgcccgtctgccaggaccatctggagttctgggagagcgtcttcacaggcctcacccacatagatgcccacttcctgtcccagactaaacaggcaggagacaactttccttacctggtggcatatcaagctacagtgtgcgccagggctcaagctccacctccatcgtgggaccaaatgtggaagtgtctcatacggctgaaacctacactgcacgggccaacacccctgctgtataggctaggagccgtccaaaatgaggtcatcctcacacaccccataactaaatacatcatggcatgcatgtcggctgacctggaggtcgtcactagcacctgggtgctggtaggcggagtccttgcagctttggccgcatactgcctgacgacaggcagtgtggtcattgtgggcaggatcatcttgtccgggaagccagctgtcgttcccgacagggaagtcctctaccaggagttcgatgagatggaagagtgtgcctcacaacttccttacatcgagcagggaatgcagctcgccgagcaattcaagcaaaaggcgctcgggttgttgcaaacggccaccaagcaagcggaggctgctgctcccgtggtggagtccaagtggcgagcccttgagaccttctgggcgaagcacatgtggaatttcatcagcggaatacagtacctagcaggcttatccactctgcctggaaaccccgcgatagcatcattgatggcatttacagcttctatcactagcccgctcaccacccaaaacaccctcctgtttaacatcttggggggatgggtggctgcccaactcgctcctcccagcgctgcgtcagctttcgtgggcgccggcatcgccggagcggctgttggcagcataggccttgggaaggtgctcgtggacatcttggcgggctatggggcaggggtagccggcgcactcgtggcctttaaggtcatgagcggcgaggtgccctccaccgaggacctggtcaacttactccctgccatcctctctcctggtgccctggtcgtcggggtcgtgtgcgcagcaatactgcgtcggcacgtgggcccgggagagggggctgtgcagtggatgaaccggctgatagcgttcgcttcgcggggtaaccacgtctcccctacgcactatgtgcctgagagcgacgctgcagcacgtgtcactcagatcctctctagccttaccatcactcaactgctgaagcggctccaccagtggattaatgaggactgctctacgccatgctccggctcgtggctaagggatgtttgggattggatatgcacggtgttgactgacttcaagacctggctccagtccaaactcctgccgcggttaccgggagtccctttcctgtcatgccaacgcgggtacaagggagtctggcggggggacggcatcatgcaaaccacctgcccatgcggagcacagatcgccggacatgtcaaaaacggttccatgaggatcgtagggcctagaacctgcagcaacacgtggcacggaacgttccccatcaacgcatacaccacgggaccttgcacaccctccccggcgcccaactattccagggcgctatggcgggtggctgctgaggagtacgtggaggttacgcgtgtgggggatttccactacgtgacgggcatgaccactgacaacgtaaagtgcccatgccaggttccggcccccgaattcttcacggaggtggatggagtgcggttgcacaggtacgctccggcgtgcaaacctcttctacgggaggacgtcacgttccaggtcgggctcaaccaatacttggtcgggtcgcagctcccatgcgagcccgaaccggacgtaacagtgcttacttccatgctcaccgatccctcccacattacagcagagacggctaagcgtaggctggctagagggtctcccccctctttagccagctcatcagctagccagttgtctgcgccttctttgaaggcgacatgcactacccaccatgactccccggacgctgacctcatcgaggccaacctcttgtggcggcaggagatgggcggaaacatcactcgcgtggagtcagagaataaggtagtaattctggactctttcgaaccgcttcacgcggagggggatgagagggagatatccgtcgcggcggagatcctgcgaaaatccaggaagttcccctcagcgttgcccatatgggcacgcccggactacaatcctccactgctagagtcctggaaggacccggactacgtccctccggtggtacacggatgcccattgccacctaccaaggctcctccaataccacctccacggagaaagaggacggttgtcctgacagaatccaatgtgtcttctgccttggcggagctcgccactaagaccttcggtagctccggatcgtcggccgttgatagcggcacggcgaccgcccttcctgacctggcctccgacgacggtgacaaaggatccgacgttgagtcgtactcctccatgcccccccttgaaggggagccgggggaccccgatctcagcgacgggtcttggtctaccgtgagtgaggaggctagtgaggatgtcgtctgctgctcaatgtcctatacgtggacaggcgccctgatcacgccatgcgctgcggaggaaagtaagctgcccatcaacccgttgagcaactctttgctgcgtcaccacaacatggtctacgccacaacatcccgcagcgcaagcctccggcagaagaaggtcacctttgacagattgcaagtcctggatgatcattaccgggacgtactcaaggagatgaaggcgaaggcgtccacagttaaggctaagcttctatctatagaggaggcctgcaagctgacgcccccacattcggccaaatccaaatttggctatggggcaaaggacgtccggaacctatccagcagggccgttaaccacatccgctccgtgtgggaggacttgctggaagacactgaaacaccaattgacaccaccatcatggcaaaaagtgaggttttctgcgtccaaccagagaagggaggccgcaagccagctcgccttatcgtattcccagacctgggagttcgtgtatgcgagaagatggccctttacgacgtggtctccacccttcctcaggccgtgatgggctcctcatacggatttcaatactcccccaagcagcgggtcgagttcctggtgaatacctggaaatcaaagaaatgccctatgggcttctcatatgacacccgctgttttgactcaacggtcactgagagtgacattcgtgttgaggagtcaatttaccaatgttgtgacttggcccccgaggccagacaggccataaggtcgctcacagagcggctttacatcgggggtcccctgactaactcaaaagggcagaactgcggttatcgccggtgccgcgcaagtggcgtgctgacgactagctgcggtaataccctcacatgttacttgaaggccactgcagcctgtcgagctgcaaagctccaggactgcacgatgctcgtgaacggagacgaccttgtcgttatctgtgaaagcgcgggaacccaggaggatgcggcggccctacgagccttcacggaggctatgactaggtattccgccccccccggggatccgccccaaccagaatacgacctggagctgataacatcatgttcctccaatgtgtcagtcgcgcacgatgcatctggcaaaagggtatactacctcacccgtgaccccaccaccccccttgcacgggctgcgtgggagacagctagacacactccaatcaactcttggctaggcaatatcatcatgtatgcgcccaccctatgggcaaggatgattctgatgactcactttttctccatccttctagctcaagagcaacttgaaaaagccctggattgtca

SEQ ID NO: 644 - DNA, 8781 bp, Hepatitis C Virus
ccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatcccaaaggctcgccaacccgagggcagggcctgggctcagcccgggtacccttggcccctctatggcaatgagggcttggggtgggcaggatggctcctgtcaccccgcggctcccggcctagttggggccccacggacccccggcgtaggtcgcgtaacttgggtaaggtcatcgatacccttacatgcggcttcgccgatctcatggggtacattccgctcgtcggcgcccccctagggggcgctgccagggccttggcacacggtgtccgggttctggaggacggcgtgaactatgcaacagggaacttgcccggttgctctttctctatcttcctcttggctctgctgtcctgtttgaccatcccaacttccgcttatgaagtgcgcaacgtgtccgggatatatcatgtcacgaacgactgctccaactcaagcattgtgtatgaggcagcggacgtgatcatgcatactcccgggtgcgtgccctgcgttcgggaggccgacagctcccgttgctgggtagcgctcactcccacgctcgcggccaggaatgccagcgtccccactacgacaatacgacgccatgtcgacttgctcgttgggacggctgctttctgctccgctatgtacgtgggggatctctgcggatctattttccttgtctcccagctgttcaccttctcgcctcgccggcatgagacagtgcaggactgcaactgctcaatctaccccggccatgtatcaggtcaccgcatggcttgggatatgatgatgaactggtcacctacaacagccctagtggtgtcgcagttgctccggatcccacaagctgtcgtggacatggtggcgggggcccactggggagtcctggcgggccttgcctactattccatggtagggaactgggctaaggttctgattgtggcgctactctttgccggcgttgacgggacgacctacacgtcggggggggtggccggccgcaccacctccgggttcacgtccctcttctcacctggggcgtctcagaaaatccagcttgtgaataccaacggcagctggcacatcaacaggactgccctaaattgcaatgactccctccacactgggttccttgccgcgctgttctacacacacaagttcaactcgtccgggtgcccggagcgcatggccagctgccgccccattgactggttcgtccagggatggggccccatcacctatactgagcctaacagctcggatcagaggccttattgctggcattacgcgcctcgaccgtgtggtatcgtacccgcgtcgcaggtgtgtggtccagtgtattgtttcaccccaagccctgttgtggtggggaccaccgatcgttccggtgcccctacgtatagctggggggagaatgagacagacgtgatgctcctcaacaacacgcgtccaccacaaggcaactggttcggctgtacatggatgaatagtactgggttcactaagacgtgcggaggccccccgtgtaacatcgggggggtcggtaaccgcaccttggtctgccccacggactgcttccggaagcaccccgaggctacttacacaaaatgtggctcggggccctggttgacacctaggtgcctagtagactacccatacaggctctggcactacccctgcactctcaatttttccatctttaaggttaggatgtatgtggggggcgtggagcacaggctcaatgccgcgtgcaattggactcgaggagagcgctgtaacttggaggacagggataggtcagaactcagcccgctgctgctgtctacaacagagtggcagatactgccctgtgccttcaccaccctaccggctttatccactggtttgatccatctccatcagaacatcgtggacgtgcaatacctgtacggtgtagggtcggcgtttgtctcctttgcaatcaaatgggagtacatcctgttgcttttccttctcctggcagacgcgcgcgtgtgtgcctgcttgtggatgatgctgctgatagcccaggctgaggccgccttagagaacttggtggtcctcaatgcggcgtccgtggccggagcgcatggtattctctccttccttgtgttcttctgtgccgcctggtacattaagggcaggctggttcctggggcggcgtatgctttctatggcgtatggccgctgctcctgctcctactggcgttaccaccacgagcttacgccttggaccgggagatggctgcatcgtgcgggagtgcggttcttgtaggtctggtattcttgaccttgtcaccatactacaaagtgtttctcactaggctcatatggtggttacaatactttatcaccagagccgaggcgcacatgcaagtgtgggtcccccccctcaacgttcggggaggccgcgatgccatcatcctcctcacgtgtgcggttcatccagagttaatttttgacatcaccaaactcctgctcgccatactcggcccgctcatggtgctccaagctggcataacgagagtgccgtacttcgtgcgcgctcaagggctcattcgtgcatgcatgttagtgcggagagtcgccgggggtcattatgtccaaatggccttcatgaagctgggcgcgctgacaggtacgtacgtttataaccatcttactccactgcgggactgggcccacgcgggcctacgagaccttgcggtggcggtagagcccgtcgtcttctccgacatggagaccaaggtcatcacctggggtgcagacaccgcagcgtgtggggacatcatcttgggtctacccgtctccgcccgaagggggaaggagatatttttgggaccggctgatagtctcgaaggccaagggtggcgactccttgcgcctatcacggcctactcccaacaaacgcggggcgtacttggttgcatcatcactagcctcacaggccgggacaagaaccaggtcgagggggaggttcaagtggtttctaccgcaacacactctttcctggcgacctgcatcaacggcgtgtgctggactgtctaccatggcgctggttcgaagaccctagccggtccaaaaggtccaatcacccaaatgtacaccaatgtagacctggacctcgtcggctggcaggcgccccccggggcgcgctccatgacaccatgcagctgtggcagctcggacctttacttggtcacgagacatgctgatgtcattccggtacgccggcgaggcgacagcaggggaagtctactctcccccaggcccgtctcctacctgaagggctcctcgggtggcccattgctttgcccttcggggcatgtcgtgggcgtcttccgggctgctgtgtgcacccggggggtcgcgaaggcggtggacttcatacccgttgagtctatggaaactaccatgcggtctccggtcttcacagacaactcatcccccccggctgtaccgcagacattccaagtggcacatctgcacgctcctactggcagcggcaagagcactaaagtgccggctgcgtatgcagcccaagggtacaaggtgctcgtcctgaacccgtccgttgccgccaccttagggtttggggcgtatatgtccaaggcacacggtatcgaccctaacatcagaactggggtaaggaccattaccacgggcggctccattacgtactccacctatggcaagttccttgccgatggtggctgctccgggggcgcctatgacatcataatatgtgatgagtgccactcaactgactcgactaccatcttgggcatcggcacagtcctggaccaagcggagacggctggagcgcggcttgtcgtgctcgccaccgctacacctccgggatcggttaccgtgccacacccaaatatcgaggaaataggcctgtccaacaatggagagatccccttctatggcaaagccatccccattgaggccatcaagggggggaggcatctcattttctgccattccaagaagaaatgtgacgaactcgccgcaaagctgacaggcctcggactcaatgctgtagcatattaccggggccttgatgtgtccgtcataccgcctatcggagacgtcgttgtcgtggcaacagacgctctaatgacgggtttcaccggcgattttgactcagtgatcgactgcaacacatgtgtcacccagacagtcgacttcagcttggatcccaccttcaccattgagacgacgaccgtgccccaagacgcggtgtcgcgctcgcagcggcgaggtagaactggcaggggtaggagtggcatctacaggtttgtgactccaggagaacggccctcgggcatgttcgactcttcggtcctgtgtgagtgctatgacgcgggctgtgcttggtatgaactcacgcccgctgagacctcggttaggttgcgggcttacctaaatacaccagggttgcccgtctgccaggaccatctggagttctgggagagcgtcttcacaggcctcacccacatagatgcccacttcctgtcccagactaaacaggcaggagacaactttccttacctggtggcatatcaagctacagtatgcgccagggctcaagctccacctccatcgtgggaccaaatgtggaagtgtctcatacggctgaaacctacactgcacggaccaacacccctgctgtataggctaggagccgtccaaaatgaggtcatcctcacacaccccataactaaatacatcatggcatgcatgtcggctgacctagaggtcgtcactagcacctgggtgctggtaggcggagtccttgcagctctggccgcatattgcctgacgacaggcagtgtggtcattgtgggcaggatcatcttgtccgggaagccagctgtcgttcccgacagggaagtcctctaccaggagttcgatgagatggaagagtgtgcctcacaacttccttacatcgagcagggaatgcagctcgccgagcaatttaagcaaaaggcgctcgggttgttgcaaacggccaccaagcaagcggaggctgctgctcctgtggtggagtccaagtggcgagcccttgagaccttctgggcgaagcacatgtggaatttcatcagcgggatacagtacctagcaggcttatccactctgcctggaaaccccgcgatagcatcattgatggcatttacagcttctatcactagcccgctcaccacccaacacaccctcctgtttaacatcttggggggatgggtggctgcccaactcgctcctcccagcgctgcgtcagctttcgtgggcgccggcatcgccggagcggctgttggcagcataggccttgggaaggtgctcgtggacatcttggcgggctatggggcaggggtagccggcgcactcgtggcctttaaggtcatgagcggcgaggtgccctccaccgaggacctggtcaacttactccctgccatcctctctcctggcgccctggtcgtcggggtcgtgtgcgcagcaatactgcgtcggcacgtgggcccgggagagggggctgtgcagtggatgaaccggctgatagcgttcgcttcgcggggtaaccacgtctcccccacgcactatgtgcctgagagcgacgctgcagcacgtgtcactcagatcctctctagccttaccatcactcaactgctgaagcggcttcaccaatggatcaatgaggactgctctacgccatgctccggctcgtggctaagggatgtttgggattggatatgcacggtgttgactgacttcaagacctggctccagtccaagctcctgccgcggttaccgggagtccctttcctgtcatgccaacgcgggtacaagggagtctggcggggggatggcatcatgcaaaccacctgcccatgtggagcacagatcgccggacatgtcaaaaacggttccatgaggatcgtagggcctagaacctgcagcaacacgtggcacggaacgttccccatcaacgcgtacaccacgggaccctgcacaccctccccggcgcccaactattccagggcgctatggcgggtggctgctgaggagtacgtggaggttacgcgtgtgggagatttccactacgtgacgggcatgaccactgacaacgtaaagtgcccatgccaggttccggcccccgaattcttcacggaggtggatggagtgcggttgcacaggtacgctccggcgtgcaaacccctcctacgggaggacgtcgcgttccaggtcgggctcaaccaatacttggtcgggtcgcagcttccatgcgagcccgaaccggacgtaacagtgcttacttccatgctcaccgacccctcccacattacagcagagacggctaagcgtaggctggctagagggtctcccccctccttagccagctcatcagctagccaattgtctgcgccttctttgaaggcgacatgcactacccaccatgactccccggacgctgacctcatcgaggccaacctcttgtggcggcaagagatgggcggaaacatcactcgcgtggagtcagagaataaggtagtaattctggactctttcgaaccgcttcacgcggatggggatgagagggagatatccgtcgcggcggagatcctgcgaaaatccaggaagttcccctcagcgttgcccatatgggcacgcccggactacaatcctccactgctagagtcctggaaggacccggactacgtccctccggtggtgcacggatgcccattgccacctaccaaggctcctccaataccacctccacggagaaagaggacggttgtcctgacagaatccaatgtgtcttctgccttggcggagctcgccactaagaccttcggtagctccggatcgtcggccgttgatagcggcacggcgaccgcccttcctgaccaggcctccgacgacggtgacaaaggatccgacgttgagtcgtactcctccatgccccctcttgaaggggagccgggggaccccgatctcagcgacgggtcttggtctaccgtgagtgaggaggctagtgaggacgtcgtctgctgctcaatgtcctatacgtggacaggcgctctgatcacgccatgcgctgcggaggaaagtaagctgcccatcaacccgttgagcaactctttgctgcgtcaccacaatatggtgtacgccacaacatcccgcagcgcaagcctccggcagaagaaggtcacctttgacagactgcaagtcctggacgaccattaccgggacgtgctcaaggagatgaaggcgaaggcgtccacagttaaggctaagcttctatctatagaggaggcctgcaagctgacgcccccacattcggccaaatccaaatttggctatggggcaaaggacgtccggaacctatccagcagggccgttaaccacatccgctccgtgtgggaggacttgctggaagacactgaaacaccaattgacaccaccatcatggcaaaaagtgaggttttctgcgtccaaccagagaaaggaggccgcaagccagctcgccttatcgtattcccagacctgggagttcgtgtatgcgagaagatggccctttacgacgtggtctccacccttcctcaggccgtgatgggctcctcatacgggtttcaatactcccccaagcagcgggtcgagttcctggtgaatacctggaaatcaaagaaatgccctatgggcttctcatatgacacccgctgctttgactcaacggtcactgagagtgacattcgtgttgaggagtcaatttaccaatgttgtgacttggcccccgaggccagacaggccataaggtcgctcacagagcggctttacatcgggggtcccctgactaactcaaaagggcagagctgcggttatcgccggtgccgcgcaagtggcgtgctgacgactagctgcggtaatacccttacatgttacttgaaggccactgcggcctgtcgagctgcaaagctccaggactgcacgatgctcgtgaacggagacgaccttgtcgttatctgtgaaagcgcgggaacccaggaggatgcggcggccctacgagccttcacggaggctatgactaggtactccgcccccccccggggatccgccccaaccagaatacgacctggagctgataacatcatgttcctccaatgtgtcagtcgcgcacgatgcatctggcaaaagggtatactacctcacccgtgaccccaccaccccccttgcacgggctgcgtgggagacagctagacacactccaatcaactcttggctaggcaatatcatcatgtatgcgcccaccctatgggcaaggatgattctgatgactcactttttctccatccttctagctcaagagcaacttgaaaaagccctggattgtca

SEQ ID NO: 645 - DNA, 8780 bp, Hepatitis C Virus
ccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacccgttgccgcgcaggggccccaggttgggtgtgcgcgcgactaggaaggcttccgagcggtcgcaacctcgtggaaggcgacaacctatcccaaaggctcgccgacccgagggcagggcctgggctcagcccgggtacccttggcccctctatggcaatgagggcctggggtgggcaggatggctcctgtcaccccgcggctcccggcctagttggggccccacggacccccggcgtaggtcgcgtaacttgggtaaggtcatcgatacccttacatgcggcttcgccgatctcatggggtacattccgctcgtcggcgcccccctagggggcgctgccagggccttggcacacggtgtccgggttctggaggacggcgtgaactatgcaacagggaacttgcccggttgctctttctctatcttcctcttggccctgctgtcctgtttgaccatcccagcttccgcttatgaagtgcgcaacgtgtccgggatataccatgtcacgaacgactgctccaactcaagcattgtgtatgaggcagcggacgtgatcatgcatactcccgggtgcgtgccctgtgttcaggagggtaacagctcccgttgctgggtagcgctcactcccacgctcgcggccaggaatgccagcgtccccactacgacaatacgacgccacgtcgacttgctcgttgggacggctgctttctgctccgctatgtacgtgggggatctctgcggatctattttcctcgtctcccagctgttcaccttctcgcctcgccggcatgagacagtgcaggactgcaactgctcaatctatcccggccatgtatcaggtcaccgcatggcttgggatatgatgatgaactggtcacctacaacagccctagtggtgtcgcagttgctccggatcccacaagctgtcgtggacatggtggcgggggcccactggggagtcctggcgggccttgcctactattccatggtagggaactgggctaaggttctgattgtggcgctactctttgccggcgttgacggggagacccacacgacggggagggtggtcggccacaccacctccgggttcacgtcccttttctcatctggggcgtctcagaaaatccagcttgtgaataccaacggcagctggcacatcaacaggactgccctaaattgcaatgactccctccaaactgggttctttgccgcgctgttttacgcacacaagttcaactcgtccgggtgcccggagcgcatggccaactgccgccccattgactggttcgcccaggggtggggccccatcacctatactaagcctaacagctcggatcagaggccttattgctggcattacgcgcctcgaccgtgtggtgtcgtacccgcgtcgcaggtgtgtggtccagtgtattgtttcaccccaagccctgttgtggtggggaccaccgatcgttccggtgtccctacgtatagctggggggagaatgagacagacgtgatgctcctcaacaacacgcgtccgccacaaggcaactggttcggctgtacatggatgaatagtactgggttcactaagacgtgcggaggccccccgtgtaacatcgggggggtcggtaaccgcaccttgatctgccccacggactgcttccggaagcaccccgaggctacttacacaaaatgtggctcggggccctggttgacacctaggtgcctagtagactacccatacaggctctggcactacccctgcactctcaatttttccatctttaaggttaggatgtatgtggggggcgtggagcacaggctcaatgccgcatgcaattggactcgaggagagcgctgtaacttggaggacagggataggtcagaactcagcccgctgctgctgtctacaacagagtggccgatactgccctgtgctttcaccaccctaccggctttatccactggtttgatccatctccatcagaacatcgtggacgtgcaatacctgtacggtgtagggtcagcgtttgtctcctttgcaatcaaatgggagtacatcctgttgcttttccttctcctggcagacgcgcgcgtgtgtgcctgcttgtggatgatgctgctgatagcccaggctgaggccgccttagagaacttggtggtcctcaatgcggcgtccgtggccggagcgcatggtattctctcctttcttgtgttcttctgcgccgcctggtacattaagggcaggctggctcctggggcggcgtatgctttttatggcgtatggccgctgctcctgctcctactggcgttaccaccacgagcttacgccttggaccgggagatggctgcatcgtgcgggggtgcggttcttgtaggtctggtattcttgaccttgtcaccatactacaaagtgtttctcactaggctcatatggtggttacaatactttatcaccagagccgaggcgcacatgcaagtgtgggtcccccccctcaacgttcggggaggccgcgatgccatcatcctcctcacgtgtgcggttcatccagagttaatttttgacatcaccaaactcctgctcgccatactcggcccgctcatggtgctccaggctggcataacgagagtgccgtacttcgtgcgcgctcaagggctcattcgtgcatgcatgttagtgcgaaaagtcgccgggggtcattatatccaaatggccttcatgaagctgggcgcgctgacaggtacgtacgtttataaccatcttaccccactgcgggactgggcccacgcgggcctacgagaccttgcggtggcggtagagcccgtcgtcttctccgccatggagaccaaggtcatcacctggggagcagacaccgctgcgtgtggggacatcatcttgggtctacccgtctccgcccgaagggggaaggagatatttctgggaccggctgatagtctcgaagggcaagggtggcgactccttgcgcccatcacggcctactcccaacaaacgcggggcgtacttggttgcgtcatcactagcctcacaggccgggacaagaaccaggtcgaaggggaggttcaagtggtttctaccgcaacacaatctttcctggcgacctgcatcaacggcgtgtgctggactgtctaccatggcgctggctcgaagaccctagccggtccaaaaggtccaatcacccaaatgtacaccaatgtagacctggacctcgtcggctggcaggcgccccccggggcgcgctccatgacaccatgcagctgtggcagctcggacctttacttggtcacgagacatgctgatgtcattccggtgcgccggcgaggcgacagcaggggaagtctactctcccccaggcccgtctcctacctgaagggctcctcgggtggtccattgctttgcccttcggggcacgtcgtgggcgtcttccgggctgctgtgtgcacccggggagtcgcgaaggcggtggacttcatacccgttgagtctatggaaactaccatgcggtccccggtcttcacagacaactcatcccccccggctgtaccgcagacattccaagtggcacatctgcacgctcctactggcagcggtaagagcactaaagtgccggctgcgtatgcagcccaagggtacaaggtgctcgtcctgaacccgtccgttgccgccaccttagggtttggggcgtatatgtccaaggcacacggtatcgaccctaacatcagaactggggtaaggaccattaccacgggcggctccattacgtactccacctatggcaagttccttgccgacggtggctgctctgggggcgcctatgacatcataatatgtgatgagtgccactcaactgactcgactaccatcttgggcatcggcacagtcctggaccaagcggagacggctggagcgcggcttgtcgtgctcgccaccgctacacctccgggatcggttaccgtgccacaccccaatatcgaggaaataggcctgtccaacaatggagagatccccttctatggcaaagccatccccattgaggccatcaagggggggaggcatctcattttctgccattccaagaagaaatgcgacgagctcgccgcaaagctgacaggcctcggactgaacgctgtagcatattaccggggccttgatgtgtccgtcataccgcctatcggagacgtcgttgtcgtggcaacagacgctctaatgacgggtttcaccggcgattttgactcagtgatcgactgcaatacatgtgtcacccagacagtcgacttcagcttggatcccaccttcaccattgagacgacgaccgtgccccaagacgcggtgtcgcgctcgcaacggcgaggtagaactggcaggggtaggagtggcatctacaggtttgtgactccaggagaacggccctcgggcatgttcgattcttcggtcctgtgtgagtgctatgacgcgggctgtgcttggtatgagctcacgcccgctgagacctcggttaggttgcgggcttacctaaatacaccagggttgcccgtctgccaggaccatctggagttctgggagagcgtcttcacaggcctcacccacatagatgcccacttcctgtcccagactaaacaggcaggagacaactttccttacctggtggcatatcaagctacagtgtgcgccagggctcaagctccacctccatcgtgggaccaaatgtggaagtgtctcatacggctgaaacctacactgcacgggccaacacccctgctgtataggctaggagccgtccaaaatgaggtcatcctcacacaccccataactaaatacatcatggcatgcatgtcggctgacctggaggtcgtcactagcacctgggtgctggtaggcggagtccttgcagctttggccgcatactgcctgacgacaggcagtgtggtcattgtgggcaggatcatcttgtccgggaagccagctgtcgttcccgacagggaagtcctctaccaggagttcgatgagatggaagagtgtgcctcacaacttccttacatcgagcagggaatgcagctcgccgagcaattcaagcaaaaggcgctcgggttgttgcaaacggccaccaagcaagcggaggctgctgctcccgtggtggagtccaagtggcgagcccttgagaccttctgggcgaagcacatgtggaatttcatcagcggaatacagtacctagcaggcttatccactctgcctggaaaccccgcgatagcatcattgatggcatttacagcttctatcactagcccgctcaccacccaacacaccctcctgtttaacatcttggggggatgggtggctgcccaactcgctcctcccagcgctgcgtcagctttcgtgggcgccggcatcgccggagcggctgttggcagcataggccttgggaaggtgctcgtggacatcttggcgggctatggggcaggggtagccggcgcactcgtggcctttaaggtcatgagcggcgaggtgccctccaccgaggacctggtcaacttactccctgccatcctctctcctggtgccctggtcgtcggggtcgtgtgcgcagcaatactgcgtcggcacgtgggcccgggagagggggctgtgcagtggatgaaccggctgatagcgttcgcttcgcggggtaaccacgtctcccccacgcactatgtgcctgagagcgacgctgcagcacgtgtcactcagatcctctctagccttaccatcactcaactgctgaagcggcttcaccagtggattaatgaggactgctctacgccatgctccggctcgtggctaagggatgtttgggattggatatgcacggtgttgactgacttcaagacttggctccagtccaagctcctgccgcggttaccgggagtccctttcctgtcatgccaacgcgggtacaagggagtctggcggggggacggcatcatgcaaaccacctgcccatgtggagcacagatcgccggacatgtcaaaaacggttccatgaggatcgtagggcctagaacctgcagcaacacgtggcacggaacgttccccatcaacgcatacaccacgggaccttgcacaccctccccggcgcccaactattccagggcgctatggcgggtggctgctgaggagtacgtggaggttacgcgtgtgggggatttccactacgtgacgggcatgaccactgacaacgtaaagtgcccatgccaggttccggcccccgaattcttcacggaggtggatggagtgcggttgcacaggtacgctccggcgtgcaaacctctcctacgggaggacgtcacgttccaggtcgggctcaaccaatacttggtcgggtcgcagctcccatgcgagcccgaaccggacgtaacagtgcttacttccatgctcaccgatccctcccacattacagcagagacggctaagcgtaggctggctagagggtcccccccctctttagccagctcatcagctagccagttgtctgcgccttctttgaaggcgacatgcactacccaccatgactccccggacgctgacctcatcgaggccaacctcttgtggcggcaggagatgggcggaaacatcactcgcgtggagtcagagaataaggtagtaattctggactctttcgaaccgcttcacgcggagggggatgagagggagatatccgtcgcggcggagatcctgcgaaaatccaggaagttcccctcagcgttgcccatatgggcacgcccggactacaatcctccactgctagagtcctggaaggacccggactacgtccctccggtggtacacggatgcccattgccacctaccaaggctcctccaataccacctccacggagaaagaggacggttgtcctgacagaatccaatgtgtcttctgccttggcggagctcgccactaagaccttcggtagctccggatcgtcggccgttgatagcggcacggcgaccgcccttcctgacctggcctccgacgacggtgacaaagggtccgacgttgagtcgtactcctccatgcccccccttgaaggggagccgggggaccccgatctcagcgacgggtcttggtctaccgtgagtgaggaggctagtgaggacgtcgtctgctgctcaatgtcctatacgtggacaggcgccctgatcacgccatgcgctgcggaggaaagtaagctgcccatcaacccgttgagcaactctttgctgcgtcaccacaacatggtctacgccacaacatcccgcagcgcaagcctccggcagaagaaggtcacctttgacagattgcaagtcctggatgaccattaccgggacgtgctcaaggagatgaaggcgaaggcgtccacagttaaggctaagcttctatctatagaggaggcctgcaagctgacgcccccacattcggccaaatccaaatttggctatggggcaaaggacgtccggaacctatccagcagggccgttaaccacatccgctccgtgtgggaggacttgctggaagacactgaaacaccaattgacaccaccatcatggcaaaaagtgaggttttctgcgtccaaccagagaagggaggccgcaagccagctcgccttatcgtattcccagacctgggagttcgtgtatgcgagaagatggccctttacgacgtggtctccacccttcctcaggccgtgatgggctcctcatacgggtttcaatactcccccaagcagcgggtcgagttcctggtgaatacctggaaatcaaagaaatgccctatgggcttctcatatgacacccgctgttttgactcaacggtcactgagagtgacattcgtgttgaggagtcaatttaccaatgttgtgacttggcccccgaggccagacaggccataaggtcgctcacagagcggctttacatcgggggtcccctgactaactcaaaagggcagaactgcggttatcgccggtgccgcgcaagtggcgtgctgacgactagctgcggtaataccctcacatgttacttgaaggccactgcggcctgtcgagctgcaaagctccaggactgcacgatgctcgtgaacggagacgaccttgtcgttatctgtgaaagcgcgggaacccaggaggatgcggcggccctacgagccttcacggaggctatgactaggtattccgccccccccggggatccgccccaaccagaatacgacctggagctgataacatcatgttcctccaatgtgtcagtcgcacacgatgcatctggcaaaagggtatactacctcacccgtgaccccaccaccccccttgcacgggctgcgtgggagacagctagacacactccaatcaactcttggctaggcaatatcatcatgtatgcgcccaccctatgggcaaggatgattctgatgactcactttttctccatccttctagctcaagagcaacttgaaaaagccctggattgtca

SEQ ID NO: 646 - DNA, 8780 bp, Hepatitis C Virus
ccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaaggcttccgagcggtcgcaacctcgtggaaggcgacaacctatcccaaaggctcgccgacccgagggcagggcctgggctcagcccgggtacccttggcccctctatggcaatgagggcctggggtgggcaggatggctcctgtcaccccgcggctcccggcctagttggggccccacggacccccggcgtaggtcgcgtaacttgggtaaggtcatcgatacccttacatgcggcttcgccgatctcatggggtacattccgctcgtcggcgcccccctagggggcgctgccagggccttggcacacggtgtccgggttctggaggacggcgtgaactatgcaacagggaacttgcccggttgctctttctctatcttcctcttggctctgctgtcctgtttgaccatcccagcttccgcttatgaagtgcgcaacgtgtccgggatataccatgtcacgaacgactgctccaactcaagcattgtgtatgaggcagcggacgtgatcatgcatactcccgggtgcgtgccctgtgttcgggagggtaacagctcccgttgctgggtggcgctcactcccacgctcgcggccaggaatgccagcgtccccactacgacaatacgacgccacgtcgacttgctcgttgggacggctgctttctgctccgctatgtacgtgggggatctctgcggatctattttcctcgtctcccagctgttcaccttctcgcctcgccggcatgcgacagtgcaggactgcaactgctcaatctatcccggccatgtatcaggtcaccgcatggcttgggatatgatgatgaactggtcacctacaacagccctagtggtgtcgcagttgctccggatcccacaagctgtcgtggacatggtggcgggggcccactggggagtcctggcgggccttgcctactattccatggtagggaactgggctaaggtcctgattgtggcgctactctttgccggcgttgacggggagacccacacgacggggagggtggtcggccacaccacctccgggttcacgtcccttttctcatctggggcgtctcagaaaatccagcttgtgaataccaacggcagctggcacatcaacaggactgccctaaattgcaatgactccctccaaactgggttctttgccgcgctgttttacgcacacaagttcaactcgtccgggtgcccggagcgcatggccagctgccgccccattgactggttcgcccaggggtggggccccatcacctatactaagcctaacagctcggatcagaggccttattgctggcattacgcgcctcgaccgtgtggtgtcgtacccgcgtcgcaggtgtgtggtccagtgtattgtttcaccccaagccctgttgtggtggggaccaccgatcgttccggtgcccctacgtatagctggggggaaaatgagacagacgtgatgctcctcaacaacacgcgtccgccacaaggcaactggttcggctgtacatggatgaatagtactgggttcactaagacgtgcggaggccccccgtgtaacatcgggggggtcggtaaccgcaccttgatctgccccacggactgcttccggaagcaccctgaggctacttacacaaaatgtggctcggggccctggttgacacctaggtgcctagtagactacccatacaggctctggcactacccctgcactgtcaatttttccatctttaaggttaggatgtatgtggggggcgtggagcacaggctcaatgccgcatgcaattggactcgaggagagcgctgtaacttggaggacagggataggtcagaactcagcccgctgctgctgtctacaacagagtggcagatactgccctgtgctttcaccaccctaccggctttatccactggtttgatccatctccatcagaacatcgtggacgtgcaatacctgtacggtgtagggtcagcgtttgtctcctttgcaatcaaatgggagtacatcctgttgcttttccttctcctggcagacgcgcgcgtgtgtgcctgcttgtggatgatgctgctgatagcccaggctgaggccgccttagagaacttggtggtcctcaatgcggcgtccgtggccggagcgcatggtatcctctcctttcttgtgttcttctgcgccgcctggtacattaagggcaggctggctcctggggcggcgtatgctttttatggcgtatggccgctgctcctgctcctactggcgttaccaccacgagcttacgccttggaccgggagatggctgcatcgtgcgggggtgcggttcttgtaggtctggtattcttgaccttgtcaccatactacaaagtgtttctcactaggctcatatggtggttacaatactttatcaccagagccgaggcgcacatgcaagtgtgggtcccccccctcaacgttcggggaggccgcgatgccatcatcctcctcacgtgtgcggttcatccagagttaatttttgacatcaccaaactcctgctcgccatactcggcccgctcatggtgctccaggctggcataacgagagtgccgtacttcgtgcgcgctcaagggctcattcgtgcatgcatgttagtgcggaaagttgccgggggtcattatatccaaatggccttcatgaagctgggcgcgctgacaggtacgtacgtttataaccatcttaccccactgcgggactgggcccacgcgggcctacgagaccttgcggtggcggtagagcccgtcgtcttctccgccatggagaccaaggtcatcacctggggagcagacaccgctgcgtgtggggacatcatcttgggtctacccgtctccgcccgaagggggaaggagatatttctgggaccggctgatagtctcgaagggcaagggtggcgactccttgcgtccatcacggcctactcccaacaaacgcggggcgtacttggttgcgtcatcactagcctcacaggccgggacaagaaccaggtcgaaggggaggttcaagtggtttctaccgcaacacaatctttcctggcgacctgcattaacggcgtgtgctggactgtctaccatggcgctggctcgaagaccctagccggtccaaaaggtccaatcacccaaatgtacaccaatgtagacctggacctcgtcggctggcaggcgccccccggggcgcgctccatgacaccatgcagctgtggcagctcggacctttacttggtcacgagacatgctgatgtcattccggtgcgccggcgaggcgacagcaggggaagtctactctcccccaggcccgtctcctacctgaagggctcctcgggtggtccattgctttgcccttcggggcacgtcgtgggcgtcttccgggctgctgtgtgcacccggggggtcgcgaaggcggtggacttcatacccgttgagtctatggaaactaccatgcggtccccggtcttcacagacaactcatcccccccggctgtaccgcagacattccaagtggcacatctgcacgctcctactggcagcggcaagagcactaaagtgccggctgcgtatgcagcccaagggtacaaggtgctcgtcctgaacccgtccgttgccgccaccttagggtttggggcgtatatgtccaaggcacacggtatcgaccctaacatcagaactggggtaaggaccattaccacgggcggctccattacgtactccacctatggcaagttccttgccgacggtggctgctctgggggcgcctatgacatcataatatgtgatgagtgccattcaactgactcgactaccatcttgggcatcggcacagtcctggaccaagcggagacggctggagcgcggcttgtcgtgctcgccaccgctacacctccgggatcggttaccgtgccacaccccaatatcgaggaaataggcctgtccaacaatggagagatccccttctatggcaaagccatccccattgaagccatcaagggggggaggcatctcattttctgccattccaagaagaaatgcgacgagctcgccgcaaagctgacaggcctcggactgaacgctgtagcatattaccggggccttgatgtgtccgtcataccgcctatcggagacgtcgttgtcgtggcaacagacgctctaatgacgggtttcaccggcgattttgactcagtgatcgactgcaatacatgtgtcacccagacagtcgacttcagcttggatcccaccttcaccattgagacgacgaccgtgccccaagacgcggtgtcgcgctcgcaacggcgaggtagaactggcaggggtaggagtggcatctacaggtttgtgactccaggagaacggccctcgggcatgttcgattcttcggtcctgtgtgagtgctatgacgcgggctgtgcttggtatgagctcacgcccgctgagacctcggttaggttgcgggcttacctaaatacaccagggttgcccgtctgccaggaccatctggagttctgggagagcgtcttcacaggcctcacccacatagatgcccacttcctgtcccagactaaacaggcaggagacaactttccttacctggtggcatatcaagctacagtgtgcgccagggctcaagctccacctccatcgtgggaccaaatgtggaagtgtctcatacggctgaaacctacactgcacgggccaacacccctgctgtataggctaggagccgtccaaaatgaggtcatcctcacacaccccataactaaatacatcatggcatgcatgtcggctgacctggaggtcgtcactagcacctgggtgctggtaggcggagtccttgcagctttggccgcatactgcctgacgacaggcagtgtggtcattgtgggcaggatcatcttgtccgggaagccagctgtcgttcccgacagggaagtcctctaccaggagttcgatgagatggaagagtgtgcctcacaacttccttacatcgagcagggaatgcagctcgccgagcaattcaagcaaaaggcgctcgggttgttgcaaacggccaccaagcaagcggaggctgctgctcccgtggtggagtccaagtggcgagcccttgagaccttctgggcgaagcacatgtggaatttcatcagcggaatacagtacctagcaggcttatccactctgcctggaaaccccgcgatagcatcattgatggcttttacagcttctatcactagcccgctcaccacccaacacaccctcctgtttaacatcttggggggatgggtggctgcccaactcgctcctcccagcgctgcgtcagctttcgtgggcgccggcatcgccggagcggctgttggcagcataggccttgggaaggtgctcgtggacatcttggcgggctatggggcaggggtagccggcgcactcgtggcctttaaggtcatgagcggcgaggtgccctccaccgaggacctggtcaacttactccctgccatcctctctcctggtgccctggtcgtcggggtcgtgtgcgcagcaatactgcgtcggcacgtgggcccgggagagggggctgtgcagtggatgaaccggctgatagcgttcgcttcgcggggtaaccacgtctcccccacgcactatgtgcctgagagcgacgctgcagcacgtgtcactcagatcctctctagccttaccatcactcaactgctgaagcggcttcaccagtggattaatgaggactgctctacgccatgctccggctcgtggctaagggatgtttgggattggatatgcacggtgttgactgacttcaagacctggctccagtccaagctcctgccgcggttaccgggagtccctttcctgtcatgccaacgcgggtacaagggagtctggcggggggacggcatcatgcaaaccacctgcccatgtggagcacagatcgccggacatgtcaaaaacggttccatgaggatcgtagggcctagaacctgcagcaacacgtggcacggaacgttccccatcaacgcatacaccacgggaccttgcacaccctccccggcgcccaactattccagggcgctatggcgggtggctgctgaggagtacgtggaggttacgcgtgtgggggatttccactacgtgacgggcgtgaccactgacaacgtaaagtgcccatgccaggttccggcccccgaattcttcacggaggtggatggagtgcggttgcacaggtacgctccggcgtgcaaacctctcctacgggaggacgtcacgttccaggtcgggctcaaccaatacttggtcgggtcgcagctcccatgcgagcccgaaccggacgtaacagtgcttacttccatgctcaccgatccctcccacattacagcagagacggctaagcgtaggctggctagagggtcccccccctctttagccagctcatcagctagccagttgtctgcgccttctttgaaggcgacatgcactacccaccatgactccccggacgctgacctcatcgaggccaacctcttgtggcggcaggagatgggcggaaacatcactcgcgtggagtcagagaataaggtagtaattctggactctttcgaaccgcttcacgcggagggggacgagagggagatatccgtcgcggcggagatcctgcgaaaatccaggaagttcccctcagcgttgcccatatgggcacgcccggactacaatcctccactgctagagtcctggaaggacccggactacgtccctccggtggtacacggatgcccattgccacctaccaaggctcctccaataccacctccacgaagaaagaggacggttgtcctgacagaatccaatgtgtcttctgccttggcggagctcgccactaagaccttcggtagctccggatcgtcggccgttgatagcggcacggcgaccgcccttcctgacctggcctccgacgacggtgacaaagggtccgacgttgagtcgtactcctccatgcccccccttgaaggggagccgggggaccccgatctcagcgacgggtcttggtctaccgtgagtgaggaggctagtgaggacgtcgtctgctgctcaatgtcctatacgtggacaggcgccctgatcacgccatgcgctgcggaggaaagtaagctgcccatcaacccgttgagcaactctttgctgcgtcaccacaacatggtctacgccacaacatcccgcagcgcaagcctccggcagaagaaggtcacctttgacagattgcaagtcctggatgaccattaccgggacgtgctcaaggagatgaaggcgaaggcgtccacagttaaggctaagcttctatctatagaggaggcctgcaagctgacgcccccacattcggccaaatccaaatttggctatggggcaaaggacgtccggaacctatccagcagggccgttaaccacatccgctccgtgtgggaggacttgctggaagacactgaaacaccaattgacaccaccatcatggcaaaaagtgaggttttctgcgtccaaccagagaagggaggccgcaagccagctcgccttatcgtattcccagacctgggagttcgtgtatgcgagaagatggccctttacgacgtggtctccacccttcctcaggccgtgatgggctcctcatacgggtttcaatactcccccaagcagcgggtcgagttcctggtgaatacctggaaatcaaagaaatgccctatgggcttctcatatgacacccgctgttttgactcaacggtcactgagagtgacattcgtgttgaggagtcaatttaccaatgttgtgacttggcccccgaggccagacaggccataaggtcgctcacagagcggctttacatcgggggtcccctgactaactcaaaagggcagaactgcggttatcgccggtgccgcgcaagtggcgtgctgacgactagctgcggtaataccctcacatgttacttgaaggccactgcggcctgtcgagctgcaaagctccaggactgcacgatgctcgtgaacggagacgaccttgtcgttatctgtgaaagcgcgggaacccaggaggatgcggcggccctacgagtcttcacggaggctatgactaggtattccgccccccccggggatccgccccaaccagaatacgacctggagctgataacatcatgttcctccaatgtgtcagtcgcacacgatgcatctggcaaaagggtatactacctcacccgtgaccccaccaccccccttgcacgggctgcgtgggagacagctagacacactccaatcaactcttggctaggcaatatcatcatgtatgcgcccaccctatgggcaaggatgattctgatgactcactttttctccatccttctagctcaagagcaacttgaaaaagccctggattgtca

SEQ ID NO: 647 - DNA, 8780 bp, Hepatitis C Virus
ccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatcccaaaggctcgccaacccgagggcagggcctgggctcagcccgggtacccttggcccctctatggcaatgagggcttggggtgggcaggatggctcctgtcaccccgcggctcccggcctagttggggccccacggacccccggcgtaggtcgcgtaacttgggtaaggtcatcgatacccttacatgcggcttcgccgatctcatggggtacattccgctcgtcggcgcccccctagggggcgctgccagggccttggcacacggtgtccgggttctggaggacggcgtgaactatgcaacagggaacttgcccggttgctctttttctatcttcctcttggctctgctgtcctgtttgaccatcccagcttccgcttatgaagtgcacaacgtgtccgggatataccatgtcacgaacgactgctccaactcaagcattgtgtatgaggcagcggacgtgatcatgcatactcccgggtgcgtgccctgcgttcgggaggccgacagctcccgttgctgggtagcgctcactcccacgctcgcggccaggaatgccagcgtccccactacgacaatacgacgccatgtcgacttgctcgttgggacggctgctttctgctccgctatgtacgtgggggatctctgcggatctattttcctcgtctcccagctgttcaccttctcgcctcgccggcatgagacagtgcaggactgcaactgctcaatctatcccggccatgtatcaggtcaccgcatggcttgggatatgatgatgaactggtcacctacaacagccctagtggtgtcgcagttgctccggatcccacaagctgtcgtggacatggtggcgggggcccactggggagtcctggcgggccttgcctactattccatggtagggaactgggctaaggttctgattgtggcgctactctttaccggcgttgacgggacgacctacacgtcggggggggcggccggccgcaccacctccgggttcacgtccctcttctcatctggggcgtctcagaaaatccagcttgtgaataccaacggcagctggcacatcaacaggactgccctaaattgcaatgactccctccacactgggttccttgccgcgctgttctacacgcacaagttcaactcgtccgggtgcccggagcgcatggccagctgccgccccattgactggttcgtccagggatggggccccatcacctatactgagcctaacagctcggatcagaggccttattgctggcattacgcgcctcgaccgtgtggtatcgtacccgcgtcgcaggtgtgtggtccagtgtattgtttcaccccaagccctgttgtggtggggaccaccgatcgttccggtgtccctacgtatagctggggggagaatgagacagacgtgatgctcctcaacaacacgcgtccgccacaaggcaactggttcggctgtacatggatgaatagtactgggttcactaagacgtgcggaggccccccgtgtaacatcgggggggtcggtaaccgcaccttgatctgccccacggactgcttccggaagcaccccgaggctacttacacaaaatgtggctcggggccctggttgacacctaggtgcctagtagactacccatacaggctctggcactacccctgcactctcaatttttccatctttaaggttaggatgtatgtggggggcgtggagcacaggctcaatgccgcatgcaattggactcgaggagagcgctgtaacttggaggacagggacaggtcagaactcagcccgctgctgctgtctacaacagagtggcagatactgccctgtgccttcaccaccctaccggctttatccactggtttgatccatctccatcagaacatcgtggacgtgcaatacctgtacggtgtagggtcagcgtttgtctcctttgcaatcaaatgggagtacatcctgttgcttttccttctcctggcagacgcgcgcgtgtgtgcctgcttgtggatgatgctgctgatagcccaggctgaggccgccttagagaacttggtggtcctcaatgcggcgtccgtggccggagcgcatggtattctctccttccttgtgttcttctgtgccgcctggtacattaagggcaggctggctcctggggcggcgtatgctttctatggcgtatggccgctgctcctgctcctactggcgttaccaccacgagcttacgccttggaccgggagatggctgcatcgtgcgggggtgcggttcttgtaggtctggtattcttgaccttgtcaccatactacaaagtgtttctcactaggctcatatggtggttacaatactttatcaccagagccgaggcccacatgcaagtgtgggtcccccccctcaacgttcggggaggccgcgatgccatcatcctcctcacgtgtgcggttcatccagagttaatttttgacatcaccaaactcctgctcgccatactcggcccgctcatggtgctccaggctggcataacgagagtgccgtacttcgtgcgcgctcaagggctcattcgtgcatgcatgttagtgcggaaagtcgccgggggtcattatgtccaaatggccttcatgaagctgggcgcgctgacaggtacgtacgtttataaccatcttactccactgcgggactgggcccacgcgggcctacgagaccttgcggtggcggtagagcccgtcgtcttctccgacatggagaccaaggtcatcacctggggtgcagacaccgcagcgtgtggggacatcatcttgggtctacccgtctccgcccgaagggggaaggagatatttttggggccggctgatagtctcgaagggcaagggtggcgactccttgcgcccatcacgacctactcccaacaaacgcggggcgtacttggttgcatcatcactagcctcacaggccgggacaagaaccaggtcgagggggaagttcaagtggtttctaccgcaacacactctttcctggcgacctgcatcaacggcgtgtgctggactgtctaccatggcgctggctcgaagaccctagccggtccaaaaggtccaatcacccaaatgtacaccaatgtagacctggacctcgtcggctggcaggcgccccccggggcgcgctccatgacaccatgcagctgtggcagctcggacctttacttggtcacgagacatgctgatgtcattccggtacgccggcgaggcgacagcaggggaagtctactctcccccaggcccgtctcctacctgaagggctcctcgggtggcccattgctttgcccttcggggcatgtcgtgggcgtcttccgggctgctgtgtgcacccggggggtcgcgaaggcggtggacttcatacccgttgagtctatggaaactaccatgcggtctccggtcttcacagacaactcatcccccccggctgtaccgcagacattccaagtggtacatctgcacgctcctactggcagcggcaagagcactaaagtgccggctgcgtatgcagcccaagggtacaaggtgctcgtcctgaacccgtccgttgccgccaccttagggtttggggcgtatatgtccaaggcacacggtatcgaccctaacatcagaactggggtaaggaccattaccacgggcggctccattacgtactccacctatggcaagttccttgccgatggtggctgctccgggggcgcctatgacatcataatatgtgatgagtgccactcaactgactcgactaccatcttgggcatcggcacagtcctggaccaagcggagacggctggagcgcggcttgtcgtgctcgccaccgctacacctccgggatcggttaccgtgccacaccccaatatcgaggaaataggcctgtccaacaatggagagatccccttctatggcaaagccatccccattgaggccatcaagggggggaggcatctcattttctgccattccaagaagaaatgtgacgaactcgccgcaaagctgacaggcctcggactcaatgctgtagcatattaccggggccttgatgtgtccgtcataccgcctatcggagacgtcgttgtcgtggcaacagacgctctaatgacgggtttcaccggcgattttgactcagtgatcgactgcaacacatgtgtcacccagacagtcgacttcagcttggatcccaccttcaccattgagacgacgaccgtgccccaagacgcggtgtcgcgctcgcagcggcgaggtagaactggcaggggtaggagtggcatctacaggtttgtgtctccaggagaacggccctcgggcatgttcgactcttcggtcctgtgtgagtgctatgacgcgggctgtgcttggtatgagctcacgcccgctgagacctcggttaggttgcgggcttacctaaatacaccagggttgcccgtctgccaggaccatctggagttctgggagagcgtcttcacaggcctcacccacatagatgcccacttcctgtcccagactaaacaggcaggagacaactttccttacctggtggcatatcaagctacagtatgcgccagggctcaagctccacctccatcgtgggaccaaatgtggaagtgtctcatacggctgaaacctacactgcacgggccaacacccctgctgtataggctaggagccgtccaaaatgaggtcatcctcacacaccccataactaaatacatcatggcatgcatgtcggctgacctagaggtcgtcactagcacctgggtgctggtaggcggagtccttgcagctctggccgcatattgcctgacgacaggcagtgtggtcattgtgggcaggatcatcttgtccgggaagccagctgtcgttcccgacagggaagtcctataccaggagttcgatgagatggaagagtgtgcctcacaacttccttacatcgagcagggaatgcagctcgccgagcaatttaagcaaaaggcgctcgggttgttgcaaacggccaccaagcaagcggaggctgctgctcctgtggtggagtccaagtggcgagcccttgagaccttctgggcgaagcacatgtggaatttcatcagcgggatacagtacctagcaggcttatccactctgcctggaaaccccgcgatagcatcattgatggcatttacagcttctatcactagcccgctcaccacccaaaacaccctcctgtttaacatcttggggggatgggtggctgcccaactcgctcctcccagcgctgcgtcagctttcgtgggcgccggcatcgccggagcggctgttggcagcataggccttgggaaggtgctcgtggacatcttggcgggctatggggcaggggtagccggcgcactcgtggcctttaaggtcatgagcggcgaggtgccctccaccgaggacctggtcaacttacttcctgccatcctctctcctggtgccctggtcgtcggggtcgtgtgcgcagcaatactgcgtcggcacgtgggcccgggagagggggctgtgcagtggatgaaccggctgatagcgttcgcttcgcggggtaaccacgtctcccccacgcactatgtgcctgagagcgacgctgcagcgcgtgtcactcagatcctctctagccttaccatcactcaactgctgaagcggcttcaccaatggatcaatgaggactgctctacgccatgctccggctcgtggctaagggatgtttgggattggatatgcacggtgttgactgacttcaagacctggctccagtccaagctcctgccgcggttaccgggagtccctttcctgtcatgccaacgcgggtacaagggagtctggcggggggatggcatcatgcaaaccacctgcccatgtggagcacagatcgccggacatgtcaaaaacggttccatgaggatcgtagggcctagaacctgcagcaacacgtggcacggaacattccccatcaacgcgtacaccacgggaccctgcacaccctccccggcgcccaactattccagggcgctatggcgggtggctgctgaggagtacgtggaggttacgcgtgtgggagatttccactacgtgacgggcataaccactgacaacgtaaagtgcccatgccaggttccggcccccgaattcttcacggaggtggatggagtgcggttgcacaggtacgctccggcgtgcaaacccctcctacgggaggacgtcgcgttccaggtcgggctcaaccaatacttggtcgggtcgcagcttccatgcgagcccgaaccggacgtaacagtgcttacttccatgctcaccgacccctcccacattacagcagagacggctaagcgtaggctggctagagggtctcccccctccttagccagctcatcagctagccagttgtctgcgccttctttgaaggcgacatgcactacccaccatgactccccggacgctgacctcatcgaggccaacctcttgtggcggcaggagatgggcggaaacatcactcgcgtggagtcagagaataaggtagtaattctggactctttcgaaccgcttcacgcggatggggatgagagggagatatccgtcgcggcggagatcctgcgaaaatccaggaagttcccctcagcgttgcccatatgggcacgcccggactacaatcctccactgctagagtcctggaaggacccggactacgtccctccggtggtgcacggatgcccattgccacctaccaaggctcctccaataccacctccacggagaaagaggacggttgtcctgacagaatccaatgtgtcttctgccttggcggagctcgccactaagaccttcggtagctccggatcgtcggccgttgatagcggcacggcgaccgcccttcctgaccaggcctccgacgacggtgacaaaggatccgacgttgagtcgtactcctccatgccccctcttgaaggggagccgggggaccccgatctcagcgacgggtcttggtctaccgtgagtgaggaggctagtgaggacgtcgtctgctgctcaatgtcctatacgtggacaggcgctctgatcacgccatgcgctgcggaagaaagtaagctgcccatcaacccgttgagcaactctttgctgcgtcaccacaacatggtgtacgccacaacatcccgcagcgcaagcctccggcagaagaaggtcacctttgacagactgcaagtcctggacgaccattaccgggacgtgctcaaggagatgaaggcgaaggcgtccacagttaaggctaagcttctatctatagaggaggcctgcaaactgacgcccccacattcggccaaatccaaatttggctatggggcaaaggacgtccggaacctatccagcagggccgttaaccacatccgctccgtgtgggaggacttgctggaagacactgaaacaccaattgacaccaccatcatggcaaaaagtgaggttttctgcgtccaaccagagaaaggaggccgcaagccagctcgccttatcgtattcccagacctgggagttcgtgtatgcgagaagatggccctttacgacgtggtctccacccttcctcaggccgtgatgggctcctcatacgggtttcaatactcccccaagcagcgggtcgagttcctggtgaatacctggaaatcaaagaaatgccctatgggcttctcatatgacacccgctgttttgactcaacggtcactgagagtgacattcgtgttgaggagtcaatttaccaatgttgtgacttggcccccgaggccagacaggccataaggtcgctcacagagcggctttacatcgggggtcccctgaccaactcaaaagggcagaactgcggttatcgccggtgccgcgcaagtggcgtgctgacgactagctgcggtaataccctcacatgttacttgaaggccactgcggcctgtcgagctgcaaagctccaggactgcacgatgctcgtgaacggagacgaccttgtcgttatctgtgaaagcgcgggaacccaggaggatgcggcggccctacgagccttcacggaggctatgactaggtactccgccccccccggggatccgccccaaccagaatacgacctggagctgataacatcatgttcctccaatgtgtcagtcgcgcacgatgcatccggcaaaagggtatactacctcacccgtgaccccaccaccccccttgcacgggctgcgtgggagacagctagacacactccaatcaactcttggctaggcaatatcatcatgtatgcgcccaccctatgggcaaggatgattctgatgactcactttttctccatccttctagctcaagagcaacttgaaaaagccctggattgtca

SEQ ID NO: 648 - DNA, 9408 bp, Hepatitis C Virus
atgagtgtcgaacagcctccaggaccccccctcccgggagagccatagtggtctgcggaaccggtgagtacaccggaattgccgggatgaccgggtcctttcttggataaacccgctcaatgcccggagatttgggcgtgcccccgcgagactgctagccgagtagtgttgggtcgcgaaaggccttgtggtactgcctgatagggtgcttgcgagtgccccgggaggtctcgtagaccgtgcaacatgagcacgaatcctaaacctcaaagaaaaaccaaaagaaacaccaaccgccgcccacaggacgtcaagttcccgggcggtggtcagatcgttggtggagtttacttgttgccgcgcaggggccctaggttgggtgtgcgcgcaactcggaagacttcagaacggtcgcaaccccgtggacggcgtcagcctatccccaaggcgcgccagcccacgggccggtcctggggtcaacccgggtacccttggcccctttatgccaatgagggcctcgggtgggcagggtggttgctctccccccgaggctctcggcctaattggggccccaatgacccccggcggaaatcgcgcaacttgggtaaggtcatcgataccctgacgtgcggattcgccgacctcatggggtacatcccgctcgtaggcggccccgttgggggcgtcgcaagggctctcgcacacggtgtgagggtccttgaggacggggtaaactatgcaacagggaatttacccggttgctctttctctatctttatccttgcacttctttcatgcctgactgtcccgacctctgccgttccctaccgaaatgcctctggggtttatcatgtcaccaatgattgcccaaactcytccatcgtctatgaggctgaagacctgatcttacacgcacctggttgcgtgccctgtgttaggcagggtaatgtcagtaggtgctgggtccagatcacccccacactgtcagccccgagcctcggagcggtcacggctcctcttcggagggccgttgactacttagcggggggggctgccctttgctccgcgttatacgtcggagacgcgtgcggggcagtgtttttggtaggtcaaatgttcacctatagccctcgccggcataatgttgtgcaggactgcaactgttccatttacagtggccatatcaccggccaccggatggcatgggacatgatgatgaattggtcacctacaacagctttggtgatggcccagttgttacggattccccaggtggtcattgacatcattgccggggcccactggggggtcttgttcgccgccgcatactacgcgtcggcggctaactgggccaaggttgtgctggtcctgtttctgtttgcgggggtcgatgccaacacccgcactgtgggtggtagtgcggcccaaggcgcgcgcgggctcgcttcacttttcacccctgggccgcagcagaacttgcagctcataaataccaacgggagctggcacatcaacagaactgcccttaactgtaatgacagcctccagactgggtttgtagccggcctcctgtattatcacaagttcaactccactgggtgtccgcagcggatggctagctgtaggcccctcgccgcattcgaccagggctggggaactatcagctatgccgccgtgtcgggccccagtgatgacaagccctattgctggcactaccccccacgcccgtgcggaatagtgccagcccgaggtgtctgcggtccggtctattgttttacacctagcccggtggtcgtcggcaccacagaccgcaaggggaatcccacttacagttggggcgaaaatgagactgacatctttctcttgaacaacacgaggccccctactggcaactggtttggctgcacctggatgaattccacagggtttgtcaagacttgcggggctccaccctgcaacttagggcctacaggcaacaatagccttaagtgtcctactgattgcttccgcaagcacccagacgccacctacaccaagtgtgggtcaggaccctggctcactccccggtgtctggtgcattacccttaccggttgtggcattacccgtgcaccctaaattataccatcttcaaggtgcgcatgtacattgggggcctcgagcacaggctcgaggtggcatgcaactggacccgtggtgagcggtgtgatcttgaagacagagacagggccgagctgagcccgctcctacataccaccacgcagtgggccatattgccgtgctctttcacacccacacccgctcttagcactggtctcatacacttacaccaaaatatagtagacacccagtatctttacggtctgagctccagcatcgtctcgtgggccgttaagtgggagtacatagtgctggccttcttattacttgctgatgcccgtatttgtacttgcctatggatcatgctcctggtttgtcaggctgaagcagccctggagaacgtcattgtcctaaacgcggctgcggctgcggggactcatgggtttttctggggcctgctcgtcatctgcttcgcctggcacttcaagggcaggttggtccctggggccacctacctttgcttgggcatttggccattactcttactccttttcctcctgccccaaagggctttagccctggactcaagcgatggcgggactgtgggttgtcttgtgttaaccatccttacaatcttcacactcacccccgggtacaagaagatggtagtgttggtcatatggtggcttcagtatttcatagcccgggtagaggcctttatccatgtgtgggtgcccccgttgcaggttaggggtggtcgtgatgctattatcatgctcacatgccttttccatcctgccctggggtttgaggtcacaaaaatcctcctcgggatactaggtcctttgtacctgctgcagtactcgctcatcaagctgccttatttcatcagggcgcgcgccctgctgagggcgtgcctgctagcgaagcacttggcctgtggcaggtacgtgcaggcggccttgctccaccttggtaggctgaccggaacgtacatttatgaccaccttgcccccatgaaggattgggcagcgtccgggctgcgcgacttagcagtggccacggagcccatcatattctcccctatggagacgaaggtcatcacgtggggggctgacacggccgcatgtggggacatacttgccggcctycctgtatcagctaggcgaggccatgaaatcttcytggggccagccgatgacatcagagaggcgggctggcgacttctcgcccctatcaccgcgtatgcgcagcagacgcgaggggtgctgggcgctataatcgtcagcctaaccggccgggacaaaaatgaagccgagggggaggtgcaggtcctatccacggcaacacaaacattccttggtacttgcatcaatggggtgatgtggacagtcttccacggggccggcgctaagacccttgcgggccccaaaggcccagtggtgcaaatgtacactaatgtagacaaagatctggtgggatggcctaccccccccggaacgcgctcgctcactccgtgcacttgcggatcggcggacctgtacctggttaccaggcatgcagacgtcgttccagctcgtagacggggcgacactcgtgcctccctgctcagcccgagacccatcagctatctcaagggttcatcgggcggcccggtcatgtgcccttccgggcacgtggtgggtgttttcagggctgccgtgtgcacgcggggtgtcgcgaaggcgctcgatttcattccggttgaaaacctggaaaccacgatgcgctcgcccgtgttcactgacaacagcacaccccccgcggtccctcacgagttccaagtgggacacctccatgcgcctaccgggagcgggaagagcacgaaggtacccgctgcttacgcggcccaagggtacaaggtgctggtgctaaatccatctgtcgcggcgacgctcgggttcggggcatacatgtcaagagcttatggcgtggaccccaacatcaggaccggagttaggactgtcaccaccggagctgctatcacatactctacttacggcaagttcctcgctgacggggggtgttcagggggcgcgtatgatgtaatcatatgcgacgagtgccattcccaggatgctaccaccatccttgggataggcacagtcctcgaccaggcagagacggctggagccaggctcgtcgtcttggccacggccactccccccggcagtgtgacaacgccccaccccaacatcgaggaggtggccctgccttcggagggggaaatccccttctacggcagagctatcccccttgctctcattaagggcggtaggcatctcatcttctgccactctaagaaaaagtgtgatgaacttgccaagcaattgactagccaaggcgtcaacgccgtggcatactacagaggactagacgtcgccgtcatacccgcgacaggagatgtggtcgtgtgcagcacggacgcgctcatgacggggtttaccggcgactttgattctgtcatagactgcaacaccaccgtcacgcagacggtggatttcagtctggatcccacctttaccattgagactaccacggtgccccaggacgcagtgtccagaagccaacgtaggggtcgcacgggaagaggtaggcacggcatatatcggtatgtctcgtctggggagagaccgtctggcattttcgactccgttgtgctctgtgagtgctacgatgccggatgtgcatggtatgatctgacccctgcagagactaccgtgaggttgcgtgcttacctgaacacccccggactccctgtctgtcaagaccacctggaattttgggagggggtgttcacagggctcactaacatcgacgcccacatgctgtcacagactaaacagggtggggagaacttcccataccttgtagcgtaccaagcaacagtctgtgtccgcgcgaaagcgcccccccccagctgggacacaatgtggaagtgcatgctccgtcttaagccgaccctgactggccccacccccctcctgtacaggctgggggccgtccagaatgagatcacattgacgcaccccatcaccaagtacattatggcttgcatgtccgcggacttggaggtcattaccagcacgtgggttctggtggggggtgtcgtggcggccttagcggcctactgcttgacggtgggctcggtggccatagtcggyagaatcatcctatctgggagacctgccatcattcccgacagggaggtgttgtaccaacaatttgatgagatggaggagtgttcggcctcgttgccctacatggacgaggcacgtgctattgccgagcaattcaaggagaaagtgcttggcctcattggcacggccggtcagaaagctgagactctgaaaccggcagccacgtccatgtggaacagggctgagcagttctgggcaaaacacatgtggaactttgtcagtgggatccaatacttggccggtctttcaaccttgccgggcaatcctgccgtggccactttgatgtctttcaccgccgcggtaacctccccccttacaactcaacagaccctcctctttaatattctaggagggtgggtggcctcgcagatcgcgccacccacggccgccactgcgttcgtcgttagtgggatggccggggccgcggtcggcagcatcgggctgggtagggtcctcattgacatcttggctggatatggggcaggagtggctggagcgctcgtcgccttcaagatcatgtgcggggagaagccgacagccgaagacctagtaaacctcctgccttcaatactctgccctggagccctagtggtcggggtcatatgcgccgcggttttgcggcgccatatcggcccgggcgagggggccgtgcagtggatgaacaggctgatcgcgttcgcctcccgaggcaatcatgtgtctccgacacactacgtgcccgagaccgacgcgtcggccaaagtcacacagctgctcagctccctcacagtaacatcccttttgaagaggctccacacatggatcggcgaggactactccacgccctgcgatggcacatggctaagggccatttgggactgggtctgcacggcactgacagacttcaaagcctggctgcaggcaaaactcctcccacaactccccggagtgcccttcctctcgtgccagagagggtacaggggcgtatggcgtggggatggagtaaattccaccaagtgtccgtgcggagcgacgatatctggccacgtgaaaaacggaaccatgaggatcgtcggcccgaagctgtgcagcaacacctggcacggaaccttccccatcaacgccacaacaacggggcccagtgtgcctgctccggcccccaactacaaatttgccttgtggagggtaggcgctgcggactacgccgaggtgcgccgcgtgggggactaccattacattacgggagtgacacaggacaatctgaagtgtccctgtcaggtaccatctccagagttcttcacggagctggacggcgtgaggattcaccgctacgcgccaccctgcaaccccctcctaagggaggaggtctgcttctccgtggggctgcactcctttgtggtggggtcccaactaccctgtgagccagaacctgatgtgaccgtcctaacgtcaatgctgtcagaccctgctcacatcacggcagagacggccaagcgcaggctagatcgagggtctccgccctctctagctagctcctcggccagccaactctcggccccctcccttaaggctacttgcactacacaaggtcaccatccagacgcagacctcatagaggctaatctgctatggagacagtgcatgggaggtaacatcacgcgagtggaagccgagaacaaggtcgtgatccttgactcctttgagccgcttaaggcggatgacgacgacagagagatctctgtgtccgctgactgctttaggaggggaccggcgtttccccccgccctgccaatatgggcaaggccggggtatgacccacccctcctggagacttggaagcagcctgattatgaccccccccaggtgtcaggttgcccgctaccacctgcgggcctcccacctgtcccgcctccacggaggaagaggaaaccggtggtgctatctgactccaacgtgtcccaagtcctggccgacttggcgcacgccaggttcaaggccgacacgcaatccattgaaggccaggattctgcggtgggcaccagtagccaacccgattcagggcctgaggagaagcgtgatgatgactcggacgcggcttcatattcttccatgcctccgctggagggcgagcctggggaccctgacctttcatcagggtcgtggtcaactgtcagcgatgaggacagtgtggtgtgctgctccatgtcatacagctggaccggggcgctcatcaccccttgctccgcggaggaggaaaaattacctatcaatcctttaagcaacaccctattgcgccaccacaatcttgtgtattccacttcctctcgaagtgcgggtcagaggcagaagaaggtcacctttgacaggctacaagtcctcgatgaccattacagagaagttgtggacgagatgaagcgactagcctccaaagttaaagccagactgctgcctctagaggaagcttgtgggttaacaccaccccattccgcccgttccaagtatggatacggcgctaaggaggttcgctctctcgacaaaaaggcccttaatcacatcaagggcgtgtggcaagacttactggatgactctgataccccattgccgacaaccatcatggcaaaaaacgaggtgttcgcagtggagccgtccaagggggggaagaagccggcacggctgatagtctaccccgaccttggagtccgcgtctgcgagaagcgggcattgtatgacatagctcaaaaactgccaacagcccttatggggccctcgtacgggtttcagtactctccagcgcagcgggttgaatttttattgaagacgtggaggtctaaaaagactcccatggccttctcctatgatacccgctgctttgactcaaccgttaccgaacatgacataatgactgaagagtctatctaccaatcatgtgacttgcagcccgaggcacgcgcggcaatacggtcactcacccagcgcctatactgtggaggccctatgtataacagcaaggggcaacaatgcggttatcgcagatgccgcgccagcggcgtcttcaccactagtatgggcaacaccatgacgtgctacattaaggccttagcctcctgtagagctgcaaagctccgggattgcacgctcctggtgtgcggtgacgaccttgtggccatctgcgagagccaggggacacacgaggacgaagcgagcctgagagcctttacggaggctatgaccaggtactctgctcccccgggtgatcccccggttcctgcttatgacctagagctcgtaacatcttgctcctcaaatgtgtccgtcgcccacgatgcctcaggcaacagagtttactacctcacgcgcgacccccaagtaccgcttgcgagggccgcgtgggagactgctaaacactccccagttaactcctggttggggaacatcatcatgtacgctccgaccctgtgggctcggatagtgctgatgacgcactttttcagcgtactgcagagccaggagcaactggaaaaagccctagcatttgaaatgtatgggtcagtctactctgtcactccgctggatcttccggctattattcagagactccatggacttagcgcgtttacactccattcatactctccaagtgagatcaatagggtgagtagttgcctcaggaagcttggggtaccccctttgagagcttggagacatcgggctcgcgctgtacgcgctaagctcatcgctcagggaggtaaggccgccatctgcggcatctatctcttcaactgggcggtgaaaacaaagcgcaaactcactccattagctgacgccgatcggctggacttgtccagctggtttaccgttggcgccggcgggggggacatttatcacagcatgtcccgtgcccgaccccgctgcatactcctgtgcctactcctacttaccgtgggggtaggcatctttttactccctgctcgrtaagctgggagctaaacactccataactcctgttttttttttttttttttttttttttttcttttttttttcttttcctgttctttttttttttttaaatctttggtggctccatcttag

SEQ ID NO: 649 - DNA, 9616 bp, Hepatitis C Virus
gccagcccccgattgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgatcaggaagacttccgagcggtcgcaaccccgtggaaggcgacagcctatccccaaggctcgccggcccgagggcagggcctgggctcagcccgggtatccttggcccctctatggcaatgagggcatggggtgggcaggatggctcctgtcaccccgcggctcccggcctagttggggccccacggacccccggcgtaggtcgcgtaatttgggtaaggtcatcgataccctcacatgcggcctcgccgacctcatggggtacattccgctcgtcggcggccccctagggggcgctgccagggccttggcacatggtgtccgggttctggaggacggcgtgaactatgcaacagggaacctgcccggttgctctttttctatcttcctcttggctctgctgtcctgtctgaccgtaccagcttccgctcatgaagtgcgtaacgcgtccggggtataccatgtcacgaacgactgctccaactcaagcattgtgtttgaggcggcggacttgatcatgcatactcccgggtgcgtgccctgcgttcgggagggtaactcctcccgctgctgggtagcgctcactcccacgctcgcggccaggaatgctaccatccccactacgacaatacgacaccacgtcgatttgctcgttggggcggctgctctctgctccgctatgtacgtgggggacctctgcggatctgttttcctcgtctctcagctgttcaccttctcgccccgccggcatgcgacattgcaggactgcaattgttcgatctaccccggccacgcgtcaggtcaccgcatggcctgggacatgatgatgaactggtcacctacaacagccctcgtagtgtcgcagttactccggatcccacaagccgtcatcgacatggtggcgggggcccactggggagtcctggcgggccttgcctactattccatggcggggaactgggctaaggttttgattgtgatgctactttttgccggcgttgacgggcacaccctcacaacgggggggcacgctgcccgcctcaccagcgggttcgcgggcctctttacacctgggccgtctcagagaatccagcttataaacaccaatggcagttggcacatcaacaggactgccctgaactgcaatgactccctccagactgggtttcttgccgcgctgttctacgcacataggttcaactcgtccggatgcccggagcgcatggccagctgccgctccattgacaagttcgaccagggatggggtcctatcacttatgctgagcctacaaaagacccggaccagaggccttattgctggcactacccacctcaacaatgtggtatcgtacctgcgtcgcaggtgtgtggtccagtgtattgcttcaccccaagtcctgttgtcgtggggacaaccgatcgtctcggcaaccctacgtacagctggggggagaacgatactgacgtgctgctccttaacaacacgcggccgccgcaaggcaactggttcggctgtacatggatgaatagcactgggttcaccaagacgtgcggggcccccccgtgtaacatcgggggggtcggcaataacaccttgacctgccccacggactgcttccggaagcaccccgaggccacgtactcaaaatgtggctcggggccttggttgacacctaggtgcatggttgactacccatacaggctctggcactacccctgcactgtcaacttctccatctttaaggttaggatgtatgtggggggcgtggagcacaggcttaatgctgcatgcaactggacccgaggagagcgttgcaacttggacgacagggacagatcggagctcagcccgctgctgctctctacaacagagtggcaggttctgccctgctctttcaccaccctaccggctctgtccactggcttgatccacctccatcagaacatcgtggacgtgcaatacctgtacggtatagggtcagcggttgtctcctttgcaatcaaatgggagtatgtcgtgttgcttttccttctcctggcggacgcgcgcgtctgtgcctgcttgtggatgatgctgctgatagcccaggccgaggccgccttagagaacctggtggccctcaatgcagcgtccgttgccggagcgcacggcatcctctccttcctcgtgttcttctgtgccgcttggtacatcaagggcaggctggtccctggggcggcatatgctttctatggcgcatggccgctgctcctgctcctcttgacattaccaccacgagcttacgccatggaccgggagatggctgcatcgtgcggaggcgcggtttttgtgggtctggcattattgaccttgtcgccatattacaaggtgttcctcgctaggctcctatggtggttacaatatcttatcaccagagctgaggcgcacttgcatgtgtgggttccccccctcaacgtccggggaggccgcgatgccatcatcctcctcacgtgtgcagtccacccagagctaatctttgatatcaccaaacttctgattgccatactcggaccgctcatggtgctccaagctggcataactagggtgccgtacttcgtacgcgctcaagggctcattcgtgcatgcatgttagtgcggaaagtcgctgggggtcattatgtccaaatggccttcatgagactgggcgcgctgacgggcacgtacgtctataatcacctcaccccactgcgggattgggcccacgccggcctacgggaccttgcggtagcagtggagcctgtcgtcttctctgacatggagaccaagatcatcacctggggggcagacaccgcggcgtgtggggacatcatcctgggcctacctgtctccgcccgaaggggaagggagatactcctggggccggccgatagtctagtagggcaggggtggcgactccttgcgcccatcacggcctactcccaacagacccggggcctacttggttgcatcatcacgagtctcacaggccgggacaagaaccaggtcgagggggaggttcaagtggtctccaccgcaacacaatctttcctggcgacctgcgtcaacggcgtatgttggactgtctaccatggtgctggctcaaagactctagccggcccaaaaggcccaatcgcccagatgtacactaatgtagaccaggatctcgtcggctggccggcgccccccggggcgcgttccctgacaccatgcacctgtggcagctcggacctttacttggttacgagacatgcagatgttattccggtgcgccggcggggcgacaatagagggagcttgctctcccccaggcctgtctcctacttgaagggctcttcgggtggcccactgctctgcccttcggggcacgctgtgggcgtcttccgggccgctgtatgcacccggggggttgcaaaggcggtggattttgtccccgttgagtccatggaaactactatgcggtccccggtcttcacagacaactcatctcccccggccgtaccgcaaacattccaagtggcccatctacacgctcccactggcagcggcaagagcactagagtgccggccgcatatgcggcccaagggtacaaggtgcttgtcctgaacccgtctgttgccgctaccttaggttttggggcgtatatgtctaaagcacatggtaccgaccctaacatcaggactggggtaaggaccattaccacgggcgcccccattacgtactccacctatggcaagttccttgccgacggtggttgctccgggggcgcttacgacatcataatgtgcgatgagtgccactcaactgactcaactactatcttgggcatcggcacagtcctggaccaagcggagacggctggagcgcggcttgtcgtgctcgccaccgctacgcctccaggatcggtcaccgtgccacaccccaatatcgaggaggtggccctgtcgaacactggagagatccccttctacggcaaagccatccccatcgaagccatcaaggggggaaggcacctcattttctgtcactccaagaagaagtgcgacgagcttgccgcaaagctgtcaggcctcggaatcaatgctgtagcgtattaccggggtcttgatgtgtccgtcataccgaccagcggagacgtcgttgtcgtggcaacagacgctctaatgacgggctataccggtgactttgattcagtgatcgactgtaatacgtgtgtcacccagacagtcgacttcagcttggaccccaccttcaccattgagacgacgaccgtgccccaagacgcagtgtcgcgctcgcagcggcggggtaggactggcaggggcagggggggcatatacaggtttgtaactccgggggaacggccctcgggcatgttcgattcctcggtcctgtgcgagtgctatgacgcgggctgtgcttggtacgagctcacccccgctgagacctcggttaggttgcgggcttacctaaatacaccaggattgcccgtttgccaggaccatctggagttctgggagagcgtcttcacaggcctcacccatatagatgcccacttcctgtcccagaccaagcaggcaggagataacttcccctacctggtggcataccaagccacagtgtgcgccagggctcaggccccacctccatcgtgggatcaaatgtggaagtgtctcatacggctaaaacccacgctgcacgggccaacgcccctgctgtataggctaggggccgtccaaaatgaggtcaccctcacacaccccataaccaaatacatcatggcatgcatgtcggccgacctggaagtcgtcaccagcacctgggtgctggtaggcggagtcctcgcagctctggccgcatattgcctgacaacaggcagtgtggttatcgtgggtaggatcatcttgtccgggaggccggctgtcgttcccgatagggaagtcctctaccgggagttcgatgaaatggaagaatgcgcctcgcacctcccttacatcgaacagggaatgcaactcgccgagcaattcaagcagaaggcgctcgggttgttgcaaacagccaccaagcaggcggaggctgccgctcccgtggtggagtccaagtggcgagctttggagaccttctgggcaaagcacatgtggaatttcatcagcgggatacagtacttagcgggcttatccaccctgcctgggaaccccgcgatagcatcactgatggcattcacagcctctatcaccagcccgctcaccacccagaacaccctcctgtttaacatcttgggggggtgggtagccgcccaactcgctccccccagcgctgcttcggctttcgtgggcgctggtatcgctggtgcggctgttggcagcataggtcttgggaaggtgctagtggacattctggcgggctatggggcaggggtggctggcgcgctcgtggccttcaaggtcatgagcggcgaggcgccctctgccgaggacctgatcaatttgctccctgccatcctctctcctggtgccctggtcgtcggagtcgtgtgtgcagcaatactgcgtcggcatgtgggcccgggagagggggccgtgcagtggatgaaccggctgatagcgttcgcttcgcggggtaaccatgtctcccccacgcactatgtgcctgagagcgacgccgcagcgcgtgtcactcaggtcctctccagccttaccatcacccagctgctgaagaggctccaccagtggattaatgaggactgttctacgccgtgttccggctcgtggctgagggatgtttgggactgggtgtgcacggtgttgagtgacttcaagacctggctccagtccaagctcctgccgcggttaccgggtgtccctttcctctcatgccaacgtgggtacaagggagtctggcggggggacggcatcatgcacaccacctgcccatgtggagcacagatcgccggacatgtcaaaaacggttccatgaggatcatcgggccgaaaacctgcagcaacacgtggcatggaacattccccatcaacgcgtacaccacgggcccctgcacgccttccccggcgccaaactattccaaggcgctgtggcgggtggctgctgaggagtacgtggaggtcacgcgggtgggggatttccactacgtgacgggcataaccaccgacaacgtaaagtgcccatgtcaggttccagctcctgagtttttcacggaggtggatggggtgcggttgcacaggtacgccccggtgtgcaaacctctcttacgggatgaggttgtattccaggtcgggctcaatcaatacctggttgggtcacagctcccatgcgagcccgaaccggacgtagcagtgctcacttccatgctcaccgacccctcccacattacagcagaggcggctaagcgtaggttggccagggggtctcccccctccttggccagctcttcagctagccagctgtctgcgccctccttgagggcgacatgcactacccattcttcctataatcttgactctccggacgtcgacctcattgaggccaacctcctgtggcggcaggagatgggcggaaacatcacccgcgtggagtcggagaacaaggtggtagtcctagactctttcgagccgcttcgagcggagggggatgagaatgaaatatccattgcggcggagatcctgcggaagtccaagaagttccccgcggcgatacccatatgggcacggccggattacaatcctccattgttagagtcttggaagaacccggactacgtccctccggtggtacacgggtgcccattgccacctgtcaaggcccctccaataccacctccacggagaaaaaggacggttgtcctgacggactccaccgtgtcttctgttttggcggagctcgctaccaaaaccttcggcagctccgaattgtcggccgccgacagcggcacggcgaccgcccctcctgaccagacctccgacaacggcggcaaagactccgacgctgagtcatgctcctctatgcccccccttgagggggagccgggggaccccgatctcagcgacgggtcttggtctaccgtgagcgaggaggctggtgagagcgtcgtctgctgctcaatgtcctacacatggacaggtgccctgatcacgccatgcgccgcggaagaaagcaagctgcccatcaacgcgttgagcaactctttgctgcgccatcacaacatggtctacgccacgacatcccgcagcgcgggcctgcggcagaagaaggtcacctttgacagactgcaggtcctggatgaccattaccgggacgtgcttaaggagatgaaggcaaaggcgtccacagtcaaggctaaacttctatccatagaagaagcctgccgcctgacgcccccacattcggccaaatccaagtttggctatggggcaaaggacgtccggaacctatccagcagggccatcaaccacatccgctccgtgtgggaggacttgctggaggacactgtgacaccaattgacaccaccgtcatggcaaagaatgaggttttctgcgtccaaccagagaagggaggccgcaagccagcccgccttatcgtattcccagatttgggagttcgtgtatgcgagaagatggctctctacgatgtggtctccacccttcctcaagccgtgatgggctcctcatacggattccagtactctcccgggcagcgggtcgagttcctggtaaaagcctggaaatcaaagaaaaaccctatgggcttctcatatgacacccgctgttttgactcaacggtcactgagaatgacatccgtgttgaggagtcaatttaccaatgttgtgacttggcccccgaagccagacaggctataaaatcgctcacagagcggctttatatcgggggtcccctgactaattcaaaagggcagagctgtggttatcgccggtgccgcgcgagcggcgtgctgacgactagctgcggtaataccctcacatgttacttgaaagcctctgccgcctgtcgagctgcaaagctccaggactgcacgatgctcgtgaacggggacgaccttgtcgttatctgcgaaagcgcgggaacccaggaggatgcggcgagcctacgagtcttcacggaggctatgactaggtactccgccccccccggggacttgccccaaccagaatacgacttggagttgataacatcatgttcctccaatgtgtcggtcgcgcacgatgcatctggcaaaagggtgtactacctcactcgcgatcccaccacccccatcgcacgggctgcgtgggaaacagctagacacactccagttaactcctggctaggcaacattatcatgtatgcgcccaccttatgggcaaggatgattctgatgacccatttcttctccatccttctagctcaggagcaacttgaaaaagccctggattgccaaatctacggggcctgttactccattgagccacttgacctacctcagatcattgaacgactccatggtcttagcgcattttcactccatagttactctccaggtgagatcaatagggtggcttcatgcctcaggaaacttggggtaccgcccttgcgagtctggagacatcgggccaggagcgtccgcgctaaactactgtcccagggggggagggccgccacttgcggcaaatacctcttcaactgggcagtaaagaccaagctcaaactcactccaatcccggctgcgtcccagttggacttatccggctggttcgttgctggctacagcgggggagacatatatcacagcctgtctcgtgcccgaccccgctggttcatgctgtgcctactcctactttctgtaggggtaggcatctacttgctccccaatcgatgaacggggagctaaacactccaggccaataggccatttcctgtttttttttttttttggtttttttttttttttttttttttttttttttttttttttcctttccttctttttttttttttccctctttatggtggctccatcttagccctagtcacggctagctgtgaaaggtccgtgagccgcatgactgcagagagtgctgatactggcctctctgcagatcatgt

SEQ ID NO: 650 - DNA, 9389 bp, Hepatitis C Virus
ttgggggcgacactccaccatagatcactcccctgtgaggaactactgtcttcacgcagaaagcgtctagccatggcgttagtatgagtgttgtgcagcctccaggtccccccctcccgggagagccatagtggtctgcggaaccggtgagtacaccggaattgccaggatgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcatcatgagcacgaatcctaaacctcaaagaaaaaccaaacgtaacaccaaccgccgcccacaggacgtcaagttcccgggcggtggtcagatcgttggtggagtttacctgttgccgcgcaggggccccaagttgggtgtgcgcgcgactaggaagacttccgagcggtcgcaacctcgtggaaggcgacaacctatccccaaggctcgccggcccgagggcagggcctgggcccagcccgggtacccctggcccctctatggcaatgagggtctggggtgggcaggatggctcctgtcaccccgaggctctcggcctagttggggccccacggacccccggcgtaggtcgcgtaatctgggtaaggtcatcgatacccttacatgcggcttcgccgacctcatggggtacattccgctcgtcggcgcccccctaggaggcgctgccagggccctggcacatggcgtccgggttctggaggacggcgtgaactatgcaacaggaaatctgcccggttgctctttctctatcttcctcttagctttgctgtcttgtctaaccatcccagcttccgcttacgaagtgcgcaacgtgtccggggtgtaccatgttacgaacgactgctccaactcaagtattgtgtatgaggcggcggacgtaatcatgcatacccccgggtgcgtgccctgcgtccgggaggggaattcctcccgttgctgggtagcgcttactcccacgctcgcggccaggaacagcagcgtccccactgcgacaatacgacgccatgtcgatttgctcgtcgggacagctgctttctgctccgctatgtacgtgggggatctctgcggatctgttttcctcgtctcccagctgttcaccttctcacctcgccggtatgagacggtacaagattgcaattgctcactctatcccggccatataacaggtcaccgcatggcttgggatatgatgatgaactggtcacctacaacggccttagtggtatcgcagctactccggatcccccaggccatcgtggacatggtggcgggggcccactggggagtcctagtgggccttgcctactattccatggtggggaactgggctaaggtcttggttgtgatgttactctttgccggcgttgacgggactacccacgtgtcaggggcgcaagcaggccgcgccacccatagctttacgtccctcttcacattaggggcgtctcagagagtccaactcataaacactaacggcagctggcatatcaataggactgctctgaactgcaatgactccctccacactgggttccttgccgcgctgttctacacacacaggttcaactcgtccggatgcccggagcgcatggccagctgccgccccatcgacacgttcgctcaggggtggggtcccatcacttatgttaagccttcggcttcggaccagaggccatactgctggcactacgcacctcaaccgtgtggtatcgtacctgcgtcggaggtgtgtggtccagtgtattgcttcaccccgagccccatcgtggtggggacgaccgatcgttccggcgcccccacgtatagatggggggagaatgagacggacgtgctgctcctcaacaacacgcggccaccccacggcaactggtttggctgtacatggatgaatagcaccgggttcaccaagacgtgcgggggccccccgtgcggcatcgggggggtcggcaacaacactttgacctgccctacagattgcttccggaaacaccctgaagccacttacacaaaatgtggctcgggtccttggttgacacctaggtgtttagttgactatccatacagactttggcactacccctgcactgtcaattttagcatctttaagatcagaatgtacgtggggggcctggaacacaggctcaacgccgcgtgcaattggactcggggagagcgctgtgacgtgacggacagggataggtcagagctcagcccgctgctactgtccacaacagagtggcagatactgccctgttccttcaccaccctaccggctctgtccactggtttaatccatctccatcagaacatcgtggacgtgcaatacctgtacggtgtagggtcaacggttgtctccatcgtaatcagatgggagtacgtcgtgctgctcttccttctcctggcagatgcgcgcgtctgcgcctgcttatggatgatgctgctggtagcccaggctgaggccgccttagagaatctggtggtcctcaatgcggcgtccgtggctggagcgcacggcattctctccttccttgtgttcttttgtgctgcctggtacatcaaaggcaagctggtccctggggcggcatacgctatttatggcgtatggccgctgcttctgctcctgctgtcgttaccaccacgagcatacgccatggaccgggaggtggccgcatcgtgcgggggcgcggtttttgtaggtctggtactcttgaccttgtcaccgcactataaagtgttcctcgctaggctcatatggtggctacaatatttaatcaccagggccgaagcgcacttgcaagtgtgggtcccccccctcaacgttcgggggggccgcaatgccatcatcctcctcacgtgcgtggtccaccctgagctaatttttgaaatcaccaaaaccttgctcgccatactcgggccgctcacagtgctccaggttggcctaactaaagtgccgtactttgtgcgcgctcaagggctcatccgtgcgtgtatgttggtgcggaaaaccgctgggggtcattatgtccaaatggccctcatgaggctggccgcgctgacaggtacgtacgtctatgaccatcttactccactgcaggactgggcccacgtgggcctgcgggacctcgcagtggcagttgagcccgtcgtcttctctgacatggagaccaagatcatcacctggggggcagacaccgcggcgtgtggagacatcatctcgggtctacccgtctccgcccgaagggggagggagatacttctaggaccggccgatagttttggagagcaggggtggcggctccttgcgcccattacggcctattcccaacagacgcggggcctacttggctgtatcatcactagcctcacaggtcgggacaagaaccaggtcgagggggaggttcaggtagtctctaccgcaacgcaatctttcctagcgacctgtgtcaatggcgtgtgttggaccgtctatcacggcgccggctcgaagaccctggccggcccaaagggtccgatcgcccaaatgtacaccaatgttgaccaggacctcgttggctgggcggcgccccccggggcgcgttccttgacaccatgcacctgtggcagctcggacctttacttggtcacgaggcatgccgatgtcattccggtgcgccggcggggcgatagcaggggaagcctcctttctcccagaccaatctcctaccttaagggctcctcaggtggtccactgctttgccccgcggggcacgctgtgggcatcttccgggccgctgtgtgcacccggggggttgcgaaggcggtggactttgtacccgtcgagtctatggaaactaccatgcggtctccggtcttcacggacaattcatctcccccggccgtaccgcagacattccaagtggcccatctacacgctcccaccggcagcggcaagagcactaaggtgccggctgcatacgcagctcaagggtacaaggtgctcgtcttgaacccatccgtcgccgccaccttaggttttggggcgtatatgtctaaggcacatggtgtcgaccccaacatcagaactggggtaaggaccatcaccacgggcgctcccattacgtactccacctacggcaagttccttgccgacggtggttgctctgggggcgcctatgacatcataatatgtgatgagtgccactcaactgactcgacttccattttgggcattggtacggtcctggaccaagcggagacggctggagcgcggctcgtcgtgctcgccactgctacgcctccgggatcgatcactgtgccacatcccaatatcgaggaggtggccttgtccaacactggagagattcctttctatggcaaagccatccccatcgcgaccatcaagggggggaggcatctcatcttttgccattccaagaagaaatgtgacgagctcgccgcaaagttgtcggccctcggactcaacgccgtagcgtactaccggggtcttgatgtgtccgttataccaacaagcggagacgtcgttgtcgtggcaacagacgctctaatgacgggctataccggcgactttgactcagtgatcgactgtaacacatgtgtcacccagacagtcgacttcagcttggaccctactttcaccattgagacgacgaccgtgcctcaagacgcggtgtcgcgctcgcagcggcgaggcaggactggtaggggcagggggggcatatataggtttgtgactccaggggaacggccctcgggcatgttcgattcctcggtcctgtgtgagtgctatgacgcgggctgtgcttggtacgagctcacgcccgccgagacctcggtcaggttgcgggcatacctaaacacaccagggttgcccgtctgccaggaccatctggagttctgggagagcgttttcacaggtctcacccacatagatgcccacttcttgtcccagactaagcaggcaggagacaacttcccttacctggtggcataccaggccacagtgtgcgccagggcccaggctccacctccatcgtgggaccaaatgtggaagtgtctcatacggctaaagcctacactacacgggccaacacccctgttgtataggctgggagccgtgcaaaacgaggtcaccctcacacaccccgtaaccaaattcatcatggcatgtatgtcggctgacctagaggtcgtcaccagcacctgggtgctggtgggcggggtccttgcagctctggccgcgtactgcctgacgacgggcagcgtggttatcgtgggcaggatcatcttgtcagggaggccggccgtcattcccgacagggaagttctctaccaagagttcgacgaaatggaggagtgcgcctcacacctcccttacatcgaacagggaatgcagctcgccgagcaattcaagcagaaggcgctcgggttgctgcaaacagccaccaagcaagcggaggctgctgctcccgtggtggagtccaagtggcggacccttgaggcattctgggcgaagcacatgtggaatttcatcagcgggatacagtatttagcaggcttgtccactctgcctgggaaccccgcaatagcatcattgatggcatttacagcctccatcaccagcccgctcaccacccaacacaccctcctatttaacatcttggggggatgggtggctgcccaactcgcccccccaagcgctgcttcagctttcgtgggcgccggcattgctggcgcggctgttggcagcataggccttgggaaggtgcttgtagacatcctggcgggttatggagcaggggtggcgggcgcacttgtggcctttaaggtcatgagtggcgacatgccctccactgaggacctggtcaacttactccctgccatcctctctcctggtgccctggtcgtcggggttgtatgcgcagcaatactgcgtcggcatgtgggcccaggggagggggctgtgcagtggatgaaccggctgatagcgttcgcttcgcggggtaaccacgtctcccccacgcactatgtgcctgagagcgacgcagcagcgcgtgtcacccagatcctctccagcctcaccatcactcagctgttgaaaaggctccaccagtggatcaatgaggactgctccacgccatgctccggctcgtggcttagggatgtatgggactggatatgcacggtgttgactgacttcaaaacctggctccagtccaagctcctgccgcggctaccgggagtccctttcttctcatgccaacgtgggtacaagggagtctggcggggagatggtatcatgcaaaccatctgcccatgtggagcacaaatcgctggacatgtcaaaaatggctccatgaagatcgttgggcctaaaacctgcagcaacacgtggcatggaacattccccatcaacgcatacaccacaggcccttgcacaccctccccggcaccaaattattccagggcgttgtggcgggtggctgctgaggagtacgtggaggtcacgcggatgggggatttccactacgtgacgggcatgaccactgacaacgtaaaatgcccatgccaggttccggcccctgaattcttcacggaggtggacggggtgcggctgcacaggtacgctccggcgtgcaaacctctcctacgggatgaggtcacattccaggtcgggctcaaccaatacccggtggggtcgcagctcccatgcgagcccgaaccggatgtgacagtagtcacttccatgctcaccgacccctcccatattacagcagaaacggctaagcgtaggctggccagagggtctcccccctctttggctagctcttcagctagtcagctgtctgcgccttccttgaaggcgacatgcactacccgtcatgactctccagacgctgacctcatcgaggccaacctcctgtggcggcaggagatgggcggaaacatcacccgcgtggagtcagagaataaggtggtaatcctagactccttcgacccgcttcgagcggaggaagatgagagggaagtatccgttgcggctgagatcctgcggaaaaccaggaaatttcccccagcgatacccatatgggcacgcccggattacaacccaccactgatagagtcttggagggacccggactacgtccctccggtggtacacgggtgcccattgccacctaccaagaccccgccaataccacctccacggagaaagaagacggttgttctgacagaatccactgtgtcttctgccttggccgaacttgctgtaaaggctttcggcagctctggatcgtcagccgccgacagcggcacagcgaccgcccctcccggtcagccctccgactgtggagatacaggatccgacgctgagtcatactcctccatgcccccccttgagggagagccgggggaccccgacttcagcgacgggtcttggtcaaccgtgagtgaggaggctagtgaggacgtcgtctgctgttcgatgtcctacacgtggacaggcgccttaatcacgccatgtgccgcggaggagagcaagctgcccatcaatgcgttgagcaactcgttgctgcgtcaccacaacatggtctatgccacaacatcccgcagcgcaagccaacggcagaaaaaggttacatttgacagactgcaagtcctggacgaccactaccgggacgtactcaaggagatgaaggcgaaggcgtccacagttaaggctaaacttctatctgtagaagaagcctgcaagctgacgcccccacattcggccaaatccaaatttggctatggggcaaaggacgtccggaacctatccagcaaggccgttaaccacatccactccgtgtggaaggacttgctggaagacactcaaacaccaattgacactaccatcatggcaaagaatgaggtcttcgttgttcagccagaaaaaggaggccgcaagccggcccgccttatcgtgttcccagacttgggagttcgtgtgtgcgagaaaatggctctttacgacgtagtctccactcttcctcaagccgtgatgggctcctcatacggattccagtactcccctggacaacgggtcgagttcctggtcaatgcctggaagtcaaagaaaaaccctatgggtttcgcatatgacacccgttgttttgactcaacggtcactgagaatgacatccgtgttgaggagtcaatttatcaatgttgtgacttggcccccgaggccagacaggccataaggtcgctcacagagcggctttatattgggggccccctgactaattcaaaggggcagagctgcggttatcgccggtgccgtgctagcggcgtgctgacgaccagctgcggtaacacccttacatgttacttgaaggcctctgcagcctgtcgagctgcaaagctccgggactgcacgatgctcgtgtgcggagacgacctcgtcgttatctgtgagagcgcgggaacccaggaggacgcggcgagcctacgagtcttcacggaggctatgactaggtactctgccccccccggggacccaccccaaccggaatacgacttggagttgataacatcatgctcctccaacgtgtcggtcgcgcacgatgcatctggcaagcgggtgtactatctcacccgtgaccccaccacccccctcgggcgggctgcgtgggagacagttagacacactccaaccaactcctggctaggcaacatcatcatgtatgcgcccaccttatgggcgaggatgattctgatgactcacttcttctccatccttctagctcaggagcagcttgaaaaagccctagattgtcagatctacggggccacttactccattgaaccgcttgacctacctcagatcattcagcgactccatggtcttagcgcattttcactccacagttactctccaggtgaaatcaatagggtggcttcatgcctcaggaaacttggggtaccgcccttacgagtctggagacatcgggccaggagtgtccgcgctaagctactgtcccagggggggagggccgccatttgtggcaaatacctctttaactgggcagtaaggaccaagctcaaactcactccaattccggctgcgtcccagttggatttatccggctggttcgttgccggttacagcgggggagacatatatcacagcctgtctcgcgcccgaccccgctggttcatgtggtgcctactcctactttctgtgggagtaggcatctatttgctccccaaccggtgaacggggagctaaccactggtctacttc

SEQ ID NO: 651 - DNA, 9389 bp, Hepatitis C Virus
ttgggggcgacactccaccatagatcactcccctgtgaggaactactgtcttcacgcagaaagcgtctagccatggcgttagtatgagtgtcgtgcagcctccaggtccccccctcccgggagagccatagtggtctgcggaaccggtgagtacaccggaattgccaggatgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcatcatgagcacaaatcctaaacctcaaagaagaaccaaacgtaacaccaaccgccgcccacaggacgtcaagttcccgggcggtggtcagatcgttggtggagtttacctgttgccgcgcaggggccccaagttgggtgtgcgcgcgactaggaagacttccgagcggtcgcaacctcgtggaaggcgacaacctatccccaaggctcgccggcccgagggcagggcctgggcccagcccgggtacccctggcccctctatggcaatgagggtctggggtgggcaggatggctcctgtcaccccgaggctctcggcctagttggggccccacggacccccggcgtaggtcgcgtaatctgggtaaggtcatcgatacccttacatgcggcttcgccgacctcatggggtacattccgctcgtcggcgcccccctaggaggcgctgccagggccctggcgcatggcgtccgggttctggaggacggcgtgaactatgcaacagggaatctgcccggttgctctttctctatcttcctcttagctttgctgtcttgtttaaccatcccagcttccgcttacgaagtgcgcaacgtgtccggggtgtaccatgttacgaacgactgctccaactcaagtattgtgtatgaggcggcggacataatcatgcatacccccgggtgcgtgccctgcgtccgggaggggaattcctcccgttgctgggtagcgcttactcccacgctcgcggccaggaacagcagcgtccccactgcgacaatacgacgccatgtcgatttgctcgtcgggacagctgctttctgctccgctatgtacgtgggggatctctgcggatctgttttcctcgtctcccagctgttcaccttctcacctcgccggtatgagacggtacaagattgcaattgctcactctatcccggccatataacaggtcaccgcatggcttgggatatgatgatgaactggtcacctacaacggccctagtggtatcgcagctactccggatcccccaggccatcgtggacatggtggcgggggcccactggggagtcctagtgggccttgcctactattccatggtggggaactgggctaaggtcttggttgtgatgctactctttgccggcgttgacgggactacccacgtgtcaggggcgcaagcaggccacgccacccgtagctttacgtccctcttcacattaggggcgtctcagaaagtccaactcataaacactaacggcagctggcatatcaataggactgctctgaactgcaatgactccctccagactgggttccttgccgcgctgttctacacacacaggttcaactcgtccggatgcccggagcgcatggccagctgccgccccatcgacacgttcgctcaggggtggggtcccatcacttatgctaagccttcggcttcggaccagaggccatactgctggcactacgcacctcaaccgtgtggtatcgtacctgcgtcggaggtgtgtggtccagtgtattgcttcaccccgagccccgtcgtggtggggacgaccgatcgttccggcgcccccacgtatagatggggggagaatgagacggacgtgctgctcctcaacaacacgcggccaccccacggcaactggtttggctgcacatggatgaatagcaccgggttcaccaagacgtgcgggggccccccgtgcggcatcgggggggtcggcaacaacactttgacctgccctacagattgcttccggaagcaccccgaggccacttacaccaaatgcggctcgggtccttggttgacacctaggtgtttagttgactatccatacagactttggcactacccctgcactgtcaattttagcatctttaagatcagaatgtacgtggggggcctggaacacaggcttaacgccgcgtgcaattggactcggggagagcgctgtgacgtgacggacagggacaggtcagagctcagcccgctgctactgtccacaacagagtggcagatactgccctgttccttcaccaccctaccggctctgtccactggtttaatccatctccatcagaacatcgtggacgtgcaatacctgtacggtgtagggtcaacggttgtctccatcgtaatcagatgggagtacgtcgtgctgctcctccttctcctggcagatgcgcgcgtctgcgcctgcttatggatgatgctgctggtagcccaggctgaggccgccttagagaatctggtggtcctcaatgcggcgtccgtggctggagcgcacggcattctctccttccttgtgttcttttgtgctgcctggtacatcaaaggcaagctggtccctggggcggcatacgctatttatggcgtatggccgctgcttctgctcctgctgtcgttaccaccacgagcatacgccatggaccgggaggtggccgcatcgtgcgggggcgcggtttttgtaggtctggtactcttgaccttgtcaccgcactataaagtgttcctcgctaggctcatatggtggctacaatatttaatcaccagggccgaagcgcacttgcaagtgtgggtcccccccctcaacgttcgggggggccgcaatgccatcatcctcctcacgtgcgtggtccaccctgagctaatttttgaaatcaccaaaaccttgctcgccatactcgggccgctcacagtgctccaggttggcctaactaaagtgccgtactttgtgcgcgctcaagggctcatccgtgcgtgtatgttggtgcggaaaaccgctgggggtcattatgtccaaatggccctcatgaggctggccgcgctgacaggtacgtacgtctatgaccatcttaccccgctgcaggactgggcccacgtgggcctgcgggacctcgcagtggcagttgagcccgtcgtcttctctgacatggagaccaagatcatcacctggggggcagacaccgcggcgtgtggagacatcatctcgggtctacccgtctccgcccgaagggggagggagatactcctaggaccggccgatagttttggagagcaggggtggcggctccttgcgcccattacggcctattcccaacagacgcggggcctgcttggctgtatcatcactagcctcacaggtcgggacaagaaccaggtcgagggggaggttcaggtagtctctaccgcaacgcaatctttcctagcgacctgtgtcaatggcgtgtgttggaccgtctatcacggcgccggctcgaagaccctggccggcccaaagggtccgatcgcccaaatgtacaccaatgttgaccaggacctcgttggctgggcggcgccccccggggcgcgttccttgacaccatgcacctgtggcagctcggacctttacttggtcacgaggcatgccgatgtcattccggtgcgccggcggggcgatagcaggggaagcctcctttctcccagaccaatctcctaccttaagggctcctcaggtggtccactgctttgccccgcggggcacgctgtgggcatcttccgggccgctgtgtgcacccggggggttgcgaaggcggtggactttgtacccgtcgagtctatggaaactaccatgcggtctccggtcttcacggacaattcatctcccccggccgtaccgcagacattccaagtggcccatctacacgctcccaccggcagcggcaagagcactaaggtgccggctgcatacgcagctcaagggtacaaggtgctcgtcttgaacccatccgtcgccgccaccttaggttttggggcgtatatgtctaaggcacatggtgtcgaccccaacatcagaactggggtaaggaccatcaccacgggcgctcccattacgtactccacctacggcaagttccttgccgacggtggttgctctgggggcgcctatgacatcataatatgtgatgagtgccactcaactgactcgacttccattttgggcattggtacggtcctggaccaagcggagacggctggagcgcggcttgtcgtgctcgccactgctacgcctccgggatcgatcactgtgccacatcccaatatcgaggaggtggccttgtccaacactggagagattcctttctatggcaaagccatccccatcgcgaccatcaagggggggaggcatctcatcttttgccattccaagaagaaatgtgacgagctcgccgcaaagttgtcggccctcggactcaacgccgtagcgtactaccggggtcttgatgtgtccgttataccaacaagcggagacgtcgttgtcgtggcaacagacgctctaatgacgggctataccggcgactttgactcagtgatcgactgtaacacatgtgtcacccagacagtcgacttcagcttagaccctactttcaccattgagacgacgaccgtgcctcaagacgcggtgtcgcgttcgcagcggcgaggcaggactggtaggggcagggggggcatatataggtttgtgactccaggggaacggccctcgggcatgttcgattcctcggtcctgtgtgagtgctatgacgcgggctgtgcttggtacgagctcacgcccgccgagacctcggtcaggttgcgggcatacctaaacacaccagggttgcccgtctgccaggaccatctggagttctgggagagcgttttcacaggtctcacccacatagatgcccacttcttgtcccaaactaagcaggcaggagacaacttcccttacctggtggcataccaggccacagtgtgcgccagggcccaggctccacctccatcgtgggaccaaatgtggaagtgtctcatacggctaaagcctacactgcacgggccaacacccttgttgtataggctgggagccgtgcaaaacgaggtcaccctcacacaccccgtaaccaaattcatcatggcatgtatgtcggctgacctagaggtcgtcaccagcacctgggtgctggtgggcggggtccttgcagctctggccgcgtactgcctgacgacgggcagcgtggttatcgtgggcaggatcatcttgtcagggaggccggccgtcattcccgacagggaagttctctaccaagagttcgacgaaatggaggagtgcgcctcacacctcccttacatcgaacagggaatgcagctcgccgagcaattcaagcagaaggcgctcgggttgctgcaaacagccaccaagcaagcggaggctgctgctcccgtggtggagtccaagtggcggacccttgaggcattctgggcgaagcacatgtggaatttcatcagcgggatacagtatttagcaggcttgtccactctgcctgggaaccccgcaatagcatcattgatggcatttacagcctccatcaccagcccgctcaccacccaacacaccctcctatttaacatcttggggggatgggtggctgcccaactcgcccccccaagcgctgcttcagctttcgtgggcgccggcattgctggcgcggctgttggcagcataggccttgggaaggtacttgtagacatcctggcgggttatggagcaggggtggcgggcgcacttgtggcctttaaggtcatgagtggcgacatgccctccactgaggacctggtcaacttactccctgccatcctctctcctggtgccctggtcgtcggggttgtatgcgcagcaatactgcgtcggcatgtgggcccaggggagggggctgtgcaatggatgaaccggctgatagcgttcgcttcgcggggtaaccacgtctcccccacgcactatgtgcctgagagcgacgcagcagcgcgtgtcacccagatcctctccagcctcaccatcactcagctgttgaaaaggctccaccagtggatcaatgaggactgctccacgccatgctccggctcgtggcttagggatgtatgggactggatatgcacggtgttgactgacttcaaaacctggctccagtccaagctcctgccgcggctaccgggagtccctttcttctcatgccaacgtgggtacaagggagtctggcggggagatggtatcatgcaaaccatctgcccatgtggagcacaaatcgctggacatgtcaaaaatggctccatgaagatcgttgggcctaaaacctgcagcaacacgtggcatggaacattccccatcaacgcatacaccacaggcccttgcacaccctccccggcaccaaattattccagggcgttgtggcgggtggctgctgaggagtacgtggaggtcacgcggatgggggatttccactacgtgacgggcatgaccactgacaacgtaaaatgcccatgccaggttccggcccctgaattcttcacggaagtggacggggtgcggctgcacaggtacgctccggcgtgcaaacctctcctacgggatgaggtcacattccaggtcgggctcaaccaatacccggtggggtcgcagctcccatgcgagcccgaaccggatgtgacagtagtcacttccatgctcaccgacccctcccatattacagcagaaacggctaagcgtaggctggccagagggtctcccccctccttggctagttcttcagctagtcagctgtctgcgccttccttgaaggcgacatgcactacccgtcatgactctccagacgctgacctcatcgaggccaacctcctgtggcggcaggagatgggcggaaacatcacccgcgtggagtcagagaataaggtggtaatcctagactccttcgacccgcttcgagcggaggaagatgagagggaagtatccgttgcggctgagatcctgcggaaaaccaggaaatttcccccagcgatacccatatgggcacgcccggattacaacccaccactgatagagtcttggagggacccggactacgtccctccagtggtacacgggtgcccattgccacctaccaagaccccgccaataccacctccacggagaaagaagacggttgttctgacagaatccactgtgtcttctgccttggccgaacttgctgtaaaggctttcggcagctctggatcgtcagccgccgacagcggcacagcgaccgcccctcccggtcagccctccgactgtggagatacaggatccgacgctgagtcgtactcctccatgcccccccttgagggagagccgggggaccccgacttcagcgacgggtcttggtcaaccgtgagtgaggaggctagtgaggacgtcgtctgctgttcgatgtcctacacgtggacaggcgccttaatcacgccatgtgccgcggaggagagcaagctgcccatcaatgcgttgagcaactcgttgctgcgtcaccacaacatggtctatgccacaacatcccgcagcgcaagccaacggcagaaaaaggttacatttgacagactgcaagtcctggacgaccactaccgggacgtactcaaggagatgaaggcgaaggcgtccacagttaaggccaaacttctatctgtagaagaagcctgcaagctgacgcccccacactcggccaaatccaaatttggctatggggcaaaggacgtccggaacctatccagcaaggccgttaaccacatccactccgtgtggaaggacttgctggaagacactcaaacaccaattgacactaccatcatggcaaagaatgaggtcttcgttgttcagccagaaaaaggaggccgcaagccggcccgccttatcgtgttcccagacttgggagttcgtgtgtgcgagaaaatggctctctacgacgtagtctccactcttcctcaagccgtgatgggctcctcatacggattccagtactcccctggacaacgggtcgagttcctggtcaatgcctggaagtcaaagaaaaaccctatgggtttcgcatatgacacccgttgttttgactcaacggtcactgagaatgacatccgtgttgaggagtcaatttatcaatgttgtgacttggcccccgaggccagacaggccataaggtcgctcacagagcggctttatattgggggccccctgactaattcaaaggggcagagctgcggttatcgccggtgccgtgctagcggcgtgctgacgaccagctgcggtaacacccttacatgttacttgaaggcctctgcagcctgtcgagctgcaaagctccgggactgcacgatgctcgtgtgcggagacgacctcgtcgttatctgtgagagcgcgggaacccaggaggacgcggcgagcctacgagtcttcacggaggctatgactaggtactctgccccccccggggacccaccccaaccggaatacgacttggagttgataacatcatgctcctccaacgtgtcggtcgcgcacgatgcatctggcaagcgggtgtactatctcacccgtgaccccaccacccccctcgggcgggctgcgtgggagacagttagacacactccaaccaactcctggctaggcaacatcatcatgtatgcgcccaccttatgggcgaggatgattctgatgactcacttcttctccatccttctagctcaggagcagcttgaaaaagccctagattgtcagatctacggggccacttactccattgaaccgcttgacctacctcagatcattcagcgactccatggtcttagcgcattttcactccacagttactctccaggtgaaatcaatagggtggcttcatgcctcaggaaacttggggtaccgcccttacgagtctggagacatcgggccaggagtgtccgcgctaagctactgtcccagggggggagggccgccatttgtggcaaatacctctttaactgggcagtaaggaccaagctcaaactcactccaattccggctgcgtcccagttggatttatccggctggttcgttgccggttacagcgggggagacatatatcacagcctgtctcgcgcccgaccccgctggttcatgtggtgcctactcctactttctgtgggagtaggcatctatttgctccccaaccggtgaacggggagctaaccactggtctacttc

SEQ ID NO: 652 - DNA, 9379 bp, Hepatitis C Virus
ttgggggcgacactccaccatagatcactcccctgggaggaattactgtcttaacgcagaaagcgtctagccatggcgttagtatgagtgttgtgcagcttccaggaccccccttcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggttcgccgacccgagggcagggcctgggctcagcccgggtacccttggcccctctatgccaacgagggtatggggtgggcaggatggctcctgtcaccccgtggctctcggcctagttggggccccacggacccccggcgtaggtcgcgcaatttgggtaaggtcatcgataccctcacgtgcggcttcgccgacctcatggggtacattccgctcgtcggcgcccccttaggaggcgctgccagggccctggcgcatggcgtccgggttctggaggacggcgtgaactacgcaacagggaatctgcccggttgctctttctctatcttcctcttggctttgctgtcctgtttgaccatcccagcttccgcctatgaagtgcacaactcgtccggggcgtaccatgtcacgaacgactgctccaactcaagtattgtgtatgaggcagcggacatgatcatgcacacccccgggtgcgtgccctgcgtccgggagaacaattcctcccgctgctgggtggcgctcacccctacgctcgcggccaggaacagcagtatccccactacgacaatacgacgccatgtcgatttgctcgttggggcggctgctttctgctccgctatgtacgtgggggatctctgcggatctgtcttcctcgtttcccagctgttcaccttctcgcctcgccggtatgagacggtgcaggactgcaattgctcaatctatcccggccacgtaacaggtcaccgcatggcttgggatatgatgatgaactggtcacctacagcggccatagtggtatcgcagttactccggatcccacaagccgtcgtggacatagtggcgggggcccactggggaatcctggcgggccttgcctactactccatggtggggaactgggctaaggtcttgattgtgatgctactcttcgccggcgtcgacgggaacacccacacgacgggggggcagtcagccaagctcaccagaggctttgtgtctcttttcacccccggcccgactcagaagatccaacttattaacaccaacggcagctggcacatcaacaggactgccctgaattgcaatgactctctccagactgggttcattgccgcgctgttctacacacacaagttcaactcgtctggatgcccagagcgcatggctagctgccgccccattgacgagttcgctcaggggtggggtcccatcactcatgctgtgcctaacatctcggaccagaggccttactgctggcactacgcacctcgaccgtgtggtatcgtacccgcgtcgcaggtgtgtggtccggtgtattgcttcaccccaagccctgtcgtggtggggacgaccgatcgtttcggcgcccctacgtatacctggggggagaatgagacggacgtgctgctccttaacaacacgcggccaccgcaaggcaattggttcggctgtacatggatgaatagcaccgggttcaccaagacgtgcggaggccccccgtgtgatatcgggggggccggcaacaacaccttgacctgccctacggactgcttccggaagcaccccgcggctacttacacaaaatgtggctcggggccttggctgacacctaggtgtatggttgactacccatacagactttggcactacccctgcactgtcaacttctccatctttaaggttaggatgtatgtggggggtgtggagcacaggctcaacgccgcatgcaattggactcggggcgagcgctgcgacttgagggacagggatagatcagagcttagcccgctgctactatccacaacagagtggcagatactgccctgctccttcaccaccctaccggctctgtccaccggtttgatccaccttcatcagaacatcgtggacgtgcaatatctgtacggtgtagggtcagcggttgtctccgttgttatcaaatgggagtatgtcgtgctgctcttccttctcctggcggacgcgcgtgtctgcgcctgcttatggatgatgctgctggtagcccaggctgaagccgccttagagaacctggtggtcctcaatgcggcgtccgtggccggagcgcatggcattctctccttccttgtgttcttctgtgctgcctggtacatcaagggcaagctggtccccggggcggcatatgctttctatggcgtatggccgctgctcttgctcctgctggcgttaccaccacgagcgtacgccatggaccgggagatggctgcatcgtgcggaggcgcggttttcataggtctagcactcttgaccttgtccccacactacaaagcattactcgctaggctcatatggtggttgcaatactttatcaccagggctgaggcgcaattgcaagtgtggatcccccccctcaacgttcgggggggccgcgatgccatcatcctcctcacgtgtgcggcccatccggggctaatttttgagatcaccaaaatcttgctcgccatacttggtccgctcatgatactccaggctggcctcactagagtgccgtacttcgtgcgcgctcaagggctcatccgtgcatgcatgttggtgcggaaagtcgctgggggtcactatgtccaaatggctctcatgaagctggccgcactgacgggcacgtacgtttatgaccatctcactccgctgcaggactgggcccacacgggcctgcgagaccttgcggtggcagttgagcccgtcgtcttctctgacatggagaccaagatcatcacctggggggcagacaccgcggcgtgtggggacatcatctcgggtctacccgtctccgcccgaagggggagggagatactcctggggccggccgacgggtttgatgagcaggggtggcgactccttgctcccatcacggcctactcccaacagacgcggggcctttttggctgcatcatcactagcctcacaggtcgagacaagaaccaggtcgagggggaagttcaggtggtttccaccgcaacgcagtctttcctggcgacctgtgtcaacggcgtgtgctggactgtctaccatggtgccggctcaaaaaccctagccggcccaaagggaccaatcacccaaatgtacaccaatgtagaccaggacctcgtcggctggccggcgccccccggggcgcgttccttgacaccatgcacctgcggcagctcggacctttatttggtcacgaggcatgctgacgtcattccggtgcgccggcggggcgacagcagggggagcctactctcccctaggcctgtctcctacttgaagggttcctcgggtggtccattgctctgcccctcagggcacgctgtgggcatcttccgggctgctgtgtgcacccggggggttgcaaaggcggtggacttcgtacccgttgagtctatggaaactactatgcggtctccggtcttcacggacaactcatctcccccggccgtaccgcagacattccaagtggcccatctacacgcccccaccggcagcggcaagagcactaaggtgccggctgcatatgcagcccaagggtataaggtactcgtcctgaacccgtccgttgccgccaccttagggtttggggcgtatatgtctaaggcacatggtattgaccccaacgtcagaactggggtaaggaccatcaccacgggcgcttccattacgtattccacctatggcaagttccttgccgacggtggttgttctgggggcgcctatgacatcataatgtgtgatgagtgccactcaactgactcgacttccattttgggcatcggcacagttctggaccaagcggagacggctggagcgcggctcgtcgtgctcgccaccgctacgcctccgggatcggtcaccgtgccacatcccaacattgaggaggtgggcctgtccaacactggagagatccccttctacggcaaagccatccccattgagaccataaagggggggaggcatctcatcttctgccattccaagaagaaatgtgatgagctcgccacgaagctgtcaacccttggaatcaatgctgtggcgtactaccggggtctggacgtgtccgtcatacctacaagcggagacgtcgttgtcgtggcaacagacgctctcatgacgggctatactggtgattttgactcagtgatcgactgcaacacatgtgtcacccagacagtcgacttcagcttggaccctaccttcaccattgaaacggcgaccgtgcctcaagacgcggtgtcgcgctcgcagcggcggggcagaactggtaggggcagaatgggcatatacaggtttgtgactccaggagaacggccctcgggcatgttcgactcttcagtcctgtgtgaatgctatgacgcgggctgtgcttggtatgagctcacgcccgccgagacttcggttaggttgcgggcttacctaaacacaccagggttgcccgtctgccaggaccatctggagttctgggagagcgtcttcacaggcctcacccatatagatgcccacttcttgtcccagaccaagcaggcaggagacaacttcccctacctggtagcataccaggctacagtgtgcgccagggcccaggctccacctccatcgtgggatcaaatgtggaagtgtctcatacggctgaagcccacacttcacgggccaacacccctgttgtacaggctaggagccgttcaaaatgaaatcaccctcacacaccccataaccaaatacatcatggcatgcatgtcggctgacctagaagtcgtcacaagcacttgggtgctagtaggcggggtccttgcagctctggccgcgtactgcctaacaacgggcagcgtggtcattgtgggcagaatcattttgtctgggaggccggctatcatccctgacagggaggtcctctaccgggagttcgatgaaatggaggagtgcgcctcacacctcccttacatcgaacagggaatgcagctcgctgaacaattcaagcagaaggcgctcgggttgctgcaaacggccaccaagcaagcggaggccgccgctcccgtggtggaatccaagtggcgtacccttgaggccttctgggcgaagcacatgtggaatttcatcagcgggatacagtacctagcaggcttgtccactctgcctgggaaccccgcgatagcatcactgatggcattcacagcctctatcaccagcccgctcaccacccaacataccctcttgttcaacatcttggggggatgggtggccgcccaactcgccccccccagcgctgcttcagctttcgtgggcgccggcattgctggcgcggctgttggcagcataggccttgggaaggtgcttgtggacattctggcggggtatggggcaggggtggcaggcgcgctcgtggcctttaaggtcatgagcggcgatatgccctccaccgaggatttggtcaacttactccccgccatcctctctcctggtgccctggtcgtcggggtcgtgtgcgcagcaatactgcgtcggcatgtgggcccaggggagggggctgtgcagtggatgaaccggctgatagcgtttgcttcgcggggtaaccacgtctcccccacgcactatgtgcctgaaagcgacgccgcagcgcgcgttacccagatcctctccagccttaccatcactcagctgttgaagaggctccaccagtggattaatgaggactgctccacaccatgctccggctcgtggctcagggatgtttgggactggatatgcacggtgttgtctgacttcaagacctggctccagtccaagctcctgccgcggttgccgggagttcctttcctctcatgccaacgtgggtacaagggagtctggcggggagatggcgtcgtgcacaccacctgcccatgtggagcacaaatcaccggacatgtcaaaaacggttccatgaggattgttgggcccaaaacctgcagcaacacgtggcatggaacattccccatcaacgcatacaccacgggcccctgcacaccctccccggcgccaaactattccagggcattgtggcgggtggctgctgaggagtacgtggaggtcacgcgggtgggggatttccactacgtgacgggcatgaccactgacaacgtaaaatgcccatgccaggttccggcccccgagttctttacagaattggacggggtgcggttacacaggtacgctccagcgtgcaagcctctcctacgggaggaggtcacattccaggtcgggctcaaccaatacccagttgggtcacagctcccatgtgagcccgaaccggatgtgacagtgctcacctccatgcttaccgacccctcccacattacagcagagacggccaagcgtaggctggccagggggtctcccccttctttggccagctcttcagctagtcagttgtctgcgccctccttgaaggcggcatgcactacccatcatgactccccagatgctgacctcattgaggccaacctcttgtggcggcaggagatgggcgggaacatcacccgcgtggagtcagagaataaggtggtaattctagactcttttgacccgcttcgagcggaggaagatgagagggaggtatccgttgcggcggagatcctgcggaagaccaggaaattccccccggcgatacccatatgggcacgcccggattacaacccaccactgctagagtcttggaaggacccggactacgtccctccggtggtacacgggtgcccattgccacctaccaaggcccctccaataccacctccacggagaaagaggacagttgtcttaacagactccactgtgtcttccgccttggcggagcttgctacgaagaccttcggcagctccgggtcgtcggccgtcgacagcggcacagcgaccgcccctcctacccagtcctccgatgacggtggtgcaggatccgacgttgagtcgtactcctccatgcccccccttgagggggagccgggggaccccgatctcagtgacgggtcttggtctactgtaagcgaggaggctagtgaggacgtcgtctgctgctcgatgtcctacacatggacaggtgccttgatcacgccatgcgccgcggaggagagcaagctgcccatcaacgcgttgagcaactctttgctgcgtcaccacaatatggtctatgccacaacatcccgcagcgcaagccaacggcagaaaaaggtcacctttgacagactgcaagtcctggacgaccactaccgggacgtgctcaaggagatgaaggcgaaggcgtccacagttaaggctaaacttctatccgtagaagaagcttgcaagctgacgcccccacattcggctagatccaaatttggctatggggcgaaggacgtccggaacctatccagcaaggctgttaaccacatccactccgtgtggaaggacttgctggaagacactgagacaccaattgacaccaccatcatggcaaaaaatgaggtcttttgtgttcaaccagagaaaggaggccgcaagccagctcgccttatcgtattcccagatttgggggttcgcgtgtgcgagaaaatggccctttacgacgtggtctccactcttcctcaggccgtgatgggctcctcgtacgggttccagtactctcctgggcagcgggtcgagttcctggtaaatgcctggaaatcaaagaaaagccccatgggcttcgcatatgacacccgctgttttgactcaacggtcactgagagtgacatccgtgttgaggagtcaatttaccaatgttgtgacttggcccccgaggccagacaggccataaggtcgctcacagagcggctttacatcgggggccccctgactaattcaaaagggcagaactgcggttatcgccggtgccgcgccagcggcgtgctgacgaccagctgcggtaatacccttacatgttacttgaaggcctctgcagcctgtcgagctgcgaagctccaggactgcacgatgctcgtgtgcggggacgaccttgtcgttatctgtgagagcgcgggaatccaggaggacgcggcgagcctacgagtcttcacggaggctatgactaggtactctgccccccccggggacccgccccaaccagaatatgacttggagctaataacatcatgctcctccaacgtgtcggtcgcgcacgatgcatctggtaaacgggtgtattatctcacccgtgaccccaccaccccccttgcacgggctgcgtgggagacagctagacacactccaatcaactcttggctaggcaacatcatcatgtatgcgcccaccctatgggcaaggatgattctgatgacccacttcttttccatccttctagcccaggagcaactcgaaaaagccctagattgtcagatctacggggccacttactccattgagccacttgacctacctcagatcattcagcgactccatggtcttagcgcattttcactccatagttactctccaggtgagatcaatagggtggcttcatgcctcaggaaacttggggtaccacccttgcgagtctggagacatcgggccagaagtgtccgcgctaagctactgtcccagggagggagggccgccacttgtggcaaatacctcttcaactgggcagtaaggaccaaacttaaactcactccaatcccggctgcgtcccagttggacttgtccggctggttcgttgctggttacagcgggggagacatatatcacagcttgtctcgtgcccgaccccgctggttcatgtggtgcctactcctactttctgtaggggtaggcatctatttgctccccaaccggtgaacggggagctaaccact

SEQ ID NO: 653 - DNA, 9379 bp, Hepatitis C Virus
ttgggggcgacactccaccatagatcactcccctgggaggaattactgtcttaacgcagaaagcgtctagccatggcgttagtatgagtgttgtgcagcttccaggaccccccttcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccgacccgagggcagggcctgggctcagcccgggtaccctgggcccctctatgccaacgagggtatggggtgggcaggatggctcctgtcaccccgaggctcccggcctagttggggccccacggacccccggcgtaggtcgcgcaatttgggtaaggtcatcgatacccttacatgcggcttcgccgacctcatggggtacattccgctcgtcggcgcccccttaggaggcgctgccagggccctggcgcatggcgtccgggttctggaggacggcgtgaactacgcaacagggaatctgcccggttgctctttttctatcttcctcttggctttgctgtcctgtttgaccatcccagcttccgcctatgaagtgcacaactcgtccggggcgtaccatgtcacgaacgactgctccaactcaagtattgtgtatgaggcagcggacatgatcatgcacacccccgggtgcgtgccctgcgtccgggagaacaattcctcccgctgctgggtggcgctcacccctacgctcgcggccaggaacagcagtatccccactacgacaatacgacgccatgtcgatttgctcgttggggcggctgctttctgttccgctatgtacgtgggggatctctgcggatctgtcttccttgtttcccagctgttcaccttctcgcctcgccggtatgagacggtgcaggactgcaattgctcaatctatcccggccacgtaacaggtcaccgcatggcttgggatatgatgatgaactggtcacctacagcggccatagtggtatcgcagctactccggatcccacaagccgtcgtggacatagtggcgggggcccactggggaatcctggcgggccttgcctactattccatggtggggaactgggctaaggtcttgattgtgatgctactcttcgccggcgtcgacgggaacacccacacgacgggggggcagtcagcccagatcaccagaggctttgtgtctcttttcacccccggcccgactcagaagatccaacttattaacaccaacggcagctggcacatcaacaggactgccctgaactgcaatgactctctccagactgggttcattgccgcgctgttctacacacacaagttcaactcgtctggatgcccagagcgcatggctagctgccgccccattgacgagttcgctcaggggtggggtcccatcactcatgctgtgcctaacatctcggaccagaggccttactgctggcactacgcacctcgaccgtgtggtatcgtacccgcgtcgcaggtgtgtggtccggtgtattgcttcaccccaagccctgtcgtggtggggacgaccgatcgtttcggcgcccctacgtatacctggggggagaatgagacggacgtgctgctccttaacaacacgcggccgccgcaaggcaattggttcggctgtacatggatgaatagcaccgggttcaccaagacgtgcggaggccccccgtgtgatatcgggggggccggcaacaacaccttgacctgccctacggactgcttccggaagcaccccgcggctacttacacaaaatgtggctcggggccttggctgacacctaggtgtatggttgactacccatacagactttggcactacccctgcactgtcaacttctccatctttaaggttaggatgtatgtggggggtgtggagcacaggctcaacgccgcatgcaattggactcggggcgagcgctgcgacttgagggacagggatagatcagagcttagcccgctgctactatccacaacagagtggcagatactgccctgttccttcaccaccctaccggctctgtccaccggtttgatccaccttcatcagaacatcgtggacgtgcaatatctgtacggtgtagggtcagcagttgtctccgttgttatcaaatgggagtatgtcgtgctgctcttccttctcctggcggacgcgcgtgtctgcgcctgcttatggatgatgctgctggtagcccaggctgaagccgccttagagaacctggtggtcctcaatgcggcgtccgtggccggagcgcatggcattctctccttccttgtgttcttctgtgctgcctggtacatcaagggcaagctggtccccggggcggcatatgctttctatggcgtatggccgctgctcttgctcctgctggcgttaccaccacgagcgtacgccatggaccgggagatggctgcatcgtgcggaggcgcggttttcataggtctagcactcttgaccttgtccccacactacaaagcattactcgctaggctcatatggtggttgcaatactttatcaccagggctgaggcgcaattgcaagtgtggatcccccccctcaacgttcgggggggccgcgatgccatcatcctcctcacgtgtgcggcccatccggggctaatttttgaaatcaccaaaatcttgctcgccatacttggtccgctcatgatactccaggctggcctcactagagtgccgtacttcgtgcgcgctcaagggctcatccgtgcatgcatgttggtgcggaaagtcgctgggggtcactatgtccaaatggctctcatgaagctggccgcactgacaggtacgtacgtttatgaccatctcactccgctgcaggactgggcccacacgggcctgcgagaccttgcggtggcagttgagcccgtcgtcttctctgacatggagaccaagatcatcacctggggggcagacaccgcggcgtgtggggacatcatctcgggtctacccgtctccgcccgaagggggagggagatactcctggggccggccgacgggtttgatgagcaggggtggcgactccttgctcccatcacggcctactcccaacagacgcggggcctttttggctgcatcatcactagcctcacaggtcgagacaagaaccaggtcgagggggaagttcaggtggtttccaccgcaacgcagtctttcctggcgacctgtgtcaacggcgtgtgctggactgtctaccatggtgccggctcaaagaccctagccggcccaaagggaccaatcacccaaatgtacaccaatgtagaccaggacctcgtcggctggccggcgccccccggggcgcgttccttgacaccatgcacctgcggcagctcggacctttacttggtcacgaggcatgctgacgtcattccggtgcgccggcggggcgacagcagggggagcctactctcccccaggcctgtctcctacttgaagggttcctcgggtggtccattgctctgcccctcagggcacgctgtgggcatcttccgggctgctgtgtgcacccggggggttgcaaaggcggtggacttcgtacccgttgagtctatggaaactactatgcggtctccggtcttcacggacaactcatctcccccggccgtaccgcagacattccaagtggcccatctacacgcccccaccggcagcggcaagagcactaaggtgccggctgcatatgcagcccaagggtataaggtactcgtcctgaacccgtccgttgccgccaccttagggtttggggcgtatatgtctaaggcacatggtattgaccccaacgtcagaactggggtaaggaccatcaccacgggcgcttccattacgtattccacctatggcaagttccttgccgacggtggttgttctgggggcgcctatgacatcataatgtgtgatgagtgccactcaactgactcgacttccattttgggcatcggcacagttctggaccaagcggagacggctggagcgcggctcgtcgtgctcgccaccgctacgcctccgggatcggtcaccgtgccacatcccaacattgaggaggtgggcctgtccaacactggagagatccccttctacggcaaagccatccccattgagaccataaagggggggaggcatctcatcttctgccattccaagaagaaatgtgatgagctcgccacgaagctgtcaacccttggaatcaatgctgtggcgtactaccggggtctggacgtgtccgtcatacctacaagcggagacgtcgttgtcgtggcaacagacgctctcatgacgggctatactggtgattttgactcagtgatcgactgcaacacatgtgtcacccagacagtcgacttcagcttggaccctaccttcaccatcgaaacggcgaccgtgcctcaagacgcggtgtcgcgctcgcagcggcggggcagaactggtaggggcaggatgggcatatacaggtttgtgactccaggagaacggccctcgggcatgttcgactcttcagtcctgtgtgaatgctacgacgcgggctgtgcttggtatgagctcacgcccgccgagacttcggttaggttgcgggcttacctaaacacaccagggttgcccgtctgccaggaccatctggagttctgggagagcgtcttcacaggcctcacccatatagatgcccacttcttgtcccagaccaagcaggcaggagacaacttcccctacctggtggcataccaggctacagtgtgcgccagggcccaggctccacctccatcgtgggatcaaatgttgaaatgtctcatacggctgaagcccacgctacacgggccaacacccctgttgtataggctaggagccgttcaaaatgaaatcaccctcacacaccccataaccaaatacatcatggcatgcatgtcggctgacctagaagtcgtcacaagcacttgggtgctagtaggcggggtccttgcagctctggccgcgtactgcctaacaacgggcagcgtggtcattgtgggcaggatcattttgtctgggaggccggctatcatccctgacagggaggtcctctaccgggagttcgatgaaatggaggagtgcgcctcacacctcccttacatcgaacagggaatgcagctcgctgaacaattcaagcagaaggcgctcgggttgctgcaaacggccaccaagcaagcggaggccgccgctcccgtggtggaatccaagtggcgtacccttgaggccttctgggcgaagcacatgtggaatttcatcagcgggatacagtacctagcaggcttgtccactctgcctgggaaccccgcgatagcatcactgatggcattcacagcctccatcaccagcccgctcaccacccaacataccctcttgttcaacatcttgggaggatgggtggccgcccaactcgccccccccagcgctgcttcagctttcgtgggcgccggcattgctggcgcggctgttggcagcataggccttgggaaggtgcttgtggacattctggcggggtatggggcaggggtggcaggcgcgctcgtggcctttaaggtcatgagcggcgatatgccctccaccgaggatttggtcaacttactccccgccatcctctctcctggtgccctggtcgtcggggtcgtgtgcgcagcaatactgcgtcggcatgtgggcccaggggagggggctgtgcagtggatgaaccggctgatagcgtttgcttcgcggggtaaccacgtctcccccacgcactatgtgcctgaaagcgacgccgcagcgcgcgttacccagatcctctccagccttaccatcactcagctgttgaagaggctccaccagtggattaatgaggactgctccacgccatgctccggctcgtggctcagggatgtttgggactggatatgcacggtgttgtctgacttcaagacctggctccagtccaagctcctgccgcggttgccgggagttcctttcctctcatgccaacgtgggtacaagggagtctggcggggagatggcgtcgtgcacaccacctgcccatgtggagcacaaatcaccggacatgtcaaaaacggttccatgaggattgttgggcccaaaacctgcagcaacacgtggcatggaacattccccatcaacgcatacaccacgggcccctgcacaccctccccggcgccaaactattccagggcattgtggcgggtggctgctgaggagtacgtggaggtcacgcgggtgggggatttccactacgtgacgggcatgaccactgacaacgtaaaatgcccatgccaggttccggcccccgagttctttacagaattggacggggtgcggttacacaggtacgctccagcgtgcaagcctctcctacgggaggaggtcacattccaggtcgggctcaaccaatacccagttgggtcacagctcccatgtgagcccgaaccggatgtgacagtgctcacctccatgcttaccgacccctcccacattacagcagagacggccaagcgcaggctggccagggggtctcccccttctttggccagctcttcagctagtcagttgtctgcgccctccttgaaggcggcatgcactacccatcatgactccccagatgctgacctcattgaggccaacctcttgtggcggcaggagatgggcgggaacatcacccgcgtggagtcagagaataaggtggtaattctagactcttttgacccgcttcgagcggaggaagatgagagggaggtatccgttgcggcggagatcctgcggaagaccaggaaattccccccggcgatacccatatgggcacgcccggattacaacccaccactgctagagtcttggaaggacccggactacgtccctccggtggtacacgggtgcccattgccacctaccaagccccctccaataccacctccacggagaaagaggacagttgtcttaacagactccactgtgtcttccgccttggcggagcttgctacgaagaccttcggcagctccgggtcgtcggccgtcgacagcggcacagcgaccgcccctcctacccagtcctccgatgacggtggtgcaggatccgacgttgagtcgtactcctccatgcccccccttgagggggagccgggggaccccgatctcagtgacgggtcttggtctactgtaagcgaggaggctagtgaggacgtcgtctgctgctcgatgtcctacacatggacaggtgccttgatcacgccatgcgccgcggaggagagcaagctgcccatcaacgcgttgagcaactctttgctgcgtcaccacaatatggtctatgccacaacctcccgcagcgcaagccaacggcagaaaaaggtcacctttgacagactgcaagtcctggacgaccactaccgggacgtgctcaaggagatgaaggcgaaggcgtccacagttaaggctaaacttctatccgtagaagaagcttgcaagctgacgcccccacattcggctagatccaaatttggctatggggcaaaggacgtccggaacctatccagcaaggctgttaaccacatccactccgtgtggaaggacttgctggaagacactgagacaccaattgacaccaccatcatggcaaaaaatgaggtcttttgtgttcaaccagagaaaggaggccgcaagccagctcgccttatcgtattcccagatttgggggttcgcgtgtgcgagaaaatggccctttacgacgtggtctccactcttcctcaggccgtgatgggctcctcgtacgggttccagtactctcctgggcagcgggtcgagttcctggtaaatgcctggaaatcaaagaaaagccccatgggcttcgcatatgacacccgctgttttgactcaacggtcactgagagtgacatccgtgttgaggagtcaatttaccaatgttgtgacttggcccccgaggccagacaggccataaggtcgctcacagagcggctttacatcgggggccccctgactaattcaaaagggcagaactgcggttatcgccggtgccgcgccagcggcgtgctgacgaccagctgcggtaatacccttacatgttacttgaaggcctctgcagcctgtcgagctgcgaagctccaggactgcacgatgctcgtgtgcggggacgaccttgtcgttatctgtgagagcgcgggaatccaggaggacgcggcgagcctacgagtcttcacggaggctatgactaggtactctgccccccccggggacccgccccaaccagaatatgacttggagctaataacatcatgctcctccaacgtgtcggtcgcgcacgatgcatctggtaaacgggtgtattatctcacccgtgaccccaccaccccccttgcgcgggctgcgtgggagacagctagacacactccaatcaactcttggctaggcaacatcatcatgtatgcgcccaccctatgggcaaggatgattctgatgacccacttcttttccatccttctagcccaggagcaactcgaaaaagccctagattgtcagatctacggggccacttactccattgagccacttgacctacctcagatcattcagcgactccatggtcttagcgcattttcactccatagttactctccaggtgagatcaatagggtggcttcatgcctcaggaaacttggggtaccacccttgcgagtctggagacatcgggccagaagtgtccgcgctaagctactgtcccagggagggagggccgccacttgtggcaaatacctcttcaactgggcagtaaggaccaaacttaaactcactccaatcccggctgcgtcccagttggacttgtccggctggttcgttgctggttacagcgggggagacatatatcacagcttgtctcgtgcccgaccccgctggttcatgtggtgcctactcctactttctgtaggggtaggcatctatttgctccccaaccggtgaacggggagctaaccact

SEQ ID NO: 654 - DNA, 9379 bp, Hepatitis C Virus
ttgggggcgacactccaccatagatcactcccctgtgaggaactactgtcttcacgcagaaagcgtctagccatggcgttagtatgagtgtcgtgcagcctccaggaccccccttcccgggagagccatagtggtctgcggaaccggtgagaacaccggaattgccaggaggaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcatcatgagcacaaatcctaaaccccaaagaaaaaccaaacgtaacaccaaccgtcgcccacaggacgtcaagttcccgggcggtggtcagatcgttggtggagtttacctgttgccgcgcaggggccccaggttgggtgtgcgcgcgactaggaagacttccgagcggtcacaacctcgcggaaggcgacaacctatccccaaggctcgccatcccgagggcagggcctgggctcagcctgggtacccttggcccctctatggcaatgagggcatggggtgggcaggatggctcctgtcaccccgcggctctcggcctagttggggccccacggacccccggcgtaggtcgcgtaatttgggtaaggtcatcgataccctcacatgcggctttgccgacttcatggggtacattccgctcgtcggcgcccccctagggggtgttgccagggtcctggcacatggtgtccgggctctggaggacggcgtgaattatgcaacagggaatttgcccggttgctctttctctatcttcctcttagctctgctgtcctgtttgaccatcccagcttccgcttatgaagtgcacaacgtgtccggggtgtaccatgtcacgaacgactgttccaactcaagcattgtgtatgagacagcggacatgatcatgcatgcccccgggtgcgtgccctgtgttcgggaggataactcctcccgttgctgggtagcgctgactcccacgttagcggccaggaatgccaccgtccccactacgacaatacgacgtcatgtcgacttgctcgttggggcggctactttctgctccgtcatgtacgtgggagatctctgcggatctgttttcctcgtctcccagctgttcaccttctcgcctcgttggcatgagacagtgcaggactgcaactgctcaatctatcccggccacgtgacaggtcaccgtatggcttgggatatgatgatgaattggtcgcccacagcagccttggtggtgtcgcagttgctccggatcccacaaaccgtcgtggatatgatggcgggggctcactggggagtcctagcgggccttgcctactattccatggtggggaactgggctaaggtgttgattgtgatgctacttttcgccggcgttgatgggtcaacctacgcgtcgggggcggcatcaggccacagcacccttggaataacgaggttgttctcattcggggcgtctcagaaaatccagcttataaataccaatggcagctggcacatcaacaggactgccttgaactgcaatgactccctccagactgggtggcttgctgcgctgttctacacgcacaagttcaactcgtctggatgcccggagcgcatggccagctgccgctccattgacaagttcgatcaggggtggggtcccatcacttatgctagccctggcggccaggatcaaaggccttattgctggcactacgcaccaaagcagtgtggtatcgtacccgcgtcgcaggtgtgtggtccagtgtattgcttcaccccaagcccagttgtggtggggacgaccgatcggttcggtgtccctacgtatagctggggggagaacgagacggacgtgctgcttttaaacaacacgcggccgccgcaaggcaactggttcggctgcacatggatgaatggcactgggttcaccaagacatgcgggggccccccgtgtaacatcgggggggtcggcaataacaccttgacctgccccacggactgcttccggaagcaccccgaggccacttacacaaaatgtggctcggggccttggttgacacccaggtgcatggttgactacccatacaggctctggcactacccctgcactgtcaacttttccatctttaaggtcaggatgtatgtggggggcgtggagcacaggcttaatgctgcatgcaattggacccgaggggagcgctgtgacttggaggacagggataggtcggagctcagcccgctgctgctgtctacaacagagtggcaggtgctgccctgttccttcaccaccctaccggctctgtccactggtttaatccatcttcaccagaacatcgtggacgtgcaatacctgtacggtatagggtcggcggttgtctcctatgcaatcaaatgggagtatgtcatattgcttttccttctcctggcggacgcgcgcgtctgtgcctgcttgtggatgatgttgctgatagcccaggccgaggccgccctggagaacctggtggttctcaatgcggcgtccgtggccggagcgcatggcattctctccttccttgtgttcttctgtgccgcctggtacatcaaaggcaggctcgtccctggggcggcatatgctttttatggcgtatggccgctgctcctgctcctgctggcgttaccaccacgagcttacgccatggaccgggagatggctgcatcgtgcgggggcggggttttcataggtctggcactcttgaccttgtcaccatactacaaagaattcctcgctaggctcatatggtggttacaatattttatcaccagagccgaggcgcacctgcaagtgtggatcccccccctcaacgttcggggaggccgcgatgccatcatcctccttgtgtgtgcggtccacccagagctaatctttgacatcaccaaaattctgctcgccatcctcggtccgctcatggtgctccaggctagtataacccgagtgccgtacttcgtgcgcgctcaagggctcattcgtgcatgcatgctggtgcggaaagccgccgggggtcattatatccaaatggccttcatgaagctggccgcgctgacaggtacgtacgtttacaaccatcttactcctctgcgggactgggcccacgtgggcctacgagatctcgcggtagcagtagagcccgttgtcttctctgacatggagaccaagatcatcacctggggggcggacaccgcggcgtgtggggacatcatctggggcctacctgtctccgcccgaagggggaaggagatacttctgggaccggctgacagtcttgaagggcaggggtggcggctccttgctcccatcacggcctactctcaacagacgcggggcctacttggttgcatcgtcactagcctcacaggccgggacaagaaccaggtcgagggggaggttcaagtggtctccaccgcaacacaatctttcctggcgacctgcgtcaatggcgcgtgttggactgtcttccatggtgctggctcaaagactctagccggcccacaaggtccaatcacccagatgtacaccaatgtagaccaggaccttgtcggctggcaggcgccccccgggtcacgctccctgacaccatgcacctgcggtagctcggacctttatttggtcacgagacatgccgatgtcattccggtgcgccgacggggcgacactagggggagcctactctctcccaggcctgtctcttatttgaagggctcttcgggaggcccactactctgcccttcggggcacgttgtgggcatcttccgggctgctgtgtgcacccggggggtcgcgaaggcggtggacttcatacccgttgagtctatggaaactacaatgcggtctcctattttcacagacaactcatcccccccagcggtaccgcagacattccaagtggcccatctacacgcccccactggcagcggcaagagcactaaagtgccggctgcatatgcggcccaagggtacaaagtactcgtcttgaacccgtccgttgccgccaccttgggttttggggcgtacatgtctaaagcacatggtgttgaccccaacatcagaactggggtaaggaccatcaccacgggcgcccctatcacatactccacctatggcaagttccttgccgacggtggctgctccgggggcgcctatgacatcataatgtgtgatgagtgccactcaactgactcaactagcatcttgggcattggcacggtcctggaccaagctgagacggctggagcacgtctcgtcgtgctcgccaccgctacgcctccgggatcggtcaccgtgccacaccccaacatcgaggaggtggccctgtccaacactggggagatccccttctacggcaaagccatccccattggggtcatcaagggggggaggcatctcattttctgtcactccaagaagaagtgtgacgagctcgccgcaaagctgtcagccctcggactcaatgccgtagcatattatcggggtctcgatgtgtccgtcataccgaccagcggagacgtcgttgtcgtagcgacagacgctctaatgacgggctttaccggcgactttgactcagtaatcgactgtaacacatgtgtcacccagacagtcgattttagcttagatcccaccttcaccattgagacgacaaccgtgccccaagacgcggtgtcgcgctcgcagcggcgaggtaggactggcaggggcaggagaggcatctacaggtttgtgactccaggagaacggccctcgggcatgttcgattcctcggtcttgtgtgagtgctatgacgcgggctgtgcttggtacgagctcacgcctgccgagaccacagtcaggttgcgggcttacctaaatacaccagggttgcccgtctgccaggaccatctggagttctgggagggcgtcttcacaggcctcacccacatagatgcccactttctgtcccagactaagcaggcaggggacaacttcccctacctggtagcataccaagccacagtgtgcgccagagctcaggctccacctccatcgtgggatcaaatgtggaagtgtctcatacggctcaaacctacgctgcacgggccaacacccctgctgtataggctaggagccgtccaaaatgaggtcaccctcacacaccccgtaaccaaatacatcatgacatgcatgtcggctgacctagaagtcgtcactagcacctgggtgctagtaggcggagttctcgcagccctggccgcatattgcttgacaacaggcagcgtggtcatcgtgggtaggatcatcttgtccgggaggccggctgttattcccgacagagaaattctctaccgggagttcgatgaaatggaagagtgcgcttcacacctcccttacatcgaacagggaatgcagctcgccgagcaattcagacagaaggcgctcgggttgctgcagacagctaccaagcaagcagaggctgctgctcccgtggtggaatccaagtggcgaggccttgagaccttctgggcgaagcacatgtggaacttcatcagcgggatacagtacctagcaggcctatccactctgcctgggaaccccgcgatagcatcactgatggcattcacggcctctatcaccagtccgctcaccacccaaaataccctcctatttaacatcttggggggatgggtggctgcccaactcgccccccccagcgctgcttcggctttcgtgggcgccggcatcgccggtgcggctgttggcagcataggctttgggaaggtgatcgtggacatcctggcgggatatggagcgggggtggctggcgcactcgtagccttcaaaatcatgagcggcgaggtgccttccaccgaggatctggttaatttgctccctgccatcctctctcccggtgccctggtcgtcggggtcgtgtgcgcagcaatactgcgtcggcacgtgggcccgggagagggggctgtgcagtggatgaaccggctgatagcgttcgcttcgcggggtaaccacgtctcccccacgcactatgtgcctgagagcgacgctgcggcgcgtgttactcagatcctctccggccttaccatcactcagctgctgaagaggcttcatcagtggatcaatgaggactgctccacgccatgctccggctcgtggttaagggatgtttgggactggatatgcacggtgttgactgacttcaagacctggctccagtccaagctcctgccgcggttgccgggagtccccttcttctcgtgccaacgcgggtacaagggagtttggcggggggatggcatcatgcaaaccacctgccaatgtggagcacaaatcaccggacatgtaaaaaatggttccatgaggatcgtcgggcctaggacctgcagcaacacgtggcatggaacattccccatcaacgcatacaccacgggcccctgcacaccctccccagcgccaaactattccagggcgctgtggcgagtggctgccgaggagtacgtggaggttacgcgggtgggggatttccactacgtgacgggcatgaccactgacaacgtaaagtgcccgtgccaggttccggcccccgaattcttcacggaagtggatggagtgcggttgcacaggtacgctccggcatgcaagcctctcctacgggaggaggtctcattccaggtcgggctcaaccaatacctggttgggtcacaactcccatgcgagcccgaaccggacgtaacagtgctcacttccatgctcaccgacccctcccacattacagcagagacggcaaagcgtaggctggccagggggtctcccccctccttggccagctcttcagctagccagttgtctgcgccttccttgaaggcgacatgcactacccatcatgactccccggacgccgatctcatcgaggccaacctcctgtggcggcaggagatgggcgggaacatcacccgcgtggagtcagaaaataaggtagtgatcttggactctttcgactcgcttcgagcagaggaggacgagagggaaccatccgttccggcggagatcttgcggaaatccaagaagttccccctggcgatgcccatatgggcacgtccggattataaccctccattgctggagtcctggaaggacccggactacgtccctccggtggtacacgggtgcccattgccacctaccaaggcccctccaataccgcccccacgaaggaagaggacggttgtcctgacagagtccactgtgtcttctgccttagcggagctcgccaccaagaccttcggcagctccggatcatcggccgttgacagcggcacggcgaccgcccccccagatcaggcctctgatgacggcgacaaaggatccgacgttgagtcgtattcctccatgccccctcttgagggagagccgggggaccccgatctcagcgacgggtcttggtctaccgtgagcgaggaggctagtgaggacgtcgtctgctgctcaatgtcctacacatggacaggcgccctgatcacaccatgcgctgcggaagaaagcaagctgcccatcaacccgctgagcaactctttgctgcgtcaccacaatatggtctatgccacaacatctcgcagtgcaggcctacggcagaagaaggtcacttttgacagactgcaagtcctggacgaccactaccgggacgtgctcaaggagatgaaggcgaaggcgtccacagttaaagccaaacttctatccgtagaagaagcctgtaagctgacgcccccacactcggccagatctaaatttggctatggggcgaaggacgtccggaacctatccagcaaggccgttaaccacatccgctccgtgtggaaggacttgctggaagacactgaaacaccacttgacactaccgtcatggcaaaaaatgaggtcttctgcgtccaaccagagaaaggaggccgcaagccagcccgccttatcgtattcccagacctgggggttcgtgtatgcgagaagatggccctttacgacgtggtctccacccttcctcaagccgtgatgggctcctcatacggattccagtactctcctggacagcgggttgagttcctggtgaacacctggaaatcaaagaagaaccctatgggcttctcatatgacacccgctgtttcgactcaacggtcactgagagtgacatccgtgttgaggagtcaatctaccaatgttgtgacttagcccccgaagccagacaggtcataaagtcgctcacagagcggctctatatcgggggccccctgactaattcaaaagggcagaactgcggttatcgtcggtgccgcgcgagcggcgtgctgacgactagctgcggtaacacccttacatgttacttgaaggcctctgcagcctgtcgagctgcgaagctccgggactgcacgatgctcgtgaacggagacgaccttgtcgttatctgtgaaagcgagggaacccaggaggatgcggcgagcctacgagtcttcacggaggctatgactaggtactctgccccccccggggacctgcctcaaccagaatacgacctggagctgataacatcatgttcctccaatgtgtcggtcgcgcacgatgcatctggcaaaagggtgtactatctcacccgtgatcccaccaccccccttgcacgggctgcgtgggagacagctagacacactccagtcaactcctggctaggcaacatcatcatgtatgcgcccaccttatgggcaaggatgattctgatgactcactttttctccatccttctagctcaggagcaacttgagaaagccctagattgtcagatctacggggcctgttactccattgagccacttgacctacctcagatcattgagcgactccatggtcttagcgcattctcactccacagttattctccaggtgagatcaatagggtggcttcatgcctcaggaaacttggggtaccacccttgcgagtctggagacatcgggccagaagtgtccgcgctaagctactgtcccagggggggagggctgccacttgtggcaagtacctcttcaactgggcagtaaggaccaagcttaaactcactccaatcccggccgcgtcccagttggacttgtccggctggttcgttgctggttacagcgggggagacatatatcacagcctgtctcgtgcccgaccccgctggttcatgttgtgcctactcctactttccgtaggggtaggcatctacctgctccccaatcgctgaacggggagctaaccact

SEQ ID NO: 655 - DNA, 9379 bp, Hepatitis C Virus
  misc_feature 7892: n = A,T,C or G
ttgggggcgacattccaccatagataattcccctgtgaggaattactgttttaacgcagaaagcgtttagccatggcgttagtatgagtgtcgtgcagcttccaggaccccccctcccgggagagccatagtggtctgcggaaccggtgagtacaccggaattgccaggatgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcatcatgagcacaaatcctaaaccccaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcacaacctcgcggaaggcgacaacctatccccaaggctcgccatcccgagggcagggcctgggctcagcctgggtacccttggcccctctatggcaatgagggcatggggtgggcaggatggctcctgtcgccccgcggctctcggcctagttggggccccacggacccccggcgtaggtcgcgtaatttgggtaaggtcatcgataccctcacatgcggctttgccgacttcatggggtacattccgctcgtcggcgcccccctagggggtgttgccagggtcctggcacatggtgtccgggctctggaggacggcgtgaattatgcaacagggaatttgcccggttgctctttctctatcttcctcttggctctgctgtcctgtttgaccatcccagcttccgcttatgaagtgcacaacgtgtccggggtgtaccatgtcacgaacgactgttccaactcaagcattgtgtatgagacagcggacatgatcatgcatgcccccgggtgcgtgccctgtgttcgggaggataactcctcccgttgctgggtagcgctgactcccacgttagcggccaggaatgccaccgtccccactacgacaatacgacgtcatgtcgacttgctcgttggggcggctactttctgctccgtcatgtacgtgggagatctctgcggatctgttttcctcgtctcccagctgttcaccttctcgcctcgttggcatgagacagtgcaggactgcaactgctcaatctatcccggccacgtgacaggtcaccgtatggcttgggatatgatgatgaattggtcgcccacagcagccttggtggtgtcgcagttgctccggatcccacaaaccgtcgtggatatgatggcgggggctcactggggagtcctagcgggccttgcctactattccatggtggggaactgggctaaggtgttgattgtgatgctacttttcgccggcgttgatgggtcaacctacgcgtcgggggcggcatcaggccgcagcacccatgcagtaacgaggttgttctcattcggggcgtctcagaaaatccagcttataaataccaatggcagctggcacatcaacaggactgccttgaactgcaatgactccctccagactgggtggcttgctgcgctgttctacacgcacaagttcaactcgtctggatgcccggagcgcatggccagctgccgctccattgacaagttcgatcaggggtggggtcccatcacttatgctagccctggcggccaggatcaaaggccttattgctggcactacgcaccaaagcagtgtggtatcgtacccgcgtcgcaggtgtgtggtccagtgtattgcttcaccccaagcccagttgtggtggggacgaccgatcggttcggtgtccctacgtatagctggggggagaacgagacggacgtgctgcttttaaacaacacgcggccgccgcaaggcaactggttcggctgcacatggatgaatggcactgggttcaccaagacatgcgggggccccccgtgtaacatcgggggggtcggcaataacaccttgacctgccccacggactgcttccggaagcaccccgaggccacttacacaaaatgtggttcggggccttggttgacacccaggtgcatggttgactacccatacaggctctggcactacccctgcactgtcaacttttccatctttaaggtcaggatgtatgtggggggcgtggagcacaggcttaatgctgcatgcaattggacccgaggggagcgctgtgacttggaggacagggataggtcggagctcagcccgctgctgctgtctacaacagagtggcaggtgctgccctgttccttcaccaccctaccggctctgtccactggtttaatccatcttcaccagaacatcgtggacgtgcaatacctgtacggtatagggtcggcggttgtctcctatgcaatcaaatgggagtatgtcatattgcttttccttctcctggcggacgcgcgcgtctgtgcctgcttgtggatgatgttgctgatagcccaggccgaggccgccctggagaacctggtggttctcaatgcggcgtccgtggccggagcgcatggcattctctcctttcttgtgttcttctgtgccgcctggtacatcaaaggcaggctcgtccctggggcggcatatgctttttatggcgtatggccgctgctcctgctcctgctggcgttaccaccacgagcttacgccatggaccgggagatggctgcatcgtgcgggggcggggttttcataggtctggcactcctgaccttgtcaccatactataaagaattcctcgctaggctcatatggtggttacaatattttatcaccagagccgaggcgcacttgcaagtgtggatcccccccctcaacgttcggggaggccgcgatgccatcatcctcctcgtgtgtgcggtccacccagagctaatctttgacatcaccaaaattctgctcgccatcttcggtccgctcatggtgctccaggctagtataacccgagtgccgtacttcgtgcgcgctcaagggctcatccgtgcatgcatgctggtgcggaaagccgccgggggtcattatatccaaatggccttcatgaagctggccgcgctgacaggcacgtacgtgtacgaccaccttactcctctgcgggactgggcccacgtgggcctacgagatctcgcggtagcagtagagcccgttgtcttctctgacatggagaccaagatcatcacctggggggcggacaccgcggcatgtggggacatcatctggggtctacctgtctccgcccgaagggggaaggagatacttctgggaccggctgacagtcttgaagggcaggggtggcggctccttgctcccatcacggcctactcccaacagacgcggggcctacttggttgcatcgtcactagccttacaggccgggacaagaaccaggtcgagggggaggttcaagtggtttccaccgcaacacaatctttcctggcgacctgcgtcaatggcgcgtgttggactgtcttccatggtgctggctcaaagacgctagccggcccacaaggtccgatcacccagatgtacaccaatgtagaccaggaccttgtcggctggcaggcgccccccgggtcacgctccctgacaccatgcacctgcggcagctcggacctttatttggtcacgagacatgccgatgtcattccggtgcgccgacggggcgacactagggggagcctactctctcccaggcctgtctcttatttgaagggctcttcgggaggcccactactctgcccttcggggcacgttgtgggcatcttccgggctgctgtgtgcacccggggggtcgcgaaggcggtggacttcatacccgttgagtctatggaaactacaatgcggtctcctattttcacagacaactcatcccccccagcggtaccgcagacattccaagtggcccatctacacgcccccactggcagcggcaagagcactaaagtgccggctgcatatgcggcccaagggtacaaagtactcgtcttgaacccgtccgttgccgccaccttgggttttggggcgtacatgtctaaagcacatggtgttgaccccaacatcagaactggggtaaggaccatcaccacgggcgcccctatcacatactccacctatggcaagttccttgccgacggtggctgctccgggggcgcctatgacatcataatgtgtgatgagtgccactcaactgactcaactagcatcttgggcattggcacggtcctggaccaagctgagacggctggagcacgtctcgtcgtgctcgccaccgctacgcctccgggatcggtcaccgtgccacaccccaacatcgaggaggtggccctgtccaacactggagagatccccttctacggcaaagccatccccattggggtcatcaagggggggaggcatctcattttctgtcactccaagaagaagtgtgacgagctcgccgcaaagctgtcagccctcggactcaatgccgtagcatattatcggggtctcgatgtgtccgtcatacctaccagcggagacgtcgttgtcgtagcgacagacgctctaatgacgggctttaccggcgactttgactcagtaatcgactgtaacacatgtgtcacccagacagtcgattttagcttagatcccaccttcaccattgagacgacaaccgtgccccaagacgcggtgtcgcgctcgcagcggcgaggtaggactggcaggggcaggagaggcatctacaggtttgtgactccaggagaacggccctcgggcatgttcgattcctcggtcctgtgtgagtgctatgacgcgggctgtgcttggtacgagctcacgcctgccgagaccacagtcaggttgcgggcttacctaaatacaccagggttgcccgtctgccaggaccatctggagttctgggagggcgtcttcacaggcctcacccacatagatgcccactttctgtcccagactaagcaggcaggggacaacttcccctacctggtagcataccaagccacagtgtgcgccagagctcaggctccacctccatcgtgggatcaaatgtggaagtgtctcatacggctcaaacctacgctgcacgggccaacacccctgctgtataggctaggagccgtccaaaatgaggtcaccctcacacaccccgtgaccaaatacatcatgacatgcatgtcggctgacctagaagtcgtcactagcacctgggtgctagtaggcggagttctcgcagccctggccgcatattgcttgacaacaggcagcgtggtcatcgtgggtaggatcatcttgtccgggaggccggctgttattcccgacagagaaattctctaccgggagttcgatgaaatggaagagtgcgcttcacacctcccttacatcgaacagggaatgcagctcgccgagcaattcagacagaaggcgctcgggttgctgcagacagctaccaagcaagcggaggctgctgctcccgtggtggaatccaagtggcgaggccttgagaccttttgggcgaagcacatgtggaatttcatcagcgggatacagtacctagcaggcttatccactctgcctgggaaccccgcgatagcatcactgatggcattcacggcctctatcaccagcccgctcaccacccaaaataccctcctatttaacatcttggggggatgggtggctgcccaactcgccccccccagcgctgcttcggctttcgtgggcgccggcatcgccggtgcggctgttggcagcataggctttgggaaggtgatcgtggacatcctggcgggatatggagcgggggtggctggcgcactcgtagccttcaaaatcatgagcggcgaggtgccttccaccgaggatctggttaatttgctccctgccatcctctctcccggtgccctggtcgtcggggtcgtgtgcgcagcaatactgcgtcggcacgtgggcccgggagagggggctgtgcagtggatgaaccggctgatagcgttcgcttcgcggggtaaccacgtctcccccacgcactatgtgcctgagagcgacgctgcggcgcgtgttactcagatcctctccggccttaccatcactcagctgctgaagaggcttcatcagtggatcaatgaggactgctccacgccatgctccggctcgtggctaagggatgtttgggactggatatgcacggtgttgactgacttcaagacctggctccagtccaagctcctgccgcggttgccgggagtccccttcttctcgtgccaacgcgggtacaagggagtttggcggggggatggcatcatgcaaaccacctgccaatgtggagcacaaatcaccggacatgtaaaaaatggttccatgaggatcgtcgggcccagaacctgcagcaacacgtggcatggaacattccccatcaacgcatacaccacgggcccctgcacaccctccccagcgccaaactattccagggcgctgtggcgagtggctgccgaggagtacgtggaggttacgcgggtgggggatttccactacgtgacgggcatgaccactgacaacgtaaagtgcccgtgccaggttccggcccccgagttcttcacggaagtggatggagtgcggttgcacaggtacgctccggcatgcaagcctctcctacgggaggaggtctcattccaggtcgggctcaaccaatacctggttgggtcacaactcccatgcgagcccgaaccggacgtaacagtgcccacttccatgctcaccgacccctcccacattacagcagagacggcaaagcgtaggctggccagggggtctcccccctccttggccagctcttcagctagccagttgtctgcgccttccttgaaggcgacatgcactacccatcatgactccccggacgccgacctcatcgaggccaacctcctgtggcggcaggagatgggcgggaacatcactcgcgtggagtcagaaaataaggtagtgatcctggactctttcgactcgcttcgagcagaggaggacgagagggaaccatccgttccggcggagatcttgcggaaatccaagaagttccccctagcgatgcccatatgggcacgtccggattataaccctccattgctggagtcctggaaggacccggactacgtccctccggtggtacacgggtgcccattgccacctaccaaggcccctccaataccgcccccacgaaggaagaggacggttgtcctgacagagtccactgtgtcttctgccttagcggagctcgccaccaagaccttcggcagctccggatcatcggccgttgacagcggcacggcgaccgcccccccagatcaggcctctgatgacggcgacaaaggatccgacgttgagtcgtattcctccatgccccctcttgagggagagccgggggaccccgatctcagcgacgggtcttggtctaccgtgagcgaggaggctagtgaggacgtcgtctgctgctcaatgtcctacacatggacaggcgccctgatcacaccatgcgctgcggaagaaagcaagctgcccatcaacccgctgagcaactctttgctgcgtcaccacaatatggtctatgccacaacatctcgcagtgcaggcctacggcagaagaaggtcacttttgacagactgcaagtcctggacgaccactaccgggacgtgctcaaggagatgaaggcgaaggcgtccacagttaaagccaaacttctatccgtagaagaagcctgtaagctgacgcccccacactcggccagatctaaatttggntatggggcgaaggacgtccggaacctatccagcaaggccgttaaccacatccgctccgtgtggaaggacttgctggaagacactgaaacaccacttgacactaccgtcatggcaaaaaatgaggtcttctgcgtccaaccagagaaaggaggccgcaagccagcccgccttatcgtattcccagacctgggggttcgtgtatgcgagaagatggccctttacgacgtggtctccacccttcctcaagccgtgatgggctcctcatacggattccagtactctcctggacagcgggttgagttcctggtgaacacctggaaatcaaagaaaaaccctatgggcttctcatatgacacccgctgtttcgactcaacggtcactgagagtgacatccgtgttgaggagtcaatctaccaatgttgtgacttagcccccgaggccagacaggttataaagtcgctcactgagcggctctatatcgggggccccctgactaattcaaaagggcagaactgcggttatcgtcggtgccgcgcgagcggcgtgctgacgactagctgcggtaatacccttacatgttacttgaaggcctctgcagcctgtcgagctgcgaagctccgggactgcacgatgctcgtgaacggagacgaccttgtcgttatctgtgaaagcgagggaacccaagaggatgcggcgagcctacgagtcttcacggaggctatgactaggtactctgccccccccggggacttgcctcaaccagaatacgacctggagctgataacatcatgttcctccaatgtgtcggtcgcgcacgatgcatctggcaaaagggtgtactatctcacccgtgaccccaccacccctcttgcacgggctgcgtgggagacagctagacacactccagtcaactcctggctaggcaacatcatcatgtatgcgcccaccttatgggcaaggatgattctaatgactcactttttctccatccttctagctcaggagcaacttgagaaagccctagattgtcagatctacggggcctgttactccattgagccacttgacctacctcagatcattgagcgactccatggtcttagcgcgttctcactccacagttactctccaggtgagatcaatagggtggcttcatgcctcaggaaacttggggtaccacccttgcgagtctggagacatcgggccagaagtgttcgcgctaagctactgtcccagggggggagggccgccacttgtggcaagtacctcttcaactgggcagtaaggactaagcttaaactcactccaatcccggccgcgtcccagttggacttgtccggctggttcgttgctggttatagcgggggagacatatatcacagcctgtctcgtgcccgaccccgctggttcatgttgtgcctactcctactttccgtaggggtaggcatctacctgctccccaatcgctgaacggggagctaaccact

SEQ ID NO: 656 - DNA, 9379 bp, Hepatitis C Virus
ttgggggcgacactccaccatagatcactcccctgtgaggaactactgtcttcacgcagaaagcgtctagccatggcgttagtatgagtgtcgtgcagcttccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacaaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggcaggacctgggctcagcccgggtacccttggcccctctatggcaatgagggcatggggtgggcaggttggctcctgtcaccccgcggctctcggcctagttggggccccactgacccccggcgtaggtcgcgtaatttgggtaaggtcatcgataccctcacatgcggcttcgccgacctcatggggtacattccgctcgtcggcgcccccctagggggcgctgccagggccctggcacatggtgtccgggttctggaggacggcgtgaactatgcaacagggaatttgcccggttgctctttctctatcttcctcttggctctgctgtcctgtttgaccatcccagcttccgcttatgaagtgcgcaacgtgtccgggatataccatgtcacgaacgactgctccaactcaagcattgtgtatgaggcagcggacgtgatcatgcacacccccgggtgcgtgccctgcgttcgggagagcaactcctcccgttgctgggtagcgctcactcccacgctagcggccaggaatgccagcatccccactacgacaatacgacgccacgtcgacttgctcgttgggacggctgctttctgctccgctatgtacgtgggggacctctgcggatctgttttcctcatctcccagctgttcaccttctcgcctcgccggcacgagacagtgcaggactgcaattgttcaatctatcccggccacgtatcaggtcatcgcatggcttgggatatgatgatgaactggtcacctacaacagctctggtagtgtcgcagttactccggatcccacaagccgtcgtggacatggtggcgggggcccactggggagtcctagcgggccttgcctactattccatggcggggaattgggctaaggttttgattgtgatgctactctttgccggcgttgacgggaacacctacacgtcagggggagtggtaggcaggcagacctccgggctcacgtccctcttctcagttggggcgtcccagaaaatccagcttataaacaccaatggcagttggcacatcaacaggactgccctgaactgcaatgactctctccagaccgggtttcttgccgcgctgttctacacacacaggttcaacgcgtccgggtgcccagggcgtatggccagctgccgccccatcgacaagttcgctcagggatggggtcccatcacttatgctgagcctgacagcccggaccagaggccttattgctggcactacgcacctaaaccgtgtggtatcgtacccgcgtcggaggtgtgtggtccggtgtattgtttcaccccaagccctgttgtggtggggacgaccgatcggtccggtgtccctacctatacctggggggagaataagacagacgtgctgctccttaacaacacgcggccgccgcaaggcaactggttcggctgtacatacatgaatgccactgggttcaccaagacgtgcgggggccccccatgtcacatcgggggggtcggcaacaacaccttgatctgtcccacggactgcttccggaagcaccccgaggccacttacacaaaatgtggctccggaccttggttgacacctaggtgcatagttgactacccatacaggctctggcactacccctgcaccgtcaacttcaccatcttcaaggtcaggatgtatgtggggggtgtggagcacaggctcaatgccgcatgcaattggacccgaggggaacgctgtgacttggaggatagggacaggtcagaactcagcccgctgctgctgtctacaacggagtggcagatactgccctgttccttcaccaccttgccggctctgtccactggtttgatccatctccatcagaacatcgtggacgtgcaatacctgtacggtatagggtcggcagtcgtttcctttgcaatcaaatgggagtatgtcttgctgcttttccttctcctggcggacgcgcgcgtctgcgcctgcttgtggatgatgctgctgatagcccaggctgaggccgccttagagaacctggtggtcctcaatgcggcgtccgtggcaagagcgcacggcattctctccttccttgtgttcttctgtgctgcctggtacatcaagggcaagctggtccctggggcggcatatgctatctatggcgtatggccgctgctcttgctcctgctggcattaccatcacgagcttacgccatggaccgggagatggctgcatcctgtgggggcggggtctttgtaggtctggcactcttgaccttgtcaccatactataaagtgttcctcgctaggctcatgtggtggttacagtattttatcaccagagccgaggcgcacttgcaagtgtgggttccccccctcaacgtccggggaggccgtgacgccatcatcctcctcgcgtgtgcggtccatccagagctaatctttgacatcaccaaacttctgctctccatactcggcccgctcatggtgctccaggctagcatagttcgagtgccgtacttcgtgcgcgctcaagggctcattcgtgcatgcatgttagtgcggaaagccgccgggggtcattatgcccaaatggtcctcgtgaggctggccgcgctgacaggtacgtacgtctatgaccatcttactccactgcgggattgggcccacgcgggcctacgagaccttgcggtggcagtagagcccgttgtcttctctgacatggagaccaaggtcatcacctggggggcggacaccgcggcgtgtggggacatcatttcgggtctgcccgtctccgcccggaggggaagggagatactcctgggaccggccgacagttatgaagggcaggggtggcggctccttgcgcccatcacggcctactcccaacagacccggggcctacttggttgcatcatcaccagcctcacgggccgggacaaaaaccaggtcgagggggaggttcaagtggtatccaccgcaacacaatctttcctggcgacctgcgttaacggcgcgtgttggactgtctttcacggcgctggctcaaagactctagccggcccaaaaggcccaatcacccaaatgtacaccaatgtagaccaggacctcgtcggctggcaggcgccccctggggcgcgctccctaacaccgtgcacctgcggcagctcggacctttacttggtcacgaggcacgctgatgtcattccggtgcgccggcggggcgacactagagggagtttgctctctcccaggcctgtctcctacttgaagggctcttcgggtggtccgctgctctgcccctcagggcatgctgtgggcatcttccgggctgccgtgtgcacccggggggttgcgaaggcggtggacttcatacccgttgaagctatggaaaccaccatgcggtctccggtgttcacagacaactcatctcctccggccgtaccgcagaccttccaggtggcccatctgcacgcccccactggcagcggtaagagcactaaggtgccggctgcatatgcagcccaagggtacaaggtgctcgtcctgaacccgtccgttgccgccaccttgggctttggggcgtacatgtctaaggcacatggcactgaacccaacatcagaactggggtaaggaccatcaccacgggcgcccccatcacgtactccacttacggcaagttccttgccgacggtggttgctccggaggagcctatgacatcataatatgtgatgagtgccactcaactgactcgactaccatcttgggcatcggcacagtcctggaccaagcggagacggctggagcgcggctcgtcgtgctcgccaccgctacgcctccgggatcggttaccgtgccacaccctaatattgaggaggtggccctgtccaacactggagagatccccttctacggcaaggccatccccattgaggtcatcaagggggggaggcacctcattttctgccattccaagaagaagtgtgacgagctcgccgcaaagttgtcagccctcggactcaatgctgtagcatattaccgggggctcgacgtgtccgtcataccgaccagcggagacgtcgttgtcgtggcgacagacgctctaatgacgggcttcaccggcgactttgactcagtgatcgactgtaacacatgtgtcacccagacagtcgacttcagcttggatcccactttcaccattgagacgacgaccgtgccccaagacgcggtgtcgcgctcgcagcggcgaggtaggactggcaggggtaggagaggcatctacaggtttgtgactccaggagaacggccctcaggcatgttcgactcctcggtcttgtgcgagtgctatgatgcgggctgtgcttggtacgagctcacgcctgctgagacctcagttaggctgcgggcttacctaaatacaccagggttacccgtatgccaggaccatctggagttctgggagagtgtcttcacaggcctcacccacatagacgcccactttctgtcccagactaaacaggcaggagacaacttcccctacctggtagcataccaagctacagtgtgcgccagagctcaggccccacctccatcgtgggatcaaatgtggaagtgtctcatacggctcaaacccacgctgcatgggccaacacccttgctgtataggctaggagccgtccaaaatgaggtcaccctcacacaccccataaccaaattcatcatggcatgcatgtcggccgacctggaggtcgtcactagcacctgggtgctggtaggcggagtccttgcagccctggccgcatattgcttgacaacgggcagtgtggtcattgtgggcaggatcatcttgtccgggaggccggctgttattcccgacagggaagttctctaccgggagttcgatgagatggaagagtgcgcctcacacctcccttacatcgaacaggggatgcagctcgccgagcaattcaaacagaaagcgctcgggttgctgcaaacagccaccaagcaagcggaggctgctgctcccgtggtggaatccaagtggcgagccctcgaggccttttgggcgaagcacatgtggaatttcatcagcggaatacagtacttggcaggcttatccactctgcctggcaaccccgcgatagcatcactgatggcattcacagcctctatcactagcccgctcaccacccaaagtacccttctgtttaacatcttggggggatgggtggctgcccaactcgccccccccagtgctgcttcggctttcgtgggcgccggcatcgccggcgcggccgttggcagcataggccttgggaaggtgcttgtggacatcctggcgggctatggggcaggagtggctggcgcactcgtagcctttaagatcatgagcggcgaggtgccctccaccgaggacctggttaatttgctccctgccatcctctcccccggtgccctggtcgtcggagtcgtgtgcgcagcaatactgcgtcggcacgtgggcccgggagagggggctgtgcagtggatgaaccggctgatagcgttcgcttcgcggggtaaccacgtctcccccacgcactatgtgcctgagagcgacgctgcagcgcgtgttactcagatcctctccagccttaccatcactcagttgctgaagaggcttcaccagtggatcaatgaggactgctccacgccatgttccggctcgtggctaagggatgtttgggattggatatgcacggtgttgagtgacttcaagacctggctccagtccaagctcctgccgcggttaccgggactccccttcctctcatgccaacgcgggtacaagggagtctggcggggggacggcatcatgcaaaccacctgcccatgtggagcacagatcaccggacatgtcaaaaatggttccatgaggatcgttgggcctaagacctgcagcaacacgtggcatggaacattccccatcaacgcgtacaccacgggcccttgcacaccctccccggcgccaaactattccagggcgctgtggagggtggctgctgaggagtacgtggaggtcacgcgggtgggggatttccactacgtgacgggcatgactaatgacaacataaagtgcccatgccaggttccagcccccgaattcttcacggaagtggatggagtacggttgcacaggtacgctccggcgtgcaaacccctcctacgggaggaggtcacattccaggtcgggctcaaccaatatttggttgggtcgcagctcccatgtgagcccgaaccggatgtagcagtgctcacctccatgctcaccgacccctcccacataacagcagagacggctaggcgtaggctggccagggggtctcccccctccttggctagctcctcagccagccagttatctgcgccttctttgaaggcgacatgcactaccaatcatgactccccggacgctgacctcatcgaggccaacctcctgtggcggcaggagatgggcgggaacatcacccgcgtggagtcagagaacaaggtagtaattctggactctttcgacccgcttcgagcggaggaggatgagagggaaccatccgttccggcggagatcctgcggaaatccaggaagttccccatggcgatgcccgtatgggcacggccggattacaaccctcccctgctagagtcctggaaggacccggactacgtccctccggtggtgcacgggtgcccattgccacctaccaaggcccctccaataccacctccacggagaaaaaggacggttgtcctgacagaatccaccgtgtcttctgccttggcggagcttgctaccaaaaccttcggcagctccggatcgtcggccgtcgacagcggcacggcgaccgcccctcccgaccaggcctccgacgacggcgacaaaggatccgacgttgagtcgtactcctccatgcccccccttgagggggagccgggggaccccgatctcagcgacgggtcttggtctaccgtgagcgaggaggctagtgaggacgttgtttgctgttcaatgtcctacacatggacgggcgccttgatcacgccatgcgccgcggaggagagcaagctgcccatcaactcgttgagcaactccttgttacgccatcataacatggtctatgctacaacatcccgcagcgcaagcctacggcagaagaaggtcacctttgacagactgcaagtcctggacgaccactaccgggacgtgctcaaggagatgaaggcgaaggcgtccacagttaaggctaaacttctatctatagaagaagcctgcaaactgacgcccccacattcggccaaatccaaatttggctatggggcaaaggacgtccggaacctaaccggcaaggccgtcaaccacatccgctccgtgtggaaggacttgctggaagacactgagacaccaattgacaccacagtcatggcaaaaaatgaggttttctgtatccaaccagagaaaggaggccgcaagccagctcgcttgatcgtattcccagatctgggagttcgtgtatgcgagaaaatggccctttacgacgtggtctccacccttcctcaggccgtgatgggctcctcgtacggatttcagtactcccccaagcagcgggtcgagttcctggtgaatgcctggaaatcaaagaagtgccctatgggcttctcatatgacacccgctgttttgactcaacggtcactgagaacgatatccgtgttgaggagtcgatttaccaatgttgtgacctggcccccgaagccagacaggccataaagtcgctcacagagcggctctatatcgggggtcccctgactaattcaaaagggcagaactgcggctatcgtcgctgccgcgcaagcggcgtgctgacgaccagctgcggtaataccctcacatgttacttgaaagcctctgcggcctgtcgagctgcgaagctccaggactgcacgatgctcgtgaacggagacgacctagtcgttatctgtgagagtgcggggacccaggaggatgcggcgaacctacgagtcttcacggaggctatgactaggtactctgccccccccggcgacccgcctcaaccagcgtacgacttggagctgataacatcatgctcctccaatgtgtcggtcgcgcacgatgcatctggcaaaagggtgtactacctcacccgcgaccccaccaccccctttgcacgggctgcgtgggagacagctagacacactccagtcaactcctggctaggcaacatcatcatgtatgcgcccaccttatgggcaaggatggttctgatgactcacttcttctccatcctcctagcccaggagcaacttgaaaaagccctagattgtcagatctacggggcccactactccattgagccacttgacctacctcagatcattgaacgactccatggtcttagcgcattttcactccatagttactctccaggtgagatcaatagggtggctgcatgcctcaggaaacttggggtaccacccttgcgagtctggagacatcgggccagaagtgtccgcgctaagctactgtcccagggggggagggctgccacttgtggcaagtacctcttcaattgggcagtaaggaccaaacttaaactcactccaatcccggctgcgtctcagttggacttgtccagctggttcgtcgctggttacagcgggggagacatatatcacagcctgtctcgtgcccgaccccgctggttcatgttgtgcctactcctactttccgtaggggtaggcatctacctgctccccaaccgatgaacggggagctaaccact

SEQ ID NO: 657 - DNA, 9379 bp, Hepatitis C Virus
  misc_feature 1542: n = A,T,C or G
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacaaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggcaggacctgggctcagcccgggtacccttggcccctctatggcaatgagggcatggggtgggcaggttggctcctgtcaccccgcggctctcggcctagttggggccccactgacccccggcgtaggtcgcgtaatttgggtaaggtcatcgataccctcacatgcggcttcgccgacctcatggggtacattccgctcgtcggcgcccccctagggggcgctgccagggccctggcacatggtgtccgggttctggaggacggcgtgaactatgcaacagggaatttgcccggttgctctttctctatcttcctcttggctctgctgtcctgtttgaccatcccagcttccgcttatgaagtgcgcaacgtgtccgggatataccatgtcacgaacgactgctccaactcaagcattgtgtatgaggcagcggacgtgatcatgcacacccccgggtgcgtgccctgcgttcgggagagcaactcctcccgttgctgggtagcgctcactcccacgctagcggccaggaacgccagcgtccccactacgacaatacgacgccacgtcgacttgctcgttgggacggctgctttctgctccgctatgtacgtgggggacctctgcggatctgttttcctcatctcccagctgttcaccttctcgcctcgccggcacgagacagtgcaggactgcaattgttcaatctatcccggccacgtatcaggtcatcgcatggcttgggatatgatgatgaactggtcacctacaacagctctggtagtgtcgcagttactccggatcccacaagccgtcgtggacatggtggcgggggcccactggggagtcctagcgggccttgcctactattccatggcggggaattgggctaaggttttgattgtgatgctactcttcgccggcgttgacggggaaacccacacgacagggggggcggtaagcaggcacacctacaggttcgcgtccctcttctcanttggggcatcccagaaaatccagcttataaacaccaatggcagttggcacatcaacaggaccgccctgaactgcaatgactccctccagaccgggttccttgccgcgctgttctacacacacaggttcaacgcgtccgggtgcccagggcgtatggccagctgccgccccattgacaagttcgctcagggatggggtcccatcacttatgctgagcatgacagcccggaccagaggccttattgctggcactacgcacctaaaccgtgtggtatcgtacccgcgtcggaggtgtgtggtccggtatattgtttcaccccaagccctgttgtggtggggacgacagatcggtccggtgtccctacctatacctggggggagaataagacagacgtgctgctccttaacaacacgcggccgccgcaaggcaactggttcggctgtacatacatgaatgccactgggttcaccaagacgtgcgggggccccccatgtcacatcgggggggtcggcaacaacaccttgatctgtcccacggactgcttccggaagcaccccgaggccacttacacaaaatgtggctcgggaccttggttgacacctaggtgcatagttgactacccatacaggctctggcactacccctgcaccgtcaactttaccatcttcaaggtcaggatgtatgtagggggtgtggagcacaggctcaatgccgcatgcaattggacccgaggggaacgctgtgacttggaggatagggacaggtcagaactcagcccgctgctgctgtctacaacggagtggcagatactgccctgttcctttaccaccttgccggctctgtccactggtttgatccatctccatcagaacatcgtggacgtgcaatacctgtacggtatagggtcggcggtcgtttcctttgcaatcaagtgggagtatgtcttgctgcttttccttctcctggcggacgcgcgtgtctgcgcctgcttgtggatgatgctgctgatagcccaggctgaggccgccttagagaacctggtggtcctcaatgcggcgtccgtggccagagcacacggcattctctccttccttgtgttcttctgtgctgcctggtacatcaagggcaagctggtccctggggcggcatatgctatctatggcgtatggccgctgctcttgctcctgctggcattaccatcacgggcttacgccatggaccgggagatggctgcatcctgtgggggcggggtctttgtaggtctagcactcctgaccttgtcaccatactataaagtgttcctcgctaggctcatgtggtggttacagtattttatcaccagagccgaggcgcacttgcaagtgtgggttccccccctcaacgtccggggaggccgtgacgccatcatcctcctcgcgtgtgcggtccatccagagctaatttttgacatcaccaaacttctgctctccatactcggcccgctcatggtgctccaggctagcatagtccgagtgccgtacttcgtgcgcgctcaagggctcattcgtgcatgcatgttagtgcggaaagccgccgggggtcattatgcccaaatggtcctcgtgaggctggccgcgctgacaggtacgtacgtctatgaccatctcaccccactgcaggactgggcccacgcgggcctacgagaccttgcggtggcagtagagcctgttgtcttctctgacatggagaccaaggtcatcacctggggggcggacaccgcggcgtgtggggacatcatttcgggtctgcccgtctccgcccggaggggaagggagatacttctgggaccggccgacaattatgaagggcaggggtggcgactccttgcgcccatcacggcctactcccaacagactcggggcctacttggttgcatcatcaccagcctcacgggccgggacaaaaaccaggtcgagggggaggttcaagtggtatccaccgcaacacaatctttcctggcgacctgcgtcaacggcgcgtgttggactgtctttcacggcgctggctcaaagaccctagccggcccaaaaggcccaatcacccaaatgtacaccaatgtagaccaggacctcgtcggctggcaggcgccccctggggcgcgctccctaacaccatgcacctgcggcagctcggacctttacttggtcacgaggcacgccgatgtcattccagtgcgccggcggggcgacactagagggagcttgctctctcccaggcctgtctcctacttgaagggctcttcgggtggtccgctgctttgcccctcagggcatgctgtgggcatcttccgggctgccgtgtgcacccggggggttgcgaaggcggtggacttcatacccgttgaagccatggaaaccaccatgcggtctccggtgttcacagacaactcatctcctccggccgtgccgcagaccttccaggtggcccatctgcacgcccccactggcagcggtaagagcactaaggtgccggctgcatatgcagcccaagggtacaaggtgctcgtcctgaacccgtccgttgccgccaccttgggctttggggcgtacatgtctaaggcacatggcactgaacccaacatcagaactggggtaaggaccatcaccacgggcgcccccatcacatactccacttacggcaagttccttgccgacggtggttgctccggaggcgcctatgacatcataatatgtgatgagtgccactcaactgactcgactaccatcttgggcatcggcacagtcctggaccaagcggagacggctggagcgcggctcgtcgtgctcgccaccgctacgcctccgggatcggttaccgtgccacaccctaacattgaggaggtggccctgtccaacactggagagatccccttctacggcaaggccatccccattgaggtcatcaagggggggaggcacctcattttctgccattccaagaagaagtgtgacgaactcgccgcaaagttgtcagccctcggactcaatgctgtagcatattaccgggggctcgacgtgtccgtcataccgaccagcggagacgtcgttgtcgtggcgacagacgctctaatgacgggcttcaccggcgactttgactcagtgatcgactgtaacacatgtgtcacccagacagtcgacttcagcttggatcccactttcaccattgagacgacgaccgtgccccaagacgcggtgtcgcgctcgcagcggcgaggtaggactggcaggggcaggagaggcatctacaggtttgtgactccaggagaacggccctcaggcatgttcgactcctcggtcttgtgtgagtgctatgatgcgggctgtgcttggtacgagctcacgcctgctgagacttcagttaggctgcgggcttacctgaatacaccagggttacccgtatgccaggaccatctggagttctgggagagtgtcttcacaggcctcacccacatagacgcccactttctgtcccagactaaacaggcaggagacaacttcccctacctggtagcataccaagctacagtgtgcgccagagctcaggccccacctccatcgtgggatcaaatgtggaagtgtctcatacggctcaaacccacgctgcatgggccaacacccctgctgtataggctaggagccgtccaaaatgaggtcaccctcacacaccccataaccaaattcatcatggcatgcatgtcggccgacctggaggtcgtcactagcacctgggtgctggtaggcggagtccttgcagccctggccgcatattgcttgacaacgggcagtgtggtcattgtgggcaggatcatcttgtccgggaggccggctgttattcccgacagggaagttctctaccgggagttcgatgagatggaagagtgcgcctcacacctcccttacatcgaacaggggatgcagctcgccgagcaattcaaacagaaagcgctcgggttgctgcaaacagccaccaagcaagcggaggctgctgctcccgtggtggaatccaagtggcgagccctcgaggccttttgggcgaagcacatgtggaatttcatcagcggaatacagtacttggcaggcttatccactctgcctggcaaccccgcgatagcatcactgatggcattcacagcctctatcactagcccgctcaccacccaaagtacccttctgtttaacatcttggggggatgggtggctgcccaactcgccccccccagtgctgcttcggctttcgtgggcgccggcatcgccggcgcggccgttggcagtataggccttgggaaggtgcttgtggacatcctggcgggctatggggcaggagtggctggcgcactcgtagcctttaagatcatgagcggcgaggtgccctccaccgaggacctggttaatttgctccctgccatcctctcccccggcgccctggtcgtcggagtcgtgtgcgcagcaatactgcgtcgacacgtgggcccgggagagggggctgtgcagtggatgaaccggctgatagcgttcgcttcgcgggggaaccacgtctcccccacgcactatgtgcctgagagcgacgctgcagcgcgtgttactcagatcctctccagccttaccatcactcagttgctgaagaggcttcaccagtggatcaatgaggactgctccacgccatgttccggttcgtggctaagggatgtttgggattggatatgcacggtgttgagtgacttcaagacctggctccagtccaaactcctgccgcggttaccgggactccccttcctctcatgccaacgcgggtacaagggagtctggcggggggacggcatcatgcaaaccacctgcccgtgtggagcacagatcaccggacatgtcaaaaatggttccatgaggatcgttgggcctaagacctgcagcaacacgtggcatggaacattccccatcaacgcgtacaccacgggcccttgcacaccctccccggcgccaaactattccagggcgctgtggagggtggctgctgaggagtacgtggaggtcacgcgggtgggggatttccactacgtgacgggcatgactaatgacaacataaagtgcccatgccaggttccagcccccgaattcttcacggaagtggatggggtacggttgcacaggtacgctccggcgtgcaaacctctcctacgggaggaggtcacattccaggtcgggctcaaccaatatctggttgggtcgcagctcccatgtgagcccgaaccggatgtagcagtgctcacctccatgctcaccgacccctcccacataacagcagagacggctaggcgtaggctggccagggggtctcccccctccttggctagctcctcagccagccagttatctgcgccttctttgaaggcgacatgcactaccaatcatgactccccggacgctgacctcatcgaggccaacctcctgtggcggcaggagatgggcgggaacatcacccgcgtggagtcagagaacaaggtagtaattctggactctttcgacccgcttcgagcggaggaggatgagagggaaccatccgttccggcggagatcctgcggaaatccaggaagttccccatggcgatgcccgtatgggcacggccggattacaaccctcccctgctagagtcctggaaggacccggactacgtccctccggtggtgcacgggtgcccattgccacctaccagggcccctccaataccacctccacggagaaagaggacggttgtcctgacagaatccaccgtgtcttctgccttggcggagcttgctaccaaaaccttcggcagctccggatcgtcggccgtcgacagcggcacggcgaccgcccctcccgaccaggcttccgatgacggcgacaaaggatccgacgttgagtcgtactcctccatgcccccccttgagggggagccgggggaccccgatctcagcgacgggtcttggtctaccgtgagcgaggaggctagtgaggacgttgtttgttgttcaatgtcctacacatggacgggtgccttgatcacgccatgcgccgcggaggaaagcaagctgcccatcaactcgttgagcaattccttgttacgccatcataacatggtctatgctacaacatcccgcagcgcaagcctacggcagaagaaggtcacctttgacagactgcaagtcctggacgaccactaccgggacgtgctcaaggagatgaaggcgaaggcgtccacagttaaggctaaacttctatctatagaagaagcctgcaaactgacgcccccacattcggccaaatccaaatttggctatggggcaaaggacgtccggaacctaaccggcaaggccgttaaccacatccgctccgtgtggaaggacttgctggaagacactgagacaccaattgacaccacagtcatggcaaaaaatgaggttttctgtatccaaccagagaaaggaggccgcaagccagctcgcttgatcgtattcccagatctgggagttcgtgtatgcgagaaaatggccctttacgacgtggtctccacccttcctcaggccgtgatgggctcctcgtacggatttcagtactcccccaagcagcgggtcgagttcctggtgaatgcctggaaatcaaagaagtgccctatgggcttctcatatgacacccgctgttttgactcaacggtcaccgagaacgatatccgtgttgaggagtcgatttaccaatgttgtgacctggcccccgaagccagacaggccataaagtcgctcacagagcggctctatatcgggggtcccctgactaattcaaaagggcagaactgcggctatcgtcgctgccgcgcaagcggcgtgctgacgaccagctgcggtaataccctcacatgttacttgaaagcctctgcggcctgtcgagctgcgaagctccaggactgcacgatgctcgtgaacggagacgacctagtcgttatctgtgagagtgcggggacccaggaggatgcggcgaacctacgagtcttcacggaggctatgactaggtactctgccccccccggtgacccgcctcaaccagcgtacgacttggagctgataacatcatgctcctccaatgtgtcggtcgcgcacgatgcatctggcaaaagggtgtactacctcacccgcgaccccaccaccccctttgcacgggctgcgtgggagacagctagacacactccagtcaactcctggctaggcaacatcatcatgtatgcgcccaccttatgggcaaggatggttctgatgactcacttcttctccatcctcctagcccaggagcaacttgaaaaagccctagattgtcagatctacggggcccactactccattgagccacttgacctacctcagatcattgaacgactccatggtcttagcgcattttcactccatagttactctccaggtgagatcaatagggtggctgcatgcctcaggaaacttggggtaccacccttgcgagtctggagacatcgggccagaagtgtccgcgctaagctactgtcccagggggggagggctgccacttgtggcaagtacctcttcaattgggcagtaaggaccaaacttaaactcactccaatcccggctgcgtctcagttggacttgtccagctggttcgtcgctggttacagcgggggagacatatatcacagcctgtctcgtgcccgaccccgttggttcatgttgtgcctactcctactttccgtaggggtaggcatctacctgctccccaaccgatgaacggggagctaaccact

SEQ ID NO: 658 - DNA, 9369 bp, Hepatitis C Virus
ttgggggcgacactccaccatagatcactcccctgtgaggaactactgtcttcacgcagaaagcgtctagccatggcgttagtatgagtgtcgtgcagcctccaggtccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcatcatgagcacaaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggcaggacctgggctcagcccgggtacccttggcccctctacggcaatgagggtctggggtgggcaggatggctcctgtcaccccgaggctctcggcctagttggggccccacggacccccggcgtaggtcgcgtaatctgggtaaggtcatcgatacccttacatgcggcttcgccgacctcatggggtacattccgcttgtcggcgcccccctaggaggcgctgccagggccctggcgcatggcgtccgggttctggaggacggcgtgaactatgcaacagggaatctgcccggttgctctttctctatcttcctcttagctttgctgtcttgtttgaccatcccagcttccgcttatgaagtgcgcaacgtgtccggggtgtaccatgtcacgaacgactgctccaactcaagtattgtgtatgaggcagcggacatgatcatgcacatccccgggtgcgtgccctgcgtacgggagggtaattcctcccgctgctgggtagcgctcacccccacgctcgcggccaggaacagcagcatccccatagcgacaatacgacgccacgtcgatttgctcgttggggcagctgctttctgttccgctatgtacgtgggggatctctgcggatccgttttcctcgtctcccaactgctcaccttctcacctcgccggtatgagacggtacaagactgcaattgctcaatctatcccggccacgtatcaggtcaccgcatggcctgggatatgatgatgaactggtcacctacaacggctctagtggtgtcgcagctactccggatcccacaagccaccctggacatggtggcgggggcccactggggagtcctagcgggccttgcctactattccatggtggggaactgggctaaggtcttggttgtgatgctactcttcgccggtgttgacgggaataccgtcgtgtcaggggggcaggcagcccgcaccaccagcagctttacgtccctcttcacaccagggccgtcccagaaaatccagctcgtaaactccaacggcagctggcacatcaacaggactgctctgaactgcaatgactccctcagcactgggtttcttgccgcgctgttctacacacacaggttcaactcgtccggatgcccggggcgtatggccagctgccgccccattgactcgttcgcccaggggtggggtcccatcactcatgttgagcctcagatcttggaccagaggccatattgctggcactacgcacctcaaccgtgcggtatcgtacctgcgtcgcaggtgtgtggtccagtgtactgcttcaccccaagccctgttgtggtggggacgactgatcgtttcggcgcccccacgtatagttggggggagaatgagacggacgtgctgctccttaacaacacgcggccaccccacggtaactggttcggctgtacatggatgaatagcaccgggttcaccaagacgtgcgggggccccccatgtaacatcgggggggtcggcaataacaccttgacctgccctacagattgcttccggaaacaccccgaagccacttacaccaaatgtggctcgggcccctggttgacacctaggtgtatagttgactatccatacagactttggcactacccctgcaccgtcaactttaccatcttcaaggtcaggatgtacgtggggggcgtggagcacaggctcaccgccgcgtgtaactggactcggggagagcgctgtgacttgacggacagggataggtcggagcttagcccgctgctactgtctacaacagagtggcagatactgccctgttccttcaccaccctaccggctctgtccactggtttgatccacctccaccagaacatcgtggacgtgcaatacctgtacggtgtggggtcagcggttgtctccgttgcaatcagatgggagtatgtcgtgctgctcttcctcctcctagcagacgcgcgcttttgcgcctgcttatggatgatgctgctggtggcccaggctgaggccgccttagagaacctagtggtcctcaatgcggcgtccgtggctggagcgcatggcattctctccttccttgtgttcttctgtgctgcctggtacattaagggcaagctggtccccggggcggcatatgctttttatggcgtatggccgctgctcctgctcctactggcgttaccaccacgagcatacgccatggaccgggagatggccgcatcatgcggaggcgcggtcttcataggtctggcactcttgaccttgtcaccacactataaagtgttcctcgctaggctcatatggtggtcacaatatcttatcaccagggccgaggcgcatttgcaagtgtgggtcccccctctcaacgttcgggggggccgcgatgccatcatcctcctcatgtgcgtgttccggccagagctaatttttgaaatcaccaagatcttgctcgccatactcgggccgctcacggtgctccaggctggcctaactagagtgccgtactttgtgcgcgcacaagggctcatccgtgcatgcatgttggtgcggaaagtcgctgggggtcattatgctcagatggctttcatgaagctggccgcactgacgggtacgtacgtttatgaccatcttactccactgcgggactgggcccatgcgggcctgcgagaccttgcggtggcagttgagcccgtcgtcttctctgacatggagaccaagatcattacctggggggcagacaccgcggcgtgcggggatatcatcttgggcctacctgtctccgcccgaagggggagggagatacttctaggaccagccgatagctttggagagcaagggtggcggctccttgcgcctatcacggcctattcccaacagacgcggggcctacttggctgtatagtcactagcctcacaggtcgggacaagaaccaggtcgagggggaggttcaggtggtctccaccgcgacgcaatctttcctggcgacctgcgtcaatggcgtgtgttggaccgtctaccatggcgccggctcgaagaccctagccggcccgaaggggccagtcacccaaatgtacaccaatgtggaccaggacctcgtcggctggccggcgccccctggggcgcgctccttgacaccatgtacgtgcggcagctcggacctttacttggtcacgaggcatgctgatgtcattccggtgcgccggcgaggcgacagcagggggagcctgctctcccccaggcccgtctcctacttgaagggctcttcaggtggtccactgctttgccccttagggcacgctgtgggcgtcttccgggctgctgtgtgcacccggggggttgcgaaggcggtggacttcatacccgttgagtctatggaaactactatgcggtctccggtttttacggataattcatctcccccggccgtaccgcagacattccaagtggcccatctacatgcccccactggcagcggcaagagcactaaggtgccggctgcatacgcagcccaggggtacaaggtacttgtcctgaacccgtccgttgctgccaccttaggttttggggcgtatatgtctaaggcacatggtgtcgaccccaacattagaactggggtaaggaccatcaccacgggcgctcccattacgtactccacctatggcaagttccttgccgacggtggttgctccgggggcgcctatgacatcataatgtgcgatgagtgccactcaactgactcgacttccattttgggcattggtacggtcctggaccaagcggagacggctggagcgcggctcgtcgtgctcgccaccgctacgcctccgggatcagtcactgtgccacatcccaacatcgaagaggtggccctgtccaacactggagagattcccttctatggcaaggccatccccctcgagatcatcaagggggggaggcatctcattttctgccattccaagaagaaatgtgacgagctcgctgcgaagttgtcggccctcggagtcaatgctgtagcatactaccgaggtcttgatgtgtccgttataccaacaagcggggacgtcgttgttgtggcaacagacgctctaatgacgggctataccggcgactttgactcagtgatcgactgtaatacatgtgtcacccaaacagtcgatttcagcttggaccctaccttcaccattgagacgacgaccgtgccccaagacgcagtgtcgcgctcgcagcggcgaggcaggactggcaggggcagagggggcatatacaggtttgtgactccaggggaacggccctcgggcatgtttgattcttcggtcctgtgtgagtgctatgacgcgggctgtgcttggtacgagctcacgcccgccgagacctcggttaggttgcgggcttacctgaacacaccagggttgcccgtctgccaggaccatctggagttctgggagagcgtcttcacaggcctcacccacatagatgcccatttcctgtcccagactaagcaggcaggagataacttcccctacctggtagcataccaggctacagtgtgcgccagggcccaggctccaccaccatcgtgggatcaaatgtggaagtgtctcatacggctaaagcctacgctacacgggccgacgcccctgttgtacaggctaggggccgtgcaaaacgaggttaccctcacacaccccataaccaaatacatcatgacatgcatggcggctgacctagaggttgtcaccagcacctgggtgctggtgggtggggtcctcgcagctctggctgcatactgcctgacaacgggcagcgtggtcattgtgggcaggatcaccttgtcagggaggccagctatcattcccgacagggaagttctctaccaagagttcgatgaaatggaggagtgcgcctcacacctcccttacatcgagcaggggatgcagctcgccgagcaattcaagcagaaggcgcttgggttgctgcaaacagccaccaagcaggcggaggctgctgctcccgtggtggagtccaagtggcggacccttgaggctttctgggcgaagcacatgtggaatttcatcagcgggatacagtatctagcaggcttgtccactctgcctgggaaccccgcgatagcatcactgatggcattcacagcttctatcaccagcccgctcaccacccaacataccctcttgtttaacatcttggggggatgggtggccgctcaactcgccccccccagcgccgcttcagcttttgtcggcgccggcatcgctggcgcggctgttggcagcataggccttgggaaggtgcttgtggacatcctggcgggttatggagcgggggtggcaggcgcactcgtggcctttaaggtcatgagtggtgatatgccctccactgaggacctggtcaacttactccctgctatcctctctcctggcgccctggtcgtcggagttgtgtgcgcagcaatactgcgtcggcatgtgggcccaggggagggggctgtgcagtggatgaaccggctgatagcattcgcttcgcggggtaaccatgtctcccccacgcactatgtgcctgagagcgacgctgcagcgcgtgtcacccagatcctctccagccttaccatcactcagctgttgaagaggctccaccagtggatcaatgaggactgctccacgccatgttccggttcgtggctcagagacatttgggactggatatgcacggtgttgactgacttcaagacctggctccagtccaagctcctgccgcggctaccgggaatccccttcctttcatgccaacgtgggtacaagggagtttggcggggagatggcgtcatgcaaaccacctgcccatgcggagcacaaattgctggacatgtcaagaacggctccatgaagatcgtcgggcccaaaacctgtagcaacacgtggcacggaacatttcccatcaacgcgtacaccacaggtccctgcacaccctccccggcgccaaattactccagggcgctgtggcgggtggctgctgaggagtatgtggaggtcacgcgggtgggggagttccactacgtgacgggcatgaccactgacaacgtaaaatgtccatgccaggttccggcccccgaattcttcacggagttggacggggtgcggctgcacaggtacgctccggtgtgcaaacctctcctacgggatgaggtcacattccaggtcgggctcaaccaatacccggttgggtcacagctcccatgcgagcccgaaccggatgtgacagtggtcacctccatgctcaccgatccctctcacattacagcggaaacggctaggcgtaggctggccagggggtctcccccctccttggccagctcttcagctagtcagttgtccgcgccttccttgaaggcgacatgcactacccgtcacgactccccagacgctgatctcatcgaggccaacctcctgtggcggcaggagatgggcgggaacatcacccgcgtggagtcagagaataagatagtgatcctggactctttcgacccgattcgagcggaggaggatgagagggaagtgtccgtcgcggcggagatcctgcggaaaaccaggaaattccccccggcgattcccatatgggcacgcccggattacaacccaccattgatagagtcttggagggacccggactacgtccctccggtggtgcacgggtgcccattgccacctgccaagacccctccagtaccacctccgcggaggaagaggacggttgtcctgacagaatccactgtgtcttctgccctggcagagcttgctacaaagaccttcggcagctccggatcgtcggccgtcgatagcggcacgtcgaccgcccctcctgaccagccctttgacagcggagatacaggatccgacgctgggtcgtactcctctatgccccccctcgagggggagccgggggaccccgatctcagcgacgggtcttggtctactgtgagcgagcaggatggtgaggacgtcgtctgctgctcgatgtcctacacgtggacaggcgccttaatcacgccatgcgccgcggaagaaagcaagctgcccatcaatgcgttgagcaactctcagttgcgtcaccacaacatggtctacgccacaacatcccgcagcgcaagccagcggcagaaaaaggtcacctttgacagactgcaagtcctggacgaccactaccgggacgtgctcaaggagatgaacgccaaggcgtccacagttaatgctaaacttctatccgtagaagaagcctgcaagctgacgcccccacattcggccaaatccaaatttggctatggggcgaaggacgtccggaacctatccagcaaggccgttaaccacatccactccgtgtggaaggacttgctggaagacactgaaacaccaatcaacaccaccatcatggcgaagaatgaggtcttctgtgttcaaccagagaagggaggccgaaaaccagctcgccttatcgtattcccagacttgggggttcgtgtgtgcgagaaaatggccctttacgacgtagtctccactcttcctcaggccgtgatgggctcctcatacggattccagtactcccctgggcagcgggtcgagttcctggtgaatgcctggaaatcaaagaaaagccctatgggcttcgcatatgacacccgctgttttgactcaacggtcactgagaatgacatccgtgttgaggagtcaatttaccaatgttgtgacttggcccccgaggccagacaggccataaggtcgctcacagagcggctttatattgggggccctctgactaattcaaaggggcagaactgcggttaccgccggtgccgcgccagcggcgtgctgacgactagctgcggaaacacccttacatgttacttgaaggcctctgcagcctgtcgagctgcaaagctccaggactgcacgatgctcgtgtgcggagacgaccttgtcgttatctgtgagagcgcgggaacccaggaggacgcggcgagcctacgagtcttcacggaggctatgactaggtactctgcccccccgggggacccgccccaaccggaatacgacttggagttgataacatcatgctcctccaacgtgtcggtcgcgcacgatgcatctggcaaacgggtgtattatctcacccgtgaccccaccaccccccttgcgcgggcggcgtgggagacagctagacacactccagtcaactcctggctaggcaacatcatcatgtatgcgcccaccttatgggcaaggatgattctgatgactcacttcttctctatccttctagctcaggagcagcttgaaaaagccctagattgtcagatctacggggccacttactccattgaaccacttgacctacctcagatcattcagcgactccatggtcttagcgcattctcactccatagttactctccaggtgaaatcaatagggtggcttcatgcctcagaaaacttggggtcccacctttgcgagtctggatacatcgggccaaaagtgtccgcgctaagctactgtcccagggggggagggccgccacttgtggcaaatacctcttcaattgggcagtaaggaccaagctcaaactcactccaattccggctgcgtcccaattggacttgtccagctggttcgtcgctggttacagcgggggagacatatatcacagcctgtctcgtgcccgaccccgctggttcatgtggtgcctactcctactttctgtaggggtaggcatctacttgctccccaaccgatgaacgggga

SEQ ID NO: 659 - DNA, 9369 bp, Hepatitis C Virus
ttgggggcgacactccaccatagatcactcccctgtgaggaactactgtcttcacgcagaaagcgtctagccatggcgttagtatgagtgtcgtgcagcctccaggtccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcatcatgagcacaaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggcaggacctgggctcagcccgggtacccttggcccctctatggcaatgagggtctggggtgggcaggatggctcctgtcaccccggggctctcggcctagttggggccccacggacccccggcgtaggtcgcgtaatctgggtaaggtcatcgatacccttacatgcggcttcgccgacctcatggggtacattccgcttgtcggcgcccccctaggaggcgctgccagggccctggcgcatggcgtccgggttctggaggacggcgtgaactacgcaacagggaatctgcccggttgctctttctctatcttcctcttagctttgctgtcttgtttgaccatcccagcttccgcttacgaagtgcgcaacgtgtccggggtgtaccatgtcacgaacgactgctccaactcaagtattgtgtatgaggcagcggacatgatcatgcacatccccgggtgcgtgccctgcgtacgggagggcaattcctcccgttgctgggtggcgctcacctccacgctcgcggccaggaacagcagcatccccacagcgacaatacgacgccacgtcgatttgctcgttggggcagctgctttctgttccgctatgtacgtgggggatctctgcggatccgttttcctcgtctcccagctgttcaccttctcacctcgccggtatgagacggtacaagactgcaattgctcaatctatcccggccacgtatcaggtcaccgcatggcctgggatatgatgatgaactggtcacctacaacggccctagtggtatcgcagctactccggatcccacaagccaccctggacatggtggcgggggcccactggggagtcctagcgggccttgcctactattccatggtggggaactgggctaaggtcttggttgtgatgctactcttcgccggtgttgacgggaataccgtcgtgtcaggggggcaggcagcccgcaccaccagcagctttacgtccctcttcacatcagggccgtcccagaaaatccagctcgtaaactccaacggcagctggcacatcaacaggactgctctgaactgcaatgactccctcagcactgggtttcttgccgcgctgttctacacacacaggttcaacgcgtccggatgcccagggcgcatggccagctgccgccccattgactcgttcgcccaggggtggggtcccatcactcatgttgagcctcagatcttggatcagaggccatattgctggcactacgcacctcaaccgtgcggtatcgtacctgcgtcgcaggtatgtggtccagtgtactgcttcaccccaagccctgttgtggtggggacgactgatcgtttcggcgcccccacgtataggtggggggagaatgagacggacgtgctgctccttaacaacacgcggccaccccacggtaactggttcggctgtacatggatgaacagcaccgggttcaccaagacgtgcgggggccccccatgtaacatcgggggggtcggcaataacaccttgacctgccctacagattgcttccggaaacaccccgaagccacttacacgaagtgtggttcgggcccttggttgacacctaggtgcttggttgactacccatataggctctggcattacccctgcactgtcaactttaccatcttcaaggtcaggatgtatgtggggggcgtggagcacaggctcaacgccgcgtgcaactggactcgaggagaacgttgtgacttgacggacagggataggtcggagctcagcccgttgctgctgtccacaacagagtggcagatactgccctgttccttcaccaccctaccggctctgtccactggtttgatccacctccaccagaacatcgtggacgtgcaatacctgtacggtgtggggtcagcggttgtctccgttgcaatcagatgggagtatgtcgtgctgctcttcctcctcctggcagacgcgcgcttttgcgcctgcttatggatgatgctgctggtggcccaggctgaggccgccttagagaacctagtggtcctcaatgcggcgtccgtggctggagcgcatggcattctctccttccttgtgttcttctgtgctgcctggtacattaagggcaagctggtccccggggcggcatatgctttttatggcgtatggccgctgctcctgctcctactggcgttaccaccacgagcatacgccatggaccgggagatggccgcatcatgcggaggcgcggtcttcataggtctggcactcttgaccttgtcaccacactataaagtgttcctcgctaggctcatatggtggtcacaatatcttatcaccagggccgaggcgcatttgcaagtgtgggtcccccctctcaacgttcgggggggccgcgatgccatcatcctcctcatgtgcgtgttccgcccagagctaatttttgaaatcaccaagatcttgctcgccatactcggcccgctcacggtgctccaggctggcctaactagagtgccgtactttgtgcgcgcacaagggctcatccgtgcatgcatgttggtgcggaaagtcgctgggggtcattatgctcagatggctttcatgaagctggccgcactgacgggtacgtacgtttatgaccatcttactccactgcgggactgggcccatgcgggcctgcgagaccttgcggtggcagttgagcccgtcgtcttctctgacatggagaccaagatcatcacctggggggcagacaccgcggcgtgcggggatatcatcttgggcctacctgtctccgcccgaagggggagggagatacttctaggaccagccgatagctttggagagcaagggtggcggctccttgcgcctatcacggcctattcccaacagacgcggggcctacttggctgtataatcactagcctcacaggtcgggacaagaaccaggtcgagggggaggttcaggtggtctccaccgcgacgcaatctttcctggcgacctgcgtcaatggcgtgtgttggaccgtctaccatggcgccggctcgaagaccctagccggcccgaaggggccagtcacccaaatgtacaccaatgtggaccaggacctcgtcggctggccggcgccccctggggcgcgttccttgacaccatgcacctgcggcagctcggacctttacttggtcacgaggcatgctgatgtcatcccggtgcgccggcggggcgacagcagggggagcctgctctcccccaggcccgtctcctacctgaagggctcctcaggtggtccactgctttgccccttagggcacgttgtgggcgtcttccgggctgctgtgtgcacccggggggttgcgaaggcggtggacttcatacccgttgagtctatggaaactactatgcggtctccggtctttacggataattcatctcccccggccgtaccgcagacattccaagtggcccatctacatgcccccactggcagcggcaagagcactaaggtgccggctgcatacgcagcccaggggtacaaggtactcgtcctgaacccgtccgttgccgccaccttaggttttggggcgtatatgtctaaggcacatggtgtcgaccccaacatcagaactggggtgaggaccatcaccacgggcgctcccattacgtattccacctatggcaagttccttgccgacggtggttgctccgggggcgcctatgacatcataatgtgcgatgagtgccactcaactgactcgacttccattttgggcattggtacggtcctggaccaagcggagacggctggagcgcggctcgtcgtgctcgccaccgctacgcctccgggatcagtcactgtgccacatcccaacatcgaagaggtggccctgtccaacactggagagattcccttctatggcaaggccatccccctcgagatcatcaagggggggaggcatctcatcttctgccattccaagaagaaatgtgacgagctcgctgcgaagttgtcggccctcggagtcaatgctgtagcatactaccgaggtcttgatgtgtccgttataccaacaagcggggacgtcgttgttgtggcaacagacgctctaatgacgggctataccggtgactttgactcagtgatcgactgtaatacatgtgtcacccaaacagtcgatttcagcttggaccctaccttcaccattgagacgacgaccgtgccccaagacgcagtgtcgcgctcgcagcggcgaggcaggactggtaggggcagggggggcatatacaggtttgtgactccaggggaacggccctcgggcatgttcgattcttcggtcctgtgtgagtgctatgacgcgggctgtgcttggtacgagctcacgcccgccgagacctcggttaggttgcgggcttacctaaacacaccagggttgcccgtctgccaggaccatctggagttctgggagagcgtcttcacaggcctcacccacatagatgcccatttcttgtcccagactaagcaggcaggagataacttcccctacctggtagcataccaggctacagtgtgcgccagggcccaggctccaccaccatcgtgggatcaaatgtggaagtgtctcatacggctaaagcctacgctacacgggccaacacccctgttgtacaggctaggggccgtgcaaaacgaggtcaccctcacacaccccataaccaaatacatcatgacatgcatggcggctgacctagaggtcgtcaccagcacctgggtgctggtgggtggggtcctcgcagctctggctgcatactgcctgacaacgggcagcgtggtcattgtgggcaggatcaccttgtcagggaggccagctatcattcccgacagggaagttctctaccaagagttcgatgaaatggaggagtgcgcctcacacctcccttacatcgagcaggggatgcagctcgccgagcaattcaagcagaaggcgcttgggttgctgcaaacagccaccaagcaggcggaggctgctgctcccgtggtggagtccaagtggcggacccttgaggctttctgggcgaagcacatgtggaatttcatcagcgggatacagtatctagcaggcttgtccactctgcctgggaaccccgcgatagcatcactgatggcattcacagcttctatcaccagcccgctcaccacccaacataccctcttgtttaacatcttggggggatgggtggccgctcaactcgccccccccagcgccgcttcagcttttgtcggcgccggcatcgctggcgcggctgttggcagcataggccttgggaaggtgcttgtggacatcctggcgggttatggagcgggggtggcaggcgcactcgtggcctttaaggtcatgagtggtgatatgccctccactgaggacctggtcaacttactccctgctatcctctctcccggtgccctggtcgtcggagttgtgtgcgcagcaatactgcgtcgacatgtgggcccaggggagggggctgtgcagtggatgaaccggctgatagcgttcgcttcgcggggtaaccatgtctcccccacgcactatgtgcctgagagcgacgctgcagcgcgtgtcacccagatcctctccagccttaccatcactcagctgttgaagaggctccaccagtggatcaatgaggactgctccacgccatgttccggttcgtggctcagagacatttgggactggatatgcacggtgttgactgacttcaagacctggctccagtccaagctcctgccgcggctaccgggaatccctttcctttcatgccaacgtgggtacaagggagtttggcggggagatggtgtcatgcaaaccacctgcccatgcggagcacaaattgctggacatgtcaagaacggctccatgaagatcgtcgggcccagaacctgtagcaacacgtggcacggaacatttcccatcaacgcgtacaccacaggtccctgcacaccctccccggcgccaaattactccagggcgctgtggcgggtggctgctgaggagtatgtggaggtcacgcgggtgggggatttccactacgtgacgggcatgaccactgacaacgtaaaatgtccatgccaggttccggcccccgaattcttcacggagttggacggggtgcggctgcacaggtacgctccggtgtgcaaacctctcctacgggatgaggtcacattccaggtcgggctcaaccaatacacggttgggtcacagctcccgtgcgagcccgaaccggatgtgacggtggtcacctccatgctcaccgatccctcccacattacagcggaaacggctaggcgtaggctggccagggggtctcccccctccttggccagctcttcagctagtcagttgtccgcgccttccttgaaggcgacatgcaccacccgtcacgactccccagacgctgatctcatcgaggccaacctcctgtggcggcaggagatgggcgggaacatcacccgcgtggagtcagagaataagatagtgatcctggactctttcgacccgattcgagcggaggaggatgagagggaagtatccgttgcggcggagatcctgcggaaaaccaggaaatttcccccggcgattcccatatgggcacgcccggattacaacccaccattgatagagtcctggagggacccggactacgtccctccggtggtgcacgggtgcccattgccacctgccaagacccctccagtaccacctccgcggaggaagaggacggttgtcctgacagaatccactgtgtcttctgccctggcggagcttgctacaaagaccttcggcagctccggatcgtcggccgtcgatagcggcacatcgaccgcccctcctgatcagcccttcgacagcggagatacaggatctgacgctgggtcgtactcctccatgcccccccttgagggggagccgggggaccccgatctcagcgacgggtcttggtctactgtgagcgaggagggtggtgaggacgtcatctgctgctcgatgtcctacacgtggacaggcgccttaatcacgccatgtgccgcggaagagagcaagctgcccatcaatgcgttgagcaactctcagttgcgtcaccacaacatggtctacgccacaacatctcgcagcgcaagccagcggcagaaaaaggtcacctttgacagactgcaagtcctggacgaccactaccgggacgtgctcaaggagatgaaggcgaaggcgtctacagttaaggctaaacttctatccgtggaagaagcctgcaagctgacgcccccacattcggccaaatccaaatttggctatggggcgaaagacgtccggaacctatccagcaaggccgttaaccacatccactccgtgtggaaggacttgctggaagacactgaaacaccaattaacaccaccatcatggcgaagaatgaggtcttctgtgttcaaccagagaagggaggccgcaaaccagctcgccttatcgtattcccagacttgggggttcgtgtgtgcgagaaaatggccctgtacgacgtagtctccactcttcctcaggccgtgatgggctcctcatacggattccagtactctcctggacagcgggtcgagttcctggtgaatgcctggaaatcaaagaaaagccctatgggcttcgcatatgacacccgctgttttgactcaacggtcactgagaatgacatccgtgttgaggagtcaatttaccaatgttgtgacttggcccccgaggccagacaggccataaggtcgctcacagagcggctttatattgggggccctctgactaattcaaaggggcagaactgcggttaccgccggtgccgcgccagcggcgtgctgacgactagctgcggaaacacccttacatgttacttgaaggcctctgcagcctgtcgagctgcaaagctccaggactgcacgatgctcgtgtgcggagacgacctcgtcgttatctgtgagagcgcgggaacccaggaggacgcggcgagcctacgagtcttcacggaggctatgactaggtactctgcccccccgggggacccgccccaaccggaatacgacttggagttgataacatcatgctcctccaacgtgtcggtcgcgcacgatgcatctggcaaacgggtgtattatctcacccgtgaccccaccaccccccttgcgcgggcggcgtgggagacagctagacacactccagtcaactcctggctaggcaacatcatcatgtatgcgcccaccttatgggcaaggatgattctgatgactcacttcttctctatccttctagctcaggagcagcttgaaaaagccctagattgtcagatctacggggccacttactccattgaaccacttgacctacctcagatcattcagcgactccatggtcttagcgcattttcactccatagttactctccaggtgaaatcaatagggtggcttcatgcctcaggaaacttggggtcccacctttgcgagtctggagacatcgggccagaagtgtccgcgctaagctactgtcccagggggggagggccgccacttgtggcaaatacctcttcaattgggcagtaaggaccaagctcaaactcactccaattccggctgcgtcccagttggacttgtccggctggttcgttgctggttacggcgggggagacatatatcacagcctgtctcgtgcccgaccccgctggttcatgtggtgcctactcctactttccgtaggggtaggcatctacttgctccccaaccgatgaacgggga

SEQ ID NO: 660 - DNA, 9386 bp, Hepatitis C Virus
ttgggggcgacactccaccatagatcactcccctgtgaggaactactgtcttcacgcagaaagcgtctagccatggcgttagtatgagtgttgtgcagcctccaggtccccccctcccgggagagccatagtggtctgcggaaccggtgagtacaccggaattgccaggacgaccgggtcctttcttggattaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaacatgagcacaaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggcaggacctgggctcagcccgggtacccttggcctctctatggcaatgagggtctggggtgggcaggatggctcctgtcgccccgtggctctcggcctagttggggccccacggacccccggcgtaggtcgcgtaatttgggtaaggtcatcgataccctcacatgcggcttcgccgacctcatggggtacattccgctcgtcggcgcccccctaggaggtgctgccagggccctggcgcatggcgtccgggttctggaggacggcgtgaactatgcaacagggaatctgcccggttgctctttctctatcttcctcttggctttgctgtcctgtttgaccatcccagcttccgcttacgaagtgcgcaacgtgtccggggtgtaccatgtcacgaacgactgctccaactcaagtattgtgtatgaggcagcggacatgatcatgcacacccccgggtgcgtgccctgcgtccgggagagcaattcttcccgatgctgggtagcgctcactcccacgctcgcggccaggaacagcagcatccccactacgacaatacgacgccacgtcgatttgctcgttggggcggctgctttctgctccgctatgtacgtgggggatctctgcggatctgtttttctcgtctcccagttgttcaccttctcacctcgccggtatgagacggtgcaggactgcaattgttcactctatcccggccacgtatcaggtcaccgcatggcttgggatatgatgatgaactggtcacctacaacagccctagtggtatcgcagttactccggatcccacaagccgtcgtggacatggtggcgggggcccactggggagtcctggcgggccttgcctactattccatggtggggaactgggctaaggtcttgattgtgatgctactctttgccggcgttgacggggggggagggggtacccacgtgacaggggggacggcagcccagaccacctccagctttgtgtccctcttcagccccggcccgtcccagaaaatccaacttgttaacaccaacggcagctggcacatcaacaggactgccctgaattgcaatgattccctcaacactgggttccttgccgcgctgttttacacacacaggttcaactcgtccggatgcccagagcgtatggctagctgccgtcccattgacgggttcgcccaggggtggggtcccatcactcatgttgtgcccaacgtctcggaccagaggccttactgctggcactacgcacctcgaccgtgtggtattgtacccgcgtcggaggtgtgtggtccagtgtattgcttcactccaagccctgttgtggtggggacgaccgatcgcttcggcgtccccacgtataaatggggggagaatgagacggacgtgctactccttaacaacacgcgaccgccgcaaggcaactggttcggttgcacatggatgaatagcaccgggttcaccaagacgtgcggaggccctccgtgtaacatcggaggggttggcaacgacaccttgacctgccctacggattgcttccggaagcaccccgaggccacttacacaaaatgtggctcgggcccctggctgacacctaggtgcttggttgactacccatacagactttggcactacccttgcactgtcaactttaccctcttcaagatcaggatgtacgtggggggtgtggagcacaggctcagcgccgcgtgcaattggactcgaggagagcgttgtgatttgacggacagggatagatcagagcttagtccgctgctactgtctacaacagagtggcagatactgccctgttccttcactaccctaccggctctgtccactggtttgatccacctccaccagaacatcgtggatgtgcaatacctgtacggtgtggggtcagcggttgtttccgttgtaatcagatgggagtatgtcatactgctcttccttctcctggcggacgcgcgcttctgcgcctgcttgtggatgatgctgctgatagcccaggctgaggccgccttagagaacctggtggtcctcaacgcggcgtctgtggccggagtgcatggcattctctccttccttgtgttcttctgtgctgcctggtacatcaagggcaagctggtccccggggcggcatacgctctctacggcgtatggccgctgctcctgctcctgctggcattaccaccacgagcatatgccatggaccgggaggtggctgcatcgtgcgggggcgcggtttttataggtctggcactcttgaccttgtcaccacactataaagcgttcctcgctaagctcatatggtggatgcagtatttcatcaccagggtcgaggcgcaattacaagtgtgggtcccccctctcaacgttcgggggggccgcgatgccatcatcctcctcacgtgcgcggtccacccagagctaatttttgatatcaccaaaatcttgctcgccatatttggtccgctcatggtgctccaggctggcctaactagagtgccgtacttcgtgcgcgctcaagggctcatccgcgcgtgcatgttagtgcggaaagtcgctgggggtcattatatccaaatggctctcatgaagctggccgcactgacgggcacgtacgtttatgaccatctcaccccgttgcgggactgggcccacgcgggcctgcgagaccttgcggtggcagttgagcccgttgtcttctctgccatggagaccaagatcatcacctggggggcagacactgcggcgtgtggggacatcatcttgggtctacccgtctccgcccgaagggggagggagatacttctgggaccggccgatagttttggagagcaggggtggcgactccttgcacctatcacggcctactctcaacagacgcggggcctatttggctgtatcatcactagcctcacaggtcgggacaagaaccaggtcgagggggaggttcaggtggtctccaccgcaacgcagtctttcctggcgacctgcgttaatggcgtgtgttggactgtctaccatggtgccggcgcgaagaccctagccggcccaaaggggccaatcacccaaatgtacaccaatgtggaccaggacctcgtcggttggccggcgccccccggggcgcgttccttgacaccatgcacctgcggcagctcggacctttacttggtcacgaggcatgccgatgtcgttccggtgcgccggcggggcgatagtagggggagcctactttcccccaggcctgtttcttacttgaagggctcctcgggtggcccactgctctgcccctcagggcacgctgcgggcatcttccgggctgctgtgtgcaccaggggggttgcgaaggcggtggactttgtgcccgttgagtctatggaaaccactatgcggtctccggtcttcacggacaactcatctcccccggccgtaccgcaaacattccaagtggcccatctacacgctcccactggcagcggcaagagcactaaggtgccggctgcatatgcagcccaagggtacaaggtactcgtcttgaacccgtccgttgccgccaccttaggctttggggcgtatatgtctaaggcacacggtgttgaccctaacatcagaaccggggtaaggaccatcaccacgggcgctcccatcacgtactccacctacggcaagttccttgccgacggtggttgctctgggggcgcctatgacatcataatatgtgatgagtgccactcaactgactcgacttccatcttgggcatcggtacagtcttggaccaagcggagacggctggagcgcggctcgtcgtgctcgccaccgctacgcccccgggatcggtcaccgtgccacaccccaacatcgaggaggtggccttgtccaacactggagagattcccttttatggtaaagccatccccatcgaggtcatcagggggggaaggcatctcattttctgccattccaagaagaaatgtgacgagctcgccacaaagctgtcggccctcggaatcaatgctgtggcgtactaccggggtcttgatgtgtccgtcatacccacaagcggagacgtcgttgtcgtggcaacggacgctctaatgacgggctatactggtgactttgattcagtgatcgactgtaatacatgtgtcacccagacagtcgatttcagtttggaccctaccttcaccattgagaccacgaccgtgccccaggacgcagtgtcgcgctcgcagcggcgaggcaggactggtaggggcagagggggcatatacaggtttgtgactccaggggaacggccctcgggcatgttcgattcttcggtcctgtgtgaatgctatgacgctggctgtgcttggtacgagctcacgcccgccgagacctcggttaggttgcgggcgtacctaaatacaccagggttgcccgtctgccaggaccatctggagttttgggagagcgtcttcacaggcctcacccacatagacgcccacttcttgtcccagactaagcaggcaggagacaacttcccctacctagtagcataccaggccacagtgtgcgccagggcccaggctccgcctccgtcgtgggatcaaatgtggaagtgtctcatacggctgaagcctacgctacacgggccaacacccctgttgtacaggctgggagccgtccaaaacgaggtcaccctcacacaccccataaccaaattcatcatggcatgcatgtcggctgacctagaggtcgtcacgagcacctgggtgctagtaggcggggtccttgcagctctggccgcgtactgcctgacaacaggcagcgtggtcatagtgggtaggatcatcttgtctgggaggccggctatcatacccgacagggaagttctctaccaggagttcgatgaaatggaagagtgcgcctcacacctcccttacatcgaacagggaatgcagctcgccgagcaattcaagcagaaggcgctcgggttgctgcaaacagccaccaagcaagcggaggctgctgctcccgtggtggagtccaaatggcgagcccttgagaccttctgggcgaagcacatgtggaatttcatcagcgggatacagtacttagcaggcttgtccactctgcctgggaaccccgcgatagcatcactgatggcattcacagcctctatcaccagcccgctcaccacccaatataccctcttgttcaacatcttggggggatgggtggccgcccaactcgccccccccagcgctgcatcagcttttgtgggcgccggcatcgctggcgcggctgttggcagcataggccttgggaaggtgcttgtggacatcctggcgggctatggagcgggggtggcaggcgcactcgtggcctttaaggtcatgagcggcgatatgccctccaccgaggacctggtcaacttacttcctgccatcctctctcccggtgccctggtcgtcggggtcgtgtgcgcagcaatactgcgtcgacatgtgggcccaggggagggggctgtgcagtggatgaaccggctgatagcgttcgcctcgcggggtaaccacgtctcccccacgcattacgtgcctgagagcgacgccgcagcgcgtgtcactcagatcctctccaaccttaccatcactcagctgttgaagaggctccatcagtggatcaatgaggattgctccacgccatgctccggctcgtggctcagggatgtctgggactggatatgcacggtgttggctgacttcaagacctggctccagtccaagctcctgccgcggttgccgggaatccccttcctttcatgccaacgtgggtacaggggagtctggcggggagatggcgtcatgcacaccacctgcccatgtggagcacaaattaccggacatgtaaaaaacggttccatgaggatcgttgggccaaaaacctgcagcaacacgtggcatggaacattccccatcaacgcatacaccacaggcccctgcacaccctccccggcgccaaactattccagagcgttgtggcgggtggctgctgaggagtatgtggaggttgcgcgggtgggggatttccactacgtgacgggcatgaccactgacaacgtaaaatgcccatgccaggttccggcccctgaattcttcacagaattggacggggtgcggctgcacaggtacgctccggcgtgcaaacctctcctacgggaggaggtcacattccaggtcgggctcaaccagtacccggttgggtcacagctcccatgtgagcccgaaccggatgtaacagtgcttacttccatgctcaccgacccctcccacattacggcggaggcggctaaacgcaggctggccagggggtctcccccttccttggccagctcttcagctagtcagttgtctgcgccctccttgaaggcaacatgcactacccatcatgactccccagacgctgacctcatcgaggccaacctcctgtggcggcaggagatgggcgggaacatcacccgcgtggagtcagagaataaggtggtaattctagactcttttgacccgctacgagcggaggaggatgagagggaagtgtccgtcgcggcggagatcctgcggaaaaccaggaaattccccccagcgttgcccgtatgggcacgcccggactacaatccaccactgctagagccttggagggacccggactacgtccctccggtggtacatgggtgcccattgccacctaccaaggcccctccaataccacctccacggagaaagaggacggtcatcctgacagaatccaccgtgtcttctgccttggcggagcttgctacaaagaccttcggcagctccggatcgtcggccgtcgacagcggcacagcgaccgcccctcatgatctgccctccgacgacggtgatgcgggatccgacgttgggtcgtactcctccatgcccccccttgagggggagccgggggaccccgatctcagcgacgggtcttggtctactgtgagcgaggaggctagtgaggacgttgtctgctgttcgatgtcctatacatggacaggtgccttgatcacgccatgcgctgcggaagagagcaagctgcccatcaatgcgttgagcaactctttgctgcgtcaccacaacatggtctatgccacaacatcccgcagcgcaagccagcggcagaaaaaggtcacctttgacagaatgcaagtcctggacgaccactaccgggacgtgcttaaggagatgaaggcgaaggcgtccactgttaaggctaaacttctatccgtagaagaagcctgcaagctgacgcccccacattcggccagatccaaatttggctatggggcaaaggacgtccggaacctatccagcaaggccgttaaccacatccactccgtgtggaaggacttgctggaagacaccgagacaccaattgatactaccatcatggcaaaaaatgaggtcttctgtgttcaaccagagaaaggaggccgcaagccagctcgccttatcgtattcccagatttgggggttcgtgtttgcgagaaaatggccctttatgacgtggtctccactcttcctcaggccgtgatgggctcctcatacggattccagtactctcctgggcagcgggtcgagttcctggtgaatgcctggaaatcaaagaaaagccctatgggcttcgcatatgacacccgctgctttgactcaaccgtcactgagaatgacatccgtgttgaggagtcaatttaccaatgttgtgacttggcccccgaggccagacaggccataaggtcgctcacagagcggctttatatcgggggccccctgactaattcaaaagggcagaactgcggctatcgtcggtgccgcgccagcggcgtgctgacgaccagctgcggcaatacccttacatgttacttgaaggcctctgcagcctgtcgagctgcgaagctccaggactgcacgatgctcgtgtgcggagacgacctcgtcgttatctgtgagagcgcgggaacccaggaggacgcggcgagcctacgagtcttcacggaggctatgacgaggtactctgccccccccggggacccgcccaaaccagaatacgacttggagctgataacatcatgctcttccaacgtgtcggtcgcgcacgatgcatctggcaaacgggtgtactacctcacccgcgaccccaccaccccctttgcgcgggctgcgtgggagacagctagacacactccagttaactcctggctaggcaacatcatcatgtatgcgcccaccttatgggcaaggatggttctgatgacccactttttctcaatccttctagcccaggagcaacttgagaaagccctagattgtcagatctacggggccacttactccattgagccacttgacctacctcagatcattcagcgactccatggtcttagcgcattttcactccatagttactctccaggtgagatcaatagggtggcttcatgcctcagaaaacttggggtaccacccctgcgagtctggagacatcgggccagaagtgtccgcgctaagctgctgtcccagggggggagggctgccacatgtggcaaatacctcttcaactgggcagtaaggaccaagctcaaactcactccaatcccagctgcgtcccagctggacttgtccggctggttcattgctggctacagcgggggagacatatatcacagcttgtctcgtgcccgaccccgctggttcatgtggtgcctactcctactttctgtaggggtaggcatctatttgctccccaaccggtgaacggggagctaacca

SEQ ID NO: 661 - DNA, 9386 bp, Hepatitis C Virus
ttgggggcgacactccaccatagatcactcccctgtgaggaactactgtcttcacgcagaaagcgtctagccatggcgttagtatgagtgttgtgcagcctccaggtccccccctcccgggagagccatagtggtctgcggaaccggtgagtacaccggaattgccaggacgaccgggtcctttcttggattaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaacatgagcacaaatcccaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggcaggacctgggctcagcccgggtacccttggcctctctatggcaatgagggtctggggtgggcaggatggctcctgtcgccccgtggctcccggcctagttggggccccacggacccccggcgtaggtcgcgtaatttgggtaaggtcatcgataccctcacatgcggcttcgccgacctcatggggtacattccgctcgtcggcgcccccctaggaggtgctgccagggccctggcgcatggcgtccgggttctggaggacggcgtgaactatgcaacagggaatctgcccggttgctctttctctatcttcctcttggctttgctgtcctgtttgaccatcccagcttccgcttacgaagtgcgcaacgtgtccggggtgtaccatgtcacgaacgactgctccaactcaagtattgtgtatgaggcagcggacatgatcatgcacacccccgggtgcgtgccctgcgtccgggagagcaactcttcccgatgctgggtagcgctcactcccacgctcgcggccaggaacagcagcatccccactacgacaatacgacgccacgtcgatttgctcgttggggcggctgctttctgctccgctatgtacgtgggggatctctgcggatctgtttttctcgtctcccagttgttcaccttctcacctcgccggtatgagacggtgcaggactgcaattgttcactctatcccggccacgtatcaggtcaccgcatggcttgggatatgatgatgaactggtcacctacaacagccctagtggtatcgcagttactccggatcccacaagccgtcgtggacatggtggcgggggcccactggggagtcctggcgggccttgcctactattccatggtggggaactgggctaaggtcttgattgtgatgctactctttgccggcgttgacggggggggagggggtacccacgtgacagggggggcggcagcccagaccgcctcccgctttgcgtccctcttcagccccggcccgtcccagaaaatccaacttgttaacaccaacggcagctggcacatcaacaggactgccctgaattgcaatgattccctcaacaccgggttccttgctgcgctgttttacacacacaggttcaactcgtccggatgcccagagcgtatggctagctgccgtcccattgacgggttcgcccaggggtggggtcccatcactcatgttgtgcccaacgtctcggaccagaggccttactgctggcactacgcacctcgaccgtgtggtattgtacccgcgtcggaggtgtgtggtccagtgtattgcttcactccaagccctgttgtggtggggacgaccgatcgcttcggcgtccccacgtataaatggggggagaatgagacggacgtgctactccttaacaacacgcgaccgccgcaaggcaactggttcggttgcacatggatgaatagcaccgggttcaccaagacgtgcggaggccctccgtgtaacatcggaggggttggcaacgacaccttgacctgccctacggattgcttccggaagcaccccgaggccacttacacaaaatgtggctcgggcccctggctgacacctaggtgcttggttgactacccatacagactttggcactacccttgcactgtcaactttaccctcttcaagatcaggatgtacgtggggggtgtggagcacaggctcagcgccgcgtgcaattggactcgaggagagcgttgtgatttgacggacagggatagatcagagcttagtccgctgctactgtctacaacagagtggcagatactgccctgttccttcactaccctaccggctctgtccactggtttgatccacctccaccagaacatcgtggatgtgcaatacctgtacggtgtggggtcagcggttgtttccgttgtaatcagatgggagtatgtcatactgctcttccttctcctggcggacgcgcgcttctgcgcctgcttgtggatgatgctgctgatagcccaggctgaggccgccttggagaacctggtggtcctcaacgcggcgtctgtggccggagtgcatggcattctctccttccttgtgttcttctgtgctgcctggtacatcaagggcaagctggtccccggggcggcatacgctctctacggcgtatggccgctgctcctgctcctgctggcattaccaccacgagcatatgccatggaccgggaggtggctgcatcgtgcgggggcgcggtttttataggtctggcactcttgaccttgtcaccacactataaagcgttcctcgctaagctcatatggtggttgcagtatttcatcaccagggtcgaggcgcaattacaagtgtgggtcccccctctcaacgttcgggggggccgcgatgccatcatcctcctcacgtgcgcggtccacccagagctaatttttgatatcaccaaaatcttgctcgccatatttggtccgctcatggtgctccaggctggcctaactagagtgccgtacttcgtgcgcgctcaagggctcatccgcgcgtgcatgttagtgcggaaagtcgctgggggtcattatatccaaatggctctcatgaagctggccgcactgacgggcacgtacgtttatgaccatctcaccccgttgcgggactgggcccacgcgggcctgcgagaccttgcggtggcagttgagcccgttgtcttctctgccatggagaccaagatcatcacctggggggcagacactgcggcgtgtggggacatcatcttgggtctacccgtctccgcccgaagggggagggagatacttctgggaccggccgatagttttggagagcaggggtggcgactccttgcacctatcacggcctactctcaacagacgcggggcctatttggctgtatcatcactagcctcacaggtcgggacaagaaccaggtcgagggggaggttcaggtggtttccaccgcaacgcagtctttcctggcgacctgcgttaatggcgtgtgttggactgtctaccatggtgccggcgcgaagaccctagccggcccaaaggggccaatcacccaaatgtacaccaatgtggaccaggacctcgtcggttggccggcgccccccggggcgcgttccttgacaccatgcacctgcggcagctcggacctttacttggtcacgaggcatgccgatgtcgttccggtgcgccggcggggcgatagtagggggagcctactttcccccaggcctgtttcttacttgaagggctcctcgggtggcccactgctctgcccctcagggcacgctgcgggcatcttccgggctgctgtgtgcaccaggggggttgcgaaggcggtggactttgtgcccgttgagtctatggaaaccactatgcggtctccggtcttcacggacaactcatctcccccggccgtaccgcaaacattccaagtggcccatctacacgctcccactggcagcggcaagagcactaaggtgccggctgcatatgcagcccaagggtacaaggtactcgtcttgaacccgtccgttgccgccaccttaggctttggggcgtatatgtctaaggcacacggtgttgaccctaacatcagaaccggggtaaggaccatcaccacgggcgctcccatcacgtactccacctacggcaagttccttgccgacggtggttgctctgggggcgcctatgacatcataatatgtgatgagtgccactcaactgactcgacttccatcttgggcatcggtacagtcttggaccaagcggagacggctggagcgcggctcgtcgtgctcgccaccgctacgcccccgggatcggtcaccgtgccacaccccaacatcgaggaggtggccttgtccaacactggagagattcccttttatggtaaagccatccccatcgaggtcatcagggggggaaggcatctcattttctgccattccaagaagaaatgtgacgagctcgccacaaagctgtcggccctcggaatcaatgctgtggcgtactaccggggtcttgatgtgtccgtcatacccacaagcggagacgtcgttgtcgtggcaacggacgctctaatgacgggctatactggtgactttgattcagtgatcgactgtaatacatgtgtcacccagacagtcgatttcagtttggaccctaccttcaccattgagaccacgaccgtgccccaggacgcagtgtcgcgctcgcagcggcgaggcaggactggtaggggcagagggggcatatacaggtttgtgactccaggggaacggccctcgggcatgttcgattcttcggtcctgtgtgaatgctatgacgctggctgtgcttggtacgagctcacgcccgccgagacctcggttaggttgcgggcgtacctaaatacaccagggttgcccgtctgccaggaccatctggagttttgggagagcgtcttcacaggcctcacccacatagacgcccacttcttgtcccagactaagcaggcaggagacaacttcccctacctagtagcataccaggccacagtgtgcgccagggcccaggctccgcctccgtcgtgggatcaaatgtggaagtgtctcatacggctgaagcctacgctacacgggccaacacccctgttgtataggctgggagccgtccaaaacgaggtcaccctcacacaccccataaccaaattcatcatggcatgcatgtcggctgacctagaggtcgtcacgagcacctgggtgctagtaggcggggtccttgcagctctggccgcgtactgcctgacaacaggcagcgtggtcatagtgggtaggatcatcttgtctgggaggccggctgtcatacccgacagggaagttctctaccaggagttcgatgaaatggaagagtgcgcctcacacctcccttacatcgaacagggaatgcagctcgccgagcaattcaagcagaaggcgctcgggttgctgcaaacagccaccaagcaagcggaggctgctgctcccgtggtggagtccaaatggcgagcccttgagaccttctgggcgaagcacatgtggaatttcatcagcgggatacagtacttagcaggcttgtccactctgcctgggaaccccgcgatagcatcactgatggcattcacagcctctatcaccagcccgctcaccacccaatataccctcttgttcaacatcttggggggatgggtggccgcccaactcgccccccccagcgctgcatcagcttttgtgggcgccggcatcgctggcgcggctgttggcagcataggccttgggaaggtgcttgtggacatcctggcgggctatggagcgggggtggcaggtgcactcgtggcctttaaggtcatgagcggcgatatgccctccaccgaggacctggtcaacttacttcctgccatcctctctcccggtgccctggtcgtcggggtcgtgtgcgcagcaatactgcgtcgacatgtgggcccaggggagggggctgtgcagtggatgaaccggctgatagcgttcgcctcgcggggtaaccacgtctcccccacgcattacgtgcctgagagcgacgccgcagcgcgtgtcactcagatcctctccaaccttaccatcactcagctgttgaagaggctccatcagtggattaatgaggattgctccacgccatgctccggctcgtggctcagggatgtctgggactggatatgcacggtgttggctgacttcaagacctggctccagtccaagctcctgccgcggttgccgggaatccccttcctttcatgccaacgtgggtacaggggagtctggcggggagatggcgtcatgcacaccacctgcccatgtggagcacaaattactggacatgtaaaaaacggttccatgaggatcgttgggccaaaaacctgcagcaacacgtggcatggaacattccccatcaacgcatacaccacaggcccctgcacaccctccccggcgccaaactattccagagcgttgtggcgggtggctgctgaggagtatgtggaggttgcgcgggtgggggatttccactacgtgacgggcatgaccactgacaacataaagtgcccatgccaggttccggcccctgaattcttcacagaattggacggggtgcggctgcacaggtacgctccggcgtgcaaacctctcctacgggaggaggtcacattccaggtcgggctcaaccagtacccggttgggtcacagctcccatgtgagcccgaaccggatgtaacagtgcttacttccatgctcaccgacccctcccacattacggcggagacggctaagcgcaggctggccagggggtctcccccttccttggccagctcttcagctagtcagttgtctgcgccctccttgaaggcaacatgcactacccatcatgactccccagacgctgacctcatcgaggccaacctcctgtggcggcaggagatgggcgggaacatcacccgcgtggagtcagagaataaggtggtaattctagactcttttgacccgctacgagcggaggaggatgagagggaagtgtccgtcgcggcggagatcctgcggaaaaccaggaaattccccccagcgttgcccgtatgggcacgcccggactacaatccaccactgctagagccttggagggacccggactacgtccctccggtggtacatgggtgcccattgccacctaccaaggcccctccaataccacctccacggagaaagaggacggttatcctgacagaatccaccgtgtcttctgccttggcggagcttgctacaaagaccttcggcagctcgggatcgtcggccgtcgacagcggcacagcgaccgcccctcatgatctgccctccgacgacggtgacgcgggatccgacgttgggtcgtactcctccatgcccccccttgagggggagccgggggaccccgatctcagcgacgggtcttggtctactgtgagcgaggaggctagtgaggaccttgtctgctgttcgatgtcctatacatggacaggtgccttgatcaccccatgcgctgcggaagagagcaagctgcccatcaatgcgttgagcaactctttgctgcgtcaccacaacatggtctacgccacaacatcccgcagcgcaagccagcggcagaaaaaggtcacctttgacagaatgcaagtcctggacgaccactaccgggacgtgcttaaggagatgaaggcgaaggcgtccacagttaaggctaaacttctatccgtagaagaagcctgcaagctgacgcccccacattcggccagatccaaatttggctatggggcaaaggacgtccggaacctatccagcaaggccgttaaccacatccactccgtgtggaaggacttgctggaagacactgagacaccaattgacactaccatcatggcaaaaaatgaggtcttctgtgttcaaccagagaaaggaggccgcaagccagctcgccttatcgtattcccagatttgggggttcgtgtgtgcgagaaaatggccctttatgacgtggtctccactcttcctcaggccgtgatgggctcctcatacggattccaatactctcctgggcagcgggtcgagttcctggtgaatgcctggaaatcaaagaaaaaccctatgggcttcgcatatgacacccgctgctttgactcaacggtcactgagaatgacatccgtgttgaggagtcaatttaccaatgttgtgacttggcccccgaggccagacaggccataaggtcgctcacagagcggctttacatcgggggccccctgaccaattcaaaagggcagaactgcggctatcgtcggtgccgcgccagcggcgtgctgacgaccagctgcggcaacacccttacatgttacttgaaggcctctgcagcctgtcgagctgcgaagctccagaactgcacgatgctcgtgtgcggagacgacctcgtcgttatctgtgagagcgcgggaacccaggaggacgcggcgagcctacgagtcttcacggaggctatgacgaggtactctgccccccccggggacccgcccaaaccagaatacgacttggagctgataacatcatgctcctccaacgtgtcggtcgcgcacgatgcatctggcaagcgggtgtactacctcacccgcgaccccaccaccccctttgcgcgggctgcgtgggagacagctagacacactccagttaactcctggctaggcaacatcatcatgtatgcgcccaccttatgggcaaggatggttctgatgacccactttttctcaatccttctagcccaggagcaacttgagaaagccctagattgtcagatctacggggccacttactccattgagccacttgacctacctcagatcattcagcgactccatggtcttagcgcattttcactccatagttactctccaggtgagatcaatagggtggcttcatgcctcagaaaacttggggtaccacccctgcgagtctggagacatcgggccagaagtgtccgcgctaagctgctgtcccagggggggagggctgccacatgtggcaaatacctcttcaactgggcagtaaggaccaagctcaaactcactccaatcccagctgcgtcccagctggacttgtccggctggttcattgctggctacagcgggggagacatatatcacagcttgtctcgtgcccgaccccgctggttcatgtggtgcctactcctactttctgtaggggtaggcatctatttgctccccaaccggtgaacggggagctaacca

SEQ ID NO: 662 - DNA, 9379 bp, Hepatitis C Virus
ttgggggcgacactccaccatagatcactcccctgtgaggaactactgtcttcacgcagaaagcgtctagccatggcgttagtatgagtgtcgtgcagcttccaggaccccccctcccgggagagccatagtggtctgcggaaccggtgagtacaccggaattgccaggacgaccgggtcctttcttggattaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacaaatcctaaacctcaaagaaaaaccaaacgtaacaccaaccgtcgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggcaggacctgggctcagcctgggtacccttggcccctctatggcaatgagggcatggggtgggcaggatggctcctgtcaccccgcggctctcggcctagttggggccccacagacccccggcgtaggtcgcgtaatctgggtaaggtcatcgatacccttacatgcggcttcgccgacctcatggggtacattccgctcgtcggcgcccccctagggggcgctgccagggccctggcacatggtgtccgggttctggaggacggcgtgaactatgcaacagggaatttgcccggttgctctttctctatcttcctcttggctttgctgtcctgtttgaccatcccagcttccgcctatgaagtgcgcaacgtgtccggggcataccaagtcacgaacgactgctccaactcaagcattgtgtatgaggcagcggacatgatcttgcatacccccgggtgcgtgccctgtgttcgggagaacaactcctcccgttgctgggtagcgctcactcccacgctagcggccaggaatgccagcgtccccactacgacaatacgacgccatgtcgacttgctcgttggggcagctgctttctgttccgctatgtacgtgggagatctctgcggatctgttttcctcgtctcccagctgttcaccttctcgcctcgccggtatgagacagtacaggactgcaactgctcaatctatcccggccacgtgtcaggtcatcgcatggcttgggatatgatgatgaactggtcgcccacaacagccctagtggtgtcgcagttactccggatcccacaagctgccgtggatatggtggcgggggctcactggggagtcctagcgggccttgcctactattccatggtggggaactgggctaaggtgttgattgtgatgctactctttgccggcgttgacgggcatacccgcgtgacggggggggcgacagctcacaacacccgtgggctcacgtctctcttttcatttggggcgtctcagaagatccagcttataaataccaatggcagctggcacatcaacaggactgctctgaactgcaatgactccctccagacggggtttattgccgcactgttctacacacacaggttcaacgactctgggtgcacagagcgtttggccagttgccgctccattgacaagttcgagcaggggtggggttccatcacttatactgagcgtggcggtcaggaccagaggccttattgctggcactacgcacctaaacagtgtggtatcgtacccgcgtcgcaggtgtgtggcccagtgtattgtttcaccccaagcccagttgtggtggggacgaccgatcgtttcggtgtccctacgtataattggggggggaatgagacagacgtgctgctccttaacaacacgcggccaccgcaaggcaactggttcggctgtacatggatgaatagcactgggttcaccaagacgtgcgggggccccctgtgtaacatcgggggggtcggcaataacaccttaacctgccccacggactgcttccggaaacaccccgaggccacttacacaaaatgtggctcgggaccttggctgacacccaggtgcctagttgactacccatacaggctctggcattacccctgcactgtcaactttaccattttcaaggttaggatgtatgtggggggcgtggagcacaggctcaacgccgcatgcaattggacccgaggggagcgttgtgacttgggggacagggatagatcggagcttagcccgctgctgctgtctacaacagagtggcaggtactgccctgttccttcaccaccctaccggctctgtccaccggtttgatccatctccaccagaacatcgtggacgtgcaatacctgtacggcatagggtcggcggttgtttccattgcaatcaaatgggagtatgtcattctgcttttccttctcctggcggacgcgcgcgtctgcgcctgcttgtggatgatgctgctgatagcccaggctgaggccgccttagagaacctggtggttctcaatgcggcgtccgtggccggggcgcatggcattctctccttccttgtgttcttctgtgccgcctggtacatcaagggcaggctcgtccctggggcggcatatgctttttatggcgtatggccgctgctcctgctcctgctggcgttaccaccacgggcttacgccatggaccgggagatggctgcatcgtgcggaggcggggtttttgtaggtctggcactcttgaccttgtcaccatactataaagtgttcctcgctcggctcatatggtggttacagtactttatcaccagagccgaggcgcacctgcaagtgtggatcccccctctcaacgttcgaggaggccgagatgccatcatcctcctcacgtgtgcggtccacccagagctaatctttgacatcaccaagcttctgctcgccgtgctcggcccgctcatgatgctccaggctggcataactcgagtgccgtactttgtgcgcgctcaggggctcattcgtgcatgcatgttggtgcggaaagccgctgggggtcattacatccaaatggccctcatgaggctagccgcgctgacaggtacgtacgtttatgaccatcttgctccgctgcgggattgggcccacgcgggcctacgagacctcgcggtggcagtagagcccgtcgtcttctctgacatggagaccaaagttatcacttggggggcggacaccgcggcgtgtggggacatcatctcgggtctacctgtctccgcccgaaggggaaaggagatacttctgggaccggctgacagttttgatgggcaggggtggcgactccttgcccccatcacggcctactcccaacagacgcggggcctacttggttgcatcatcactagcctcacaggccgggacaagaaccaggttgagggggaggttcaagtggtctccaccgcaacacaatctttcctggcgacctgcgtcaacggcgcgtgttggactgtcttccatggtgccggctcgaagaccctagccggcccacaaggcccgatcacccagatgtacaccaatgtagaccaggacctcgtcggctggccggcgccctccggggcgcgttccttgacaccgtgcacctgtggcagctcggacctttatctggtcacgagacatgctgatgtcattccggtgcgccggcggggcgacactaggggaagtctactctcccccaggcctgtctcctacttgaagggctcttcgggtggtccactgctctgcccttcggggcacgctgtgggcatcttccgggctgctgtgtgcacccggggggtagcgaaggcggtggacttcatacccgttgagtctatggaaactaccatgcggtctccaatcttcacagacaactcatcccccccagccgtaccgcagacattccaagtggcccatctacatgcccccactggcagcggtaagagcaccaaagtgccggctgcatatgcagcccaagggtacaaggtactcgtcttgaacccgtccgttgccgccaccttgggtttcggggcgtatgtgtccaaagcacatggtatcgaccccaacatcagaactggggtaaggaccatcaccacaggcgcccctatcacatactccacctatggcaagttccttgccgacggtggttgctctgggggtgcctatgacatcataatgtgtgatgagtgccactcaactgactcgactagcatcttgggcatcggcactgtcctcgaccaggcggagacggctggagcgcggctcgtcgtgctcgccactgctacgcctccgggatcggtcaccgtgccgcaccccaacatcgaggaggtggccttgtccaacactggagagatccccttctacggcaaagccatccccattgaggtcatcaaagggggaaggcatctcattttctgccattccaagaaaaagtgtgacgagctcgccggaaagctgtcagccctcggactcaacgctgtagcttattatcggggtcttgatgtgtccgtcataccgaccagcggagacgttgtcgtcgtggcgacagacgctctaatgacgggctataccggcgactttgactcagtgatcgactgtaacacatgtgtcacccagacagtggattttagcttggatcccaccttcaccattgagacgatgaccgtgcctcaagacgcggtgtcgcgctcacagcggcggggtaggactggcaggggtaggagaggcacctacaggtttgtgactccgggagaacgaccctcgggcatgttcgattcctcggtcctgtgtgagtgctatgacgcgggttgtgcttggtatgagctcacacccgctgagaccacagttaggttgcgggcttacctaaatacaccagggctgcccgtctgccaggaccatctggagttctgggagagcgtcttcacaggcctcacccacatagatgcccactttctgtcccagaccaagcaggcaggagacaacttcccttacctggtagcatatcaagccacagtgtgcgccagagctcaagctccacctccatcgtgggatcaaatgtggaagtgtctcacacggcttaagcctacgctgcacgggccaacacccctgctgtacaggctaggagccgtccaaaatgaggtcaccctcacacaccccgtgaccaaactcatcatggcatgcatgtcggccgacctggaagtcgtcactagcacctgggtgctagtaggcggagtccttgcagctttggccgcatattgcttgacaacaggcagtgtggtcatcgtgggtaggatcatcctgtccgggagaccggctgttgttcccgacagggaagttctctaccgggagttcgatgaaatggaagagtgtgcctcacacctcccctacatcgagcagggaatgcagctcgctgagcaattcaaacagaaggcgctcgggttgctgcagacagctaccaagcaagcggaggctgctgctcccgtggtggaatccaagtggcaggcccttgaaaccttctgggcgaagcacatgtggaatttcatcagcgggatacagtacctagcaggcttatccactctgcctgggaaccccgcgatagcatcactgatggcattcacagcctctatcaccagcccgctcaccacccaaagtaccctcctatttaacatcttggggggatgggtggctgcccaactagccccccccagtgctgctacggccttcgtgggcgccggtatcaccggtgcggctattggcagcataggccttgggaaggtgattgtggacatcctggcgggatatggagcaggggtggctggcgcactcgtagcctttaagatcatgagcggcgaggcgccttcccccgaggacctggttaatttgctccctgccatcctctctcccggtgctctggtcgttggggtcgtgtgcgcagcaatactgcgtcgacacgtgggcccgggagagggggctgtgcagtggatgaaccggctgatagcgttcgcttcgcggggtaaccacgtctcccctacgcactatgtgcctgaaagcgacgctgcagtgcgtgttacccagatcctctccagccttaccatcacccagctgctgaagaggcttcaccagtggattaatgaggactgctccacgccatgctccggctcgtggctaagggatgtttgggactggatatgcacggtgttgaccgacttcaagacctggctccagtccaagctcctgccgcggttaccgggagttcccttcttctcgtgtcaacgcgggtacaagggagtctggcggggggacggcatcatgcaaaccacctgcccgtgtggagcacagatctctggacatgtcaaaaatggttccatgaggatcgttgggcctaaaacctgcagcaacacgtggcatggaacattccccatcaacgcatacaccacgggcccctgcacaccctccccggcgccagactattccagggcgctgtggcgggtagccgctgaggagtacgtggaggttacgcgggtgggggatttccactacgtgacgggcatgaccactgacaacgtaaagtgcccgtgccaggttccggcccccgaattcttcacggaagtggatggagtgcggttgcacaggtacgctccggcgtgcaaacctctcctacgggaggaggtcacattccaggtcggcctcaaccagtacctggtcgggtcacaactcccatgcgagcccgaaccggacgtggcagtgctcacttccatgctcactgacccctcccacattacagcagagacggcgaagcgtaggctggccaggggatctcccccttccttggccagctcttcagctagccagttgtctgcgccttctttgaaggcgacatgcactacccatcatgactccccggacgccgacctcatcgaggccaacctcctgtggcggcaggagatgggcgggaacatcacccgcgtggagtcagaaaacaaggtagtaattctggactctttcgacccgcttcgagcggaggaggatgagagggaaccatccgttccagcggagatcttgcgaaaaaccaagaagttcccccctgcaatacccatatgggcacggccggactataaccctccattgttagagtcctggaaagccccggactacgtccctccagtggtacacgggtgcccattgccacctaccaaggcccctccaataccgcccccacggagaaagaggacggttgtcctgacagagtccaccgtgtcttctgccctggcggagctcgccactaagagcttcggcagctccggatcatcggccgttgacagcggcacggcgaccgcccctcctgaccaggctctcgacgacggcgacaaagaatccgacgttgagtcgtactcctccatgcccccccttgagggagagccgggggatcccgatctcagcgacgggtcttggtctaccatgagcgaggagcctggtgaggacgtcgtctgctgttcaatgtcctacacatggacaggcgccctgatcacgccatgtgctgcggaggagagcaagctgcccatcaacccgttgagcaactccttgttgcgtcaccacaacatggtttatgccacaacatcccgcagcgcaggcctacggcagaagaaggtcacctttgacagactgcaagtcctggacgaccactaccgggacgtgctcaaggagatgaaggcgaaggcgtccacagttaaagctaaacttctatctatagaggaagcctgcaaactgacgcccccacattcggccagatccaaatttggctacggggcaaaggacgtccggaacctatccagcaaggccgttaaccacatccgctccgtgtggaaggacctgctggaagaccctgaaacaccaattgacaccaccatcatggcaaaaagtgaggttttctgtgttcaaccggagaagggaggccgcaagccagctcgccttatcgtattcccagacttgggagttcgtgtgtgcgagaagatggccctttatgacgtggtctccacccttcctcaggccgtgatgggctcctcatacggattccagtactctcctgggcagcgggtcgagttcctggtgaaaacttggaaatcaaagaaaaaccctatgggcttttcatatgacacccgctgttttgactcaacggtcactgagaatgacatccgtgttgaggagtcaatctaccaatgttgtgacttggcccccgaagccagacaggccataaagtcgctcacagagcggctctatatcgggggtcccctgactaattcaaaagggcagaactgcggttatcgccggtgccgcgcgagcggtgtgctgacgactagctgcggtaataccctcacatgttacttgaaggcctctgcagcctgtcgagctgcgaagctccgggactgcacgatgctcgtgaacggggacgaccttgtcgttatctgtgagagcgagggaacccaagaggacgcggcgagcctacgagtcttcacggaggctatgactaggtactcagccccccccggggaccccccccaaccagaatacgacttggagttgataacatcatgttcctccaatgtgtcggtcgctcacgatgcatctggcaaaagggtgtactacctcacccgtgaccccaccaccccccttgcacgggctgcgtgggagacagctagacacactccagtcaactcctggctaggcaacatcattatgtatgcgcccactttgtgggcgaggatgattttgatgactcatttcttctccatccttctagctcaggagcaacttgaaaaagccctagattgtcagatctacggggcctgttactccattcagccacttgacctacctcagatcattgagcgactccatggtcttagcgctttttcactccacagttactctccaggtgagatcaatagggtggcttcatgcctcaggaaacttggggtaccacccttgcgagtctggagacatcgggccagaagtgtccgcgctaagctactgtcccagggggggagggccgccacttgtggcaaatacctcttcaattgggcagtaaggaccaagcttaaactcactccaatcccggctgcgtcccggttggacttgtccagctggttcgtcgccggttacagcgggggagacatatatcacagcctgtctcgtgcccgaccccgctggttcatgttgtgcctactcctactttctgtaggggtaggcatctacttgctccccaaccggtgaacggggagctaaccact

SEQ ID NO: 663 - DNA, 9379 bp, Hepatitis C Virus
ttgggggcgacactccaccatagatcactcccctgtgaggaactactgtcttcacgcagaaagcgtctagccatggcgttagtatgagtgtcgtgcagcttccaggaccccccctcccgggagagccatagtggtctgcggaaccggtgagtacaccggaattgccaggacgaccgggtcctttcttggattaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacaaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggcaggacctgggctcagcctgggtacccttggcccctctatggcaatgagggcttggggtgggcaggatggctcctgtcaccccgcggctctcggcctagttggggccccacagacccccggcgtaggtcgcgtaatctgggtaaggtcatcgatacccttacatgcggcttcgccgacctcatggggtacattccgctcgtcggcgcccccctagggggcgctgccagggctctggcacatggtgtccgggttctggaggacggcgtgaactatgcaacagggaatttgcccggttgctctttctctatcttcctcttggctttgctgtcctgtttgaccatcccagcttccgcctatgaagtgcgcaacgtgtccggggcataccaggtcacgaacgactgctccaactcaagcattgtgtatgaggcagcggacatgatcttgcatacccccgggtgcgtgccctgtgttcgggagaacaattcctcccgttgctgggtagcgctcactcccacgctagcggccaggaatgccagcgtccccactacgacaatacgacgccatgtcgacttgctcgttggggcagctgctttctgttccgctatgtacgtgggagatctctgcggatctgttttcctcgtctcccagctgttcaccttctcgcctcgccggtatgagacagtacaggactgcaactgctcaatctaccccggccacgtgtcaggtcatcgcatggcttgggatatgatgatgaactggtcgcctacaacagccctagtggtgtcgcagttactccggatcccacaagctgccgtggatatggtggcgggggctcactggggagtcctagcgggccttgcctactattccatggtggggaactgggctaaggtgttgattgtgatgctactctttgccggcgttgacgggtacacccgcgtgacggggggggcgacagctcacaacacccgtgggctcacgtctctcttttcatttggggcgtctcagaagatccagcttataaataccaatggcagctggcacatcaacaggactgctctgaactgcaatgactccctccagacggggtttattgccgcactgttctacacacacaggttcaacgattctggatgcacagagcgtttggccagttgccgctccattgacaagttcgagcaggggtggggtcccatcacttatgctgagcgtggcggtcaggaccagaggccttattgctggcactacgcgcctaaacagtgtggtatcgtacccgcttcgcaggtgtgtggtccagtgtattgtttcaccccaagcccagttgtggtggggacgaccgatcggttcggtgtccctacgtataattggggggggaatgagacagacgtgctgctccttaacaacacgcggccgccgcaaggcaactggttcggctgtacatggatgaatagcactgggttcaccaagacgtgcgggggccccccgtgtaacatcgggggggtcggcaataacaccttaacctgccccacggactgcttccggaagcaccccgaggccacttacacaaaatgtggctcgggaccttggctgacacccaggtgcctagttgactacccatacaggctctggcattacccctgcactgtcaactttaccatctttaaggtcaggatgtatgtggggggcgtggagcacaggctcaacgctgcatgcaattggacccgaggggagcgttgtgacttgggggacagggatagatcggagcttagcccgctgctgctgtccacaacagagtggcaggtactgccctgttccttcaccaccctaccggctctgtccaccggtctgatccatctccaccagaacatcgtggacgtgcaatacctgtacggcatagggtcggcggttgtttctattgcaatcaaatgggagtatgtcattctgcttttccttctcctggcggacgcgcgagtctgcgcctgcttgtggatgatgctgctgatagcccaggctgaggccgccttagagaacctggtggttctcaatgcggcgtccgtggctggggcgcatggcattctctccttccttgtgttcttctgtgccgcctggtacatcaagggcaggctcgtccctggggcggcatatgctttttatggcgtatggccgctgctcctgctcctgctggcgttaccaccacgggcttacgccatggaccgggagatggctgcatcttgcggaggcggggtttttgtgggtctggcactcttgaccttgtcaccatactataaagtgttcctcgctaggctcatatggtggttacagtattttatcaccagagccgaggcgcacctgcaagtgtggatcccccctctcaacgttcggggaggccgagatgccatcatcctcctcacgtgtgcggtccacccagagctaatctttgacatcaccaagcttctgctcgccgtactcggcccgctcatgatgctccaggctggcataactcgagtgccgtactttgtgcgcgctcaagggctcattcgtgcatgcatgttggtgcggaaagccgctgggggtcattacatccaaatggccctcatgaggctagccgcgctgacaggtacgtacgtttatgaccatcttgctccgctgcgggattgggcccacgcgggcctacgagacctcgcggtggcagtggagcccgtcgtcttctctgacatggagaccaaagttatcacctggggggcggacaccgcggcgtgtggggacatcatctcgggtctacctgtctccgcccgaaggggaaaggagatacttctgggaccggctgacagttttgatgggcaggggtggcgactccttgcccccatcacggcctactcccaacagacgcggggcctacttggttgcatcatcactagcctcacaggccgggacaagaaccaggttgagggggaggttcaagtggtctccaccgcaacacaatctttcctggcgacctgcgtcaacggcgcgtgttggaccgtcttccatggcgccggctcaaagaccctagctggcccacaaggcccgattacccagatgtacaccaatgtagaccaagacctcgtcggctggccggcgccctccggggcgcgttccctgacaccatgcacctgtggcagctcggacctttacttggtcacgagacatgctgatgtcattccggtgcgccgacggggcgacactaggggaagcctactctcccccaggcctgtctcctacttgaagggctcttcgggtggtccgctgctctgcccttcggggcacgctgtgggcatcttccgggctgctgtgtgcacccggggggtagcgaaggcggtggacttcatacccgttgagtctatggaaactaccatgcggtctccaatcttcacagacaactcatctcccccagccgtaccgcagacattccaagtggctcatctacacgcccccactggcagcggtaagagcaccaaagtgccggctgcatatgcagcccaagggtacaaggtacttgtcttgaacccgtccgttgccgccaccttgggtttcggggcgtatgtgtctaaagcacatggtatcgaccccaatattagaactggggtaaggaccatcaccacaggcgcccctatcacatactccacctatggcaagttccttgccgacggtggttgctctgggggtgcctatgacatcataatgtgtgatgagtgccactcaactgattcgaccagcatcttgggcatcggcacagtcctcgaccaagcggagacggctggagcgcggctcgtcgtgctcgccactgctacgcctccgggatcggtcaccgtgccacaccccaacatcgaggaggtggccttgtccaacactggagagatccccttctacggcaaagccatccccatcgaggtcatcaagggggggaggcatctcattttctgccattccaagaagaagtgtgacgagctcgccggaaagctgtcagccctcggactcaatgctgtagcttattaccggggtcttgatgtgtccgtcataccgaccagcggagacgttgtcgtcgtggcgacagacgctctaatgacgggctataccggcgactttgactcagtgatcgactgtaacacatgtgtcacccagacagtggattttagcttggatcccaccttcaccattgagacgatgaccgtgccccaagacgcagtgtcacgttcacagcggcggggtaggactggcaggggtaggagaggcacctacaggtttgtgactccaggagaacgaccctcgggcatgttcgattcctcggtcctgtgtgagtgctatgacgcgggctgtgcttggtatgagctcacacccgctgagaccacagttaggttgcgggcttacctaaatacaccagggttgcccgtctgccaggaccatctggagttctgggagagcgtcttcacaggcctcacccacatagatgcccactttctgtcccagaccaagcaggcaggagacaacttcccttacctggtagcatatcaagccacagtgtgcgccagagctcaagctccacctccgtcgtgggatcaaatgtggaagtgtctcacacggcttaaacctacgctgcacgggccaacacccctgctgtacaggctaggagccgtccaaaatgaggtcacccttacacaccccgtgaccaaactcatcatggcatgcatgtcggccgacctggaagtcgtcactagcacctgggtgctagtaggcggagtccttgcagctttggccgcatattgcttgacaacaggcagtgtggtcatcgtgggcaggatcatcctgtccgggagaccggctgttgttcccgacagggaagttctctaccgggagttcgatgaaatggaagagtgtgcctcacacctcccctacatcgaacagggaatgcagctcgctgagcaattcaaacagaaggcgctcgggttgctgcagacagctaccaagcaagcggaggctgctgctcccgtggtggaatccaagtggcaggccctcgaaaccttctgggcgaagcacatgtggaatttcatcagcgggatacagtacttagcaggcttatccactctgcctgggaaccccgcgatagcatcactgatggcattcacagcctctatcaccagcccgctcaccacccaaagtaccctcctatttaacatcttggggggatgggtggctgcccaactcgccccccccagtgctgctacggccttcgtgggcgccggtatcaccggtgcggctattggcagcataggccttgggaaggtgattgtggacatcttggcgggatatggagcaggggtggctggcgcactcgtagcctttaagatcatgagcggcgaggcgccttcccccgaggacctggttaatttgctccctgccatcctctcccccggtgctttggtcgttggggtcgtgtgcgcagcaatactgcgtcgacacgtgggcccgggagagggggctgtgcagtggatgaaccggctgatagcgttcgcttcgcggggtaaccacgtttcccctacgcactatgtgcctgagagcgacgctgcagtgcgtgttactcagatcctctccagccttaccatcactcagctgctgaagaggcttcaccagtggatcaatgaggactgctccacgccatgctccggctcatggctaagggatgtttgggactggatatgcacggtgttgactgacttcaagacctggctccagtccaagctcctgccgcggttaccgggagtccccttcttctcgtgtcaacgcgggtacaagggagtctggcggggggacggcatcatgcaaaccacctgcccgtgtggagcacagatctccggacatgtcaaaaatggttccatgaggatcgttgggcctaaaacctgcagcaacacgtggcatggaacattccccatcaacgcatacaccacgggcccctgcacaccctccccggcgccagactattccaaggcgctgtggcgggtggccgctgaggagtacgtggaggttacgcgggtgggggatttccactacgtgacgggcatgaccactgacaacgtaaagtgcccatgccaggttccggcccccgaattcttcacggaagtggatggagtgcggttgcacaggtacgctccggcgtgcaaacctctcctacgggaggaggtcacattccaggtcggcctcaaccaatacctggtcgggtcacaactcccatgcgagcccgaaccggacgtggcagtgctcacttccatgctcactgacccctcccacattacagcagagacggcgaagcgtaggctggccaggggatctcccccttccttggccagctcttcagctagccagttgtctgcgccttctttgaaggcgacatgcactacccatcatgactccccggacgccgacctcatcgaggccaacctcctgtggcggcaggagatgggcgggaacatcacccgcgtggagtcggaaaacaaggtagtaattctggactctttcgacccgcttcgagcggaggaggacgagagggaaccatccgttccagcggagatcttgcggaaaaccaagaagttccctccagcaatacccatatgggcacgcccagattataaccctccattgttagagtcctggaaagacccggactacgtccctccggtggtacacgggtgcccattgccacctaccaaggcccctccaataccgcccccacggagaaagaggacggttgtcctgacagagtccaccgtgtcttctgccctggcggagctcgccgttaagagcttcggcagctccggatcatcggccgttgacagcggcacggcgaccgcccctcccgaccaggctctcgacgacggcgacaaagaatccgacgttgagtcgtactcctccatgcccccccttgagggagagccgggggaccccgatctcagcgacgggtcttggtctaccatgagcgaggagcctggtgaggacgtcgtctgctgttcaatgtcctacacatggacaggtgccctgatcacgccatgcgctgcggaggagagcaagctgcccatcaacccgttgagcaactccttgttgcgtcaccacaacatggtctatgccacaacatcccgcagcgcaggcctacggcagaagaaggtcacctttgacagactgcaagtcctggacgaccactaccgggacgtgctcaaggagatgaaggcgaaggcgtccacagttaaagctaaacttctatctatagaggaagcctgcaaactgacgcccccacattcggccagatccaaatttggctacggggcaaaggacgtccggaacctatccagcaaggccgttaaccacatccgctccgtgtggaaggacctgctggaagaccctgaaacaccaattgacaccaccatcatggcaaaaagtgaggttttctgtgttcaaccggagaagggaggccgcaagccagctcgccttatcgtattcccagacttgggagttcgtgtgtgcgagaagatggccctttacgacgtggtctccacccttcctcaggccgtgatgggctcctcatacggattccagtactctcctaagcagcgggtcgagttcctggtgaacacttggaaatcaaagaaaaaccctatgggcttttcatatgacacccgctgttttgactcaacggtcactgagagtgacatccgtgttgaggagtcaatctaccaatgttgtgacttggcccccgaagccagacaggccataaagtcgctcacagagcggctctatatcgggggtcccctgactaattcaaaagggcagaactgcggttatcgccggtgccgcgcgagcggtgtgctgacgactagctgcggtaatacccttacatgttacttgaaggcctctgcagcctgtcgagctgcgaagctccgggactgcacgatgctcgtgaacggggacgaccttgtcgttatctgtgagagcgagggaacccaagaggacgcggcgagcctacgagtcttcacggaggctatgactaggtactcagccccccccggggaccccccccaaccagaatacgacttggagctgataacatcatgctcctccaatgtgtcggtcgctcacgatgcatctggcaaaagggtgtactacctcacccgtgaccccaccaccccccttgcacgggctgcgtgggagacagctagacacactccagtcaactcctggctaggcaacatcattatgtatgcgcccactttgtgggcaaggatgattttgatgactcatttcttctccatccttctagctcaggagcaacttgaaaaagccctagattgtcagatctacggggcctgttactccattcagccacttgacctacctcagatcattgagcgactccatggtcttagcgctttttcactccacagttactctccaggtgagatcaatagggtggcttcatgcctcaggaaacttggggtaccacccttgcgggtctggagacatcgggccagaagtgtccgcgctaagctactgtcccagggggggagggccgccacttgtggcaagtacctcttcaattgggcagtaaggaccaagcttaaactcactccaatcccggctgcgtcccagttggacttgtccagctggttcgtcgccggttacagcgggggagacatatatcacagcctgtctcgtgcccgaccccgctggttcatgttgtgcctactcctactttccgtaggggtaggcatctacttgctccccaaccggtgaacggggagctaaccact

SEQ ID NO: 664 - DNA, 9379 bp, Hepatitis C Virus
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggcaggacctgggctcagcccgggtacccttggcccctctatggcaacgagggcatggggtgggcaggatggctcctgtcaccccgcggctcccggcctagttggggccccaacgacccccggcgtaggtcgcgtaatttgggtaaggtcatcgatacccttacatgcggcttcgccgacctcatggggtacattccgcttgtcggcgcccctctaggaggcgctgccagggccctggcacatggtgtccgggttctggaggacagcgtgaactatgcaacagggaatctgcccggttgctctttctctatcttcctcttggctctgttgtcttgtttgaccatcccagcttccgcttacgaagtgcgcaacgtgtccggggtataccatgtcacgaacgactgctccaactcaagcattgtgtatgaggcagcggacatcatcatgcatacccccgggtgcatgccctgcgtgcgggaggacaacatctcccgttgctgggtagcgctcacccccacgctcgcagccaggaacatcagtgtccctactacgacaatacgacgccacgtcgacttgctcgttgggacggctgctttttgctctgctatgtacgtgggggatctctgcggatctgtcttcctcgtctcccagctgttcaccttctcacctcgccggcatgagacagtacaggactgcaattgctcaatctatcctggccacgtatcaggtcaccgcatggcttgggatatgatgatgaactggtcacctacagcagccctagtggtgtcgcagttgctccggatcccacaagccgtcgtggacatggtggcgggggcccactggggagtcctagcgggccttgcctactattccatggtggggaactgggctaaggttttgattgtgatgctgctttttgccggtgttgacgggaccacccacgtgacgggggggacgcaagcccgcagcgcccacatactcacgtcttttcttacagttgggccttctcagaaaatccagcttgtgaataccaatggcagctggcatatcaacaggactgccctgaactgcaatgactccctccagactgggttccttgccgcgctgttctacacacacaggttcaacgcgtccggatgcccagaacgtatggccagttgccgtcccattgacacattcgatcagggatggggtcccatcacttatgctgagcctaacaatccggaccagaggccttattgctggcactacgcacctcgaccgtgtggtatcgaacccgcgtcgaaggtgtgtggtccagtgtattgcttcaccccaagccctgttgtggtggggaccaccgatcgcttcggtgtccctacgtataactggggggagaatgagacggatgtgctgctcctcaacaacacgcggcctccgcaaggcaattggttcggctgtacatggatgaacagcactgggttcaccaagacgtgtgggggccccccgtgtaacatcgggggggccggcaacaacaccttgatctgccccacggattgcttccggaagcaccccgaggccacttacacaaaatgtggctcggggccttggttgacacctaggtgcttagttgactacccatacaggctctggcactacccctgcaccgtcaacttcaccatcttcaaggttaggatgtatgtggggggcgtggagcacaggctcagtgctgcatgcaattggactcgaggagagcgttgtgacttggaggacagggataggtcagaactcagcccgctgctgctgtcaacaacagagtggcagatactgccctgttccttcaccaccctaccggctctgtccactggtttgatccatctccatcggaacatcgtggacgtgcaatatctgtacggtgtggggtcggcggttgtctcctttgcaatcagatgggaatatgtcttgttgctcttcctcctcctggcggacgcgcgcgtctgcgcctgtttgtggatgatgctgctgatagcccaggctgaggccgccttagagaacttggtggtcctcaatgcggcatccgtggccggagcgcatggcattctctccttccttgtgttcttctgtgccgcctggtacatccaaggcaggctggtccctggggcggcatatgctctctatggcgtatggccgctgctcctgctcctgttggcgttaccaccacgagcttacgccatggaccgggagatggctgcatcgtgtggaggcgcggtattcgtaggtctggcattcttgaccttgtcaccatactataaagtgttcctcgctaggctcatatggtggttacaatatttcatcactagagccgaggcgcacttgcaagtgtgggttccccccctcaatgtccggggaggccgcgatgccatcatcctcctcatgtgcgtggtccacccagagctaatctttgacatcaccaagctcctgctcgccatattcggtccactcatggtgctccaggctggcataactagagtgccgtacttcgtacgcgctcatgggctcattcgtgcatgcatgttagtgcggaaagttgctgggggccattatgtccaaatggccttcgtgaagctggctgcgctgacaggcacgtacgtttatgaccatcttgccccactgcagcattgggcccactcgggcctacgagaccttgcggtggcagtagagcccgtcgtcttttctgacatggagaccaagatcatcacctggggggcagacaccgcggcgtgtggggacatcatcttgggtctgcccgtctccgcccgaaggggtagggagatactcctgggaccagccgatagtcttgaagggcaggggtggcgactcctcgcgcccatcacggcttactcccaacagacacggggcctacttggttgcatcatcaccagcctcacgggtcgagacaagaaccaggtcgagggggaggttcaagtggtctccaccgcaacacaatctttcctggcgacctgcatcaacggcgtgtgttggactgttttccacggcgccggctcaaagaccctagcaggcccgaaaggtccaatcacccaaatgtacaccaatgtagaccaggacctcgtcggctggcaggcgccccccggggcgcgttccatgacaccatgcacctgcggcagctcggacctttacttggtcacgagacatgccgatgtcatcccggtgcgccggcggggtgacggcagggggagccttctctccccaaggcccgtctcctacttgaagggctcttcgggtggtccgctgctctgcccttcggggcatgccgtgggcatcttccgggctgctgtgtgcacccggggggttgcgaaggcggtggacttcatacccgtcgagtctatggaaactaccatgcggtctccggtcttcacagacaactcatctcccccggctgtaccgcagacattccaagtggctcatctacacgcccccactggcagcggcaagagcactaaagtgccggctgcatatgcagcccaagggtacaaggtactcgtcctgaacccgtccgttgccgccaccttaggttttggggcgtatatgtccaaggcatatggtaccgaccctaacatcagaactgggataaggaccatcaccacgggcgcccccatcacgtactccacctatggcaagttccttgctgacggtggttgctccgggggtgcttatgacatcataatatgtgatgagtgccactcaactgactcaactaccatcctgggcatcggcacagtcctggatcaagcggagacggctggagcgcggctcgtcgtgctcgccaccgctacacctccgggatcggtcaccgtgccacacccaaacatcgaggaggtggccctgtccaacactggagagatccccttctatggcaaagccatccccatcgaggtcatcaaggggggtaggcatctcattttctgccattccaagaagaagtgcgacgagctcgccgcaaagctgtcagccctcggactcaatgctgtagcgtattaccggggtcttgatgtgtccgtcataccgaccagcggagatgtcgttgtcgtggcaacagacgctctaatgacgggctataccggcgactttgactcagtgattgactgcaacacatgtgtcacccagacagtcgacttcagcttggatcccaccttcaccattgaaacgacaaccgtgccccaagatgcggtgtcgcgctcgcaacggcgaggtaggactggcaggggtaggggaggcatctacaggtttgtgactccaggagaacggccttcgggcatgttcgattcgtcggtcctgtgtgagtgctatgacgcgggctgtgcgtggtacgagctcacgcccgctgagacctcggttaggttgcgggcgtacctaaatacaccagggttgcccgtctgccaggaccatctggagttctgggagagtgtcttcacaggcctcacccacatagatgcccacttcttgtcccagactaagcaggcaggagataacttcccctacctggtggcataccaggccacggtgtgcgccagggctcaggctccacctccatcgtgggaccaaatgtggaagtgtctcatacggctaaaacctacactgcacgggccaacacccctgctgtataggctaggagccgtccaaaatgaggtcaccctcacacaccccataaccaaattcatcatggcatgcatgtcggctgacctggaggtcgtcaccagcacctgggtgctggtaggcggagtcctcgcagctctggccgcgtattgcctgacaacaggcagcgtggtcattgtgggcaggattatcttgtccgggaagccggctgtcattcccgacagggaagttctctaccgggagttcgatgagatggaagagtgcgcctcgcacctcccttacatcgaacaggggatgcagctcgccgagcaattcaaacagaaagcgctcgggttgctgcaaacagccaccaagcaagcggaggctgctgctcccgtggtggagtccaagtggcgagccctcgagaccttctgggcgaagcacatgtggaatttcatcagcgggatacagtacttagcaggcttgtccactctgcctgggaaccccgcgatagcatcactgatggcattcacagcctccattaccagcccgctcaccacccaaactacccttatgtttaacatcttggggggatgggtggctgcccaactcgctccccccagcgctgcttcggcttttgtgggcgccggcattgccggtgcggctgttggcagcataggtcttgggaaggtgcttgtggacatcctggcgggctatggggcaggggtggctggcgcactcgtggcttttaaagtcatgagcggcgagatgccctccaccgaggacctgattaatctgctccctgccatcctctctcctggtgccctggtcgtcggggtcgtgtgcgcagcaatactgcgccggcacgtgggcccgggagaaggggctgtgcagtggatgaaccggctgatagcgttcgcttcgcggggtaaccatgtctcccccacgcactatgtgcctgagagcgacgccgcagcgcgtgttactcagatcctctccagccttaccatcactcagctgctgaagaggcttcaccagtggatcaatgaagactgctccacgccatgctccggctcgtggttaagggatgtttgggactggatatgcacggtgctgtctgactttaagacctggctccagtccaagatcatgccgcggttgccgggagtccctttcctctcgtgtcaacgcggctacaagggagtctggagaggggacggcatcatgcagaccacctgcccatgtggagcacagatcaccggacatgtcaagaacggttccatgaggatcgttgggcctaaaacctgcagcaacacgtggcatggaacattccccatcaacgcatacaccacgggcccctgcacaccctccccggcgccaaactattccagggcgctgtggcgggtggctgctgaggagtacgtggaggttacgcgggtgggggatttccactacgtgacgggcatgaccactgacaacgtaaagtgcccatgccaggttccagcccccgaattcttcacagaagtggatggagtacggttgcacaggtacgctccggcgtgcaaacctctcctacgggaggaggtcacattccaggtcgggctcaaccaatacttggttgggtcacaactcccatgcgagcccgaaccggatgtagcagtgctcacttccatgctcaccgacccgtcccacattacagcagagacggctaagcgtaggctggccagggggtctcccccctccttggccagctcttcagctagccagttgtctgcgccttccttgaaggcgacatgcaccactcatcatgactccccggacgctgacctcatcgaggccaacctcttgtggcggcaagagatgggcgggaacatcacccgtgtggagtcagagaacaaggtggtaattttggactctttcgacccgcttcgagcggaggaggatgagagggaggtatccgttgcggcggaaatcctgcggagatccaggaagttccccccagcgctgcccgtatgggcacgcccggattacaaccctccactgctagagtcctggaaggacccggactacgtccctccggtggtacatgggtgcccattgccacctaccaaggcccccccaataccacctccacggagaaagaggacggttgtcttgacagagtccactgtgtcttctgccctggcggagctcgctactaagacctttggtagctccggatcgtcggccgtcgacagcggcacggcgactgctccccctgaccaggcctccgacgacggcgacaaagaatccgacgttgagtcatactcctccatgcccccccttgagggagagccgggggaccctgatctcagcgacgggtcttggtctaccgtgagcgaagaggccagtgaggacgtcgtctgctgctcaatgtcctacacatggacaggcgccctgatcacgccatgcgctgcggaggagagcaagttgcccatcaacccgttgagcaactccttgctgcgtcaccacaacatggtctacgccacaacatcccgtagcgcaagcctgcggcagaagaaggtcacctttgacagactgcaagtcctggacgaccactaccgggacgtgctcaaggagatgaaggcgaaggcgtccacagttaaggctaaacttctatctatagaagaagcctgcaagctgacgcccccacattcggccagatccaaatttggctatggggcaaaggacgtccggagcctatccagcaaggccgtcaaccacatccgctccgtgtgggaggacttgctggaagacactgagacaccaattgacaccaccatcatggcaaaaagcgaggttttctgcgtccaaccagagaagggaggccgcaagccagctcgccttatcgtattcccagatctgggagttcgtgtatgcgagaagatggccctctacgacgtagtctccacccttcctcaggccgtgatgggctcctcatacggattccagtactctcctaagcagcgggtcgagttcctggtgaatacctggaagtcaaagaaatgccctatgggcttctcatatgacacccgctgttttgactcaacggtcactgagagtgacatccgtactgaggagtcaatttaccaatgctgtgacttggcccccgaagctagaaaggccataaagtcgctcacagagcggctctacatcgggggtcccctgactaattcaaaagggcagaactgcggttatcgccggtgccgcgcaagcggcgtgctgacgactagctgcggtaataccctcacatgttacttgaaagcctctgcggcctgtcgagctgcgaagctccaggactgcacgatgctcgtgaacggagacgacctagtcgttatctgtgagagcgcgggaacccaagaggatgcggcgagcctacgagtcttcacggaggctatgactaggtactctgccccccccggggacccgccccaaccagaatacgacttggagctgataacatcgtgctcctccaatgtgtcggtcgcacacgatgcatctggcaaaagggtgtactacctcacccgcgaccccaccaccccccttgcacgggctgcgtgggagacagctagacacactccagtcaactcctggctaggcaacatcatcatgtatgcgcccaccctatgggcaaggatgattctgatgactcacttcttctccatccttctagcccaggagcaacttgaaaaagccctagattgtcagatctacggggcctgttactccattgagccacttgacctacctcaaatcattgaacgactccatggtcttagcgcattttcactccatagttactctccaggtgagatcaatagggtggcttcatgcctcaggaaacttggggttccacccttgcgagtctggagacatcgggccagaagtgtccgcgctaagctactgtcccagggggggagggccgccacttgtggcaagtacctcttcaactgggcagtaaggaccaagcttaaactcactccaatcccggctgcgtcccggctggacttgtccggctggttcgtcgctggttacagcgggggagacatatatcacagcctgtctcgtgcccgaccccgctggttcatgtggtgcctactcctactttccgtaggggtaggcatctacctgctccccaaccgatgaacggggagctaaccact

SEQ ID NO: 665 - DNA, 9379 bp, Hepatitis C Virus
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggcaggacctgggctcagcccgggtacccttggcccctctatggcaacgagggcatggggtgggcaggatggctcctgtcaccccgcggctcccggcctagttggggccccaacgacccccggcgtaggtcgcgtaatttgggtaaggtcatcgataccctcacatgcggcttcgccgacctcatggggtacattccgcttgtcggcgcccctctaggaggcgctgccagggccctggcacatggtgtccgggttctggaggacagcgtgaactatgcaacagggaatttgcccggttgctctttctctatcttcctcttggctttgctgtcttgtttgaccatcccagcttccgcttacgaagtgcgcaacgtgtccggggtataccatgtcacgaacgactgctccaactcaagcattgtgtatgaggcagcggacatcatcatgcatacccccgggtgcacgccctgcgtgcgggagggcaacatctcccgttgctgggtagcgctcacccccacgctcgcagccaggaacatcagtgtccctactacgacaatacgacgccacgtcgacttgctcgttgggacggctgctttttgctctgctatgtacgtgggggatctctgcggatctgtcttcctcgtctcccagctgttcaccttctcacctcgccggcatgagacagtacaggactgcaattgctcaatctatcctggccacgtatcaggtcaccgcatggcttgggatatgatgatgaactggtcacctacagcagccctagtggtgtcgcagttgctccggatcccacaagccgtcgtggacatggtggcgggggcccactggggagtcctagcgggccttgcctactattccatggtggggaactgggctaaggttttgattgtgatgctgctttttgccggtgttgacgggaccacccacgtgacggggggggcgcaagcccacagcgcccacacgctcatgtctttttttacagttgggccttctcagaaaatccagcttgtgaataccaatggcagctggcatatcaacaggactgccctgaactgcaatgactccctccagactgggttccttgccgcgctgttctacacacacaggttcaacgcgtccggatgcccagaacgtatggccagctgccgtcccattgacacattcgatcagggatggggtcccatcacttatgctgagcctaacagtccggaccagaggccttattgctggcactacgcacctcgaccgtgtggtatcgaacccgcgtcgaaggtgtgtggtccagtgtattgcttcaccccaagccctgttgtggtggggactaccgatcgcttcggtgtccctacgtataactggggggagaatgagacggatgtgctgctcctcaacaacacgcggcctccgcaaggcaattggttcggctgtacatggatgaacagcactgggttcaccaagacgtgtgggggccccccgtgtaacatcgggggggccggcaacaacaccttgacctgccccacggattgcttccggaagcaccccgaggccacttacacaaaatgtggctcggggccttggttgacacctaggtgcttagttgactacccatacaggctctggcactacccctgcactgtcaacttcaccatcttcaaggttaggatgtatgtggggggcgtggagcacaggctcagtgctgcatgcaattggactcgaggagagcgttgtgacttggaggacagggataggtcagaactcagcccgctgctgctatcaacaacagagtggcagatactgccctgttccttcaccaccctaccggctctgtccactggtttaatccatctccatcggaatatcgtggacgtgcaatatctgtacggtgtggggtcggcggttgtctccattgcaatcagatgggaatatgtcttgttgctcttcctcctcctggcggacgcgcgcgtgtgcgcctgcttgtggatgatgctgctgatagcccaggctgaggccgccttagagaacttggtggtcctcaatgcggcatccgtggccggagcgcatggcattctctccttccttgtgttcttctgtgccgcctggtacatcaagggcaggctggtccctggggcggcatatgctctctatggcgtatggccgctgctcctgctcctgttggcgttaccgccacgtgcttacgccatggaccgggagatggctgcatcgtgtggaggcgcggttttcgtaggtctggcattcttgaccttgtcaccatactataaagtgttcctcgctaggctcatatggtggttacaatatttcatcactagagccgaggcgcacttgcaagtgtgggttccccccctcaatgtccggggaggccgcgatgccatcatcctcctcatgtgcgtggtccacccagagctaatctttgacatcaccaagctcctgctcgccatattcggtccactcatggtgctccaggctggcataactagagtgccgtacttcgtacgcgctcatgggctcattcgtgcatgcatgttagtgcggaaagttgctgggggccattatgtccaaatggccttcgtgaagctggctgcgctgacaggcacgtacgtctatgaccatcttgccccactgcagcattgggcccactcgggcctgcgagaccttgcggtggcagtagagcccgtcgtcttttctgacatggagaccaagatcatcacctggggggcagacaccgcggcgtgtggggacatcatcttgggcttgcccgtctccgcccgaaggggtagggagatactcctgggaccagccgatagtcttgaagggcaggggtggcgactcctcgcgcccatcacggcttactcccaacagacgcggggcctacttggttgcatcatcaccagcctcacaggtcgggacaagaatcaggtcgagggggaggttcaagtggtctccaccgcaacacaatctttcctggcgacctgcatcaacggcgtgtgttggactgttttccacggcgccggctcaaagaccctagcaggcccgaaaggtccaatcacccaaatgtacaccaatgtagaccaggacctcgtcggctggcaggcgccccccggggcgcgttccatgacaccatgcacctgcggcagctcggacctttacttggtcacgagacatgccgatgtcatcccggtgcgccggcggggtgacggcagggggagccttctctccccaaggcccgtctcctatttgaagggctcttcgggtggtccgctgctctgcccttcggggcatgccgtgggcatcttccgggctgctgtgtgcacccggggggttgcgaaggcggtggacttcatacccgtcgagtctatggaaactaccatgcggtcgccggttttcacagacaactcatctcccccggctgtaccgcagacattccaagtggctcatctacacgcccccactggcagcggcaagagcactaaagtgccggctgcgtatgcagcccaagggtacaaggtactcgtcctgaacccgtccgttgccgccaccttaggttttggggcgtatatgtccaaggcatatggtaccgaccctaacatcagaactgggataaggaccatcaccacgggcgcccccattacatactccacctacggcaagttccttgccgacggtggttgctccgggggtgcttatgacatcataatatgtgatgagtgccactcaactgactcaactaccattctgggcatcggcacagtcctggatcaagcggagacggctggagcgcggctcgtcgtgctcgccaccgctacacctccgggatcggtcaccgtgccacacccaaatatcgaggaggtggccctgtccaacactggagagatccccttctatggcaaagccatccccatcgaggtcatcaaggggggaaggcatctcattttctgccattccaagaagaagtgcgacgagctcgccgcaaagctgtcagccctcggactcaatgctgtagcgtattaccggggtctggatgtgtccgtcatacctaccagcggagatgtcgttgtcgtggcaacagacgctctaatgacgggctataccggcgactttgactcagtgattgactgcaacacatgcgtcacccagacagtcgacttcagcttggatcccaccttcaccattgaaacgacaaccgtgccccaagatgcggtgtcgcgctcgcaacggcgaggtaggactggcaggggtagggggggcatctacaggtttgtgactccaggagaacggccttcgggcatgttcgattcttcggtcctgtgtgagtgctatgacgcgggctgtgcgtggtacgagctcacgcccgctgagacctcggttaggttgcgggcgtacctaaatacaccagggttgcccgtctgccaggaccatctggagttctgggagagtgtctttacaggcctcacccacatagatgcccacttcttgtcccaaactaagcaggcaggagataacttcccctacctggtggcataccaggccacagtgtgcgccagggctcaggctccacctccatcgtgggaccaaatgtggaagtgtctcatacggctaaaacctacactgcacgggccaacacccctgctgtataggctaggagccgtccaaaatgaggtcaccctcacacaccccataaccaaattcatcatggcatgcatgtcggctgacctggaggtcgtcaccagcacctgggtgctggtaggcggagtcctcgcagctctggccgcgtattgcctgacaacaggcagcgtggtcattgtgggcaggattatcttgtccgggaagccggctgtcattcccgacagggaagttctctaccaggagttcgatgagatggaagagtgcgcctcgcacctcccttacatcgaacagggaatgcagctcgccgagcaattcaaacagaaagcgctcgggttgctgcaaacagccaccaagcaagcggaggctgctgctcccgtggtggagtccaagtggcgagccctcgagaccttctgggcgaagcacatgtggaatttcatcagcgggatacagtacttagcaggcttgtccactctgcctgggaaccccgcgatagcatcactgatggcattcacagcctccattactagcccgctcaccacccaaactacccttatgtttaacatcttggggggatgggtggctgcccaactcgctccccccagcgctgcttcggcttttgtgggtgccggcattgccggcgcggctgttggcagcataggtcttgggaaggtgcttgtggacatcctggcgggctatggggcaggggtggctggcgcactcgtggcttttaaagtcatgagcggcgagatgccctccaccgaggacctgattaatctgctccctgccatcctctctcctggtgccctggtcgtcggggtcgtgtgcgcagcaatactgcgccggcacgtgggcccgggagaaggggctgtgcagtggatgaaccggctgatagcgttcgcttcgcggggtaaccacgtctcccccacgcactatgtgcctgagagcgacgccgcagcgcgtgtgactcagatcctctccagccttaccatcactcagctgctgaagaggcttcaccagtggatcaacgaagactgctccacgccatgctccggctcgtggttaagggatgtttgggactggatatgcacggtgctgactgactttaagacctggctccagtccaagatcatgccgcggttaccgggagtccctttcctctcgtgtcaacgcggctacaagggagtctggaggggggacggcatcatgcagaccacctgcccatgtggagcacagatcaccggacatgtcaagaacggttccatgaggatcgttgggcctaaaacctgcagcaacacgtggcatggaacattccccatcaacgcatacaccacgggcccctgcacaccctccccggcgccaaactattccagggcgctgtggcgggtggctgctgaggagtacgtggaggttacgcgggtgggggatttccactacgtgacgggcatgaccactgacaacgtaaagtgcccatgccaggttccagcccccgaattcttcacagaagtggatggagtacggttgcacaggtacgctccggcgtgcaaacccctcctacgggaggaggtcacattccaggtcgggctcaaccaatacttggttgggtcacaactcccatgcgagcccgaaccggatgtagcagtgctcacttccatgctcaccgacccatcccacattacagcagagacggctaagcgtaggctggccagggggtctcccccctccttggccagctcttcagctagccagttgtctgcgccttccttgaaggcgacatgcaccacccatcatgactccccggacgctgacctcatcgaggccaacctcttgtggcggcaagagatgggcgggaacatcacccgcgtggagtcagagaacaaggtggtaattttggactctttcgacccgcttcgagcggaggaggatgagagggaggtatccgttgcggcggaaatcctgcggagatccaggaagttccccccagcgctgcccgtatgggcacgcccggattacaaccctccactgctagagtcctggaaagacccggactacgtccctccggtggtacatgggtgcccattgccacctaccaaggcccccccaataccacctccacggagaaagaggacggttgtcttgacagagtccagtgtgtcttctgccttggcggagctcgctactaagacctttggtagctccggatcgtcggccgtcgacagcggcacggcgactgctccccctgaccaggcctccgacgacggcgacaaagaatccgacgttgagtcatactcctccatgcccccccttgagggagagccgggggaccctgatctcagcgacgggtcttggtctaccgtgagcgaagaggccagtgaggacgtcgtctgctgctcaatgtcctacacatggacaggcgccctgatcacgccatgcgctgcggaggaaagcaagttgcccatcaacccgttgagcaactccttgctgcgtcaccacaacatggtctacgccacaacatcccgtagcgcaagcctgcggcagaagaaggtcacctttgacagactgcaagtcctggacgaccactaccgggacgtgctcaaggagatgaaggcgaaggcgtccacagttaaggctaaacttctatctatagaagaagcctgcaagctgacgcccccacattcggccagatccaaatttggctatggggcgaaggacgtccggagcctatccagcaaggccgtcaaccacatccgctccgtgtgggaggacttgctggaagacactgagacacccattgacaccaccatcatggcaaaaagcgaggttttctgcgtccaaccagagaaaggaggccgcaagccagctcgccttatcgtattcccagatctgggagttcgtgtatgcgagaagatggccctctacgacgtagtctccacccttcctcaggccgtgatgggctcctcatacggattccagtactctcctaagcagcgggtcgagttcctggtgaatacctggaagtcaaagaaatgccctatgggcttctcatatgacacccgctgttttgactcaacggtcactgagagtgacatccgtactgaggagtcaatttaccaatgctgtgacttggcccccgaagctagaaaggccataaagtcgctcacagagcggctctacatcgggggtcccctgactaattcaaaagggcagaactgcggttatcgccggtgccgcgcaagcggcgtgctgacgactagctgcggtaataccctcacatgttacttgaaagccactgcggcctgtcgagctgcgaagctccaggactgcacgatgctcgtgaacggagacgacctcgtcgttatctgtgaaagcgcgggaacccaagaggatgcggcgagcctacgagtcttcacggaggctatgactaggtactctgccccccccggggacccgccccaaccagaatacgacttggagctaataacatcgtgctcctccaatgtgtcggtcgcacacgatgcatctggcaaaagggtgtactacctcacccgcgaccccaccaccccccttgcacgggctgcgtgggagacagctagacacactccagtcaactcctggctaggcaacatcatcatgtatgcgcccaccctatgggcaaggatgattctgatgactcacttcttctccatccttctagcccaggagcaacttgaaaaagccctagattgtcagatctacggggcctgttactccattgagccacttgacctacctcagatcattgaacgactccatggtcttagcgcattttcactccatagttactctccaggtgagatcaatagggtggcttcatgcctcaggaaacttggggttccacccttgcgagtctggagacatcgggccagaagtgtccgcgctaagctactgtcccagggggggagggccgccacatgtggcaagtacctcttcaactgggcagtaaggaccaagctcaaactcactccaatcccggctgcgtcccggctggacttgtccggctggttcgtcgctggttacagcgggggagacatatatcacagcctgtctcgtgcccgaccccgctggttcatgtggtgcctactcctactttccgtaggggtaggcatctacctgctccccaaccgatgaacggggagctaaccact

SEQ ID NO: 666 - DNA, 9379 bp, Hepatitis C Virus
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggatgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacaaatcctaaaccccaaagaaaaaccaaacgtaacaccaaccgtcgcccacaggacgtcaagttcccgggcggtggtcagatcgttggtggagtttacctgttgccgcgcaggggccctaggttgggtgtgcgcgcgactaggaagacttccgagcggtcgcaacctcgtggaaggcgacagcctatccccaaggctcgccaacccgagggcaggacctgggctcagcccgggtacccttggcccctctatggcaacgagggtatggggtgggcaggatggctcctgtctccccgtggctcccggcctagttggggcccctcagacccccggcgtaggtcgcgtaatttgggtaaggtcatcgacaccctcacatgcggcttcgccgacctcttggggtacattccgctcgtcggcgcccccatagggggcgttgccagggccctggcacatggtgtccgggttctggaggacggcgtgaactatgcaacagggaatttgcccggttgctctttctctatcttcctcttagctctgctgtcctgtttgactaccccagcttccgcctatgaagtgcgcaacgtgtccggggtataccacgtcacaaacgactgctccaactcaagcattgtgtatgaggcagcggacatgatcatgcatacccccgggtgcgtgccctgcgttcgggaggataatacctcccgttgctgggtagcgcttgctcccacgctagcggccaggaacgccagtgtccccactacgacaatacgacgccatgtcgacttgctcgttggggcggctgctttctgctccgctatgtatgtgggagatctctgcggatctgtttttctagtctcccagctgttcaccttctcgcctcgccggcatgagacagtacaggactgcaattgctcaatctatcccggccacgtgtcaggccatcgcatggcttgggatatgatgatgaactggtcgcctacgacagccctagtagtgtcgcagttactccggatcccacaagctgtcgtggatatggtggcgggggcccactggggagtcctagcgggccttgcctactattccatggtggggaactgggctaaggtattgattgtgatgctactctttgccggcgttgatgggcacacccacacgacaggggggacggcggcccgcgagacctccaggtttacgtccatgttttcatttgggtcgtctcagaagatccaacttataaacaccaatggcagctggcacattaacaggactgccctgaactgcaatgacaccctccaaactgggtttctcgccgcgctgttctacacacacaagttcaacgcgaccggatgtccagagcgcttggccagctgccgctccattgacaagttcgatcaggggtggggtcccatcacttatgctgaggggggtggccaggaccagaggccttattgctggcactacgcacctaaaccgtgtggtatcgtacccgcgtcgcaggtgtgcggtccagtgtattgtttcaccccaagcccagttgtagtggggacgaccgatcgtttcggtgtccctacgtatagctggggggcgaatgagacagacgtgctgctgcttaataacacgcggccgccgcaaggcaactggttcggctgtacatggatgaatggcacggggttcaccaagacgtgcgggggccccccctgtaaaatcgggggggtcggcaataacaccttgacctgcccttcggattgcttccggaagcaccccgaggctacttacacaaaatgtggctcggggccttggttgacacccaggtgcttagttgactacccatacaggctctggcactacccctgcactgtcaactttaccatcttcaaggttaggatgtatgtagggggcatggagcacaggctcaatgctgcatgcaattggacacgaggagaacgttgtgacttggaggacagggataggtcggagcttagcccgctgctgctgtctacaacagagtggcagatactgccctgttccttcaccaccctaccggccctgtccactggtctaattcatctccatcagaacatcgtggacgtgcagtacctgtatggtatagggtcggcggtcgtctcctttgtaatcaaatgggagtatgtcgtgttgctcttcctcctcctggcggacgcgcgcatctgcgcctgcctgtggatgatgctgctgatagcccaagccgaagccgccctggagaacctggtggtcctcaatgcggcgtccgtggccggagcgcatggcattctctccttccttgtgttcttctgtgccgcctggtacatcaagggcaggctggtccctggggcggcatatgctctctatggcgtatggccgctgctcctgctcctgctggcgttaccaccacgagcttacgccatagagcgggagatggctgcatcgtgcggaggcggggtctttctaggtctggcactcttgaccttgtcaccatactataaggtgttcctcgctaggctcatatggtggttacagtattttaccaccagagccgaggcgcacttgcaagtgtggatcccccccctcagcgtccgaggaggccgtgatgccatcatcctcctcgtgtgtgcggtccacccagagctaatctttgacatcaccaaacttctgctcaccatactcggtccgctcatggtgctccaggccagcatagctcgagtgccgtacttcgtacgcgctcaagggctcattcgtgtgtgcatgttggtgcggaaagcagctggcggtcattatgcccaaatggccttcatgaaactggccgcactgacaggtacgtacgtttatgaccatcttactccgctgcgggattgggcccacgcgggcctgcgagacctcgcggtggcagtagagcccgtcgttttctctgacatggagaccaagatcatcacctggggagcagacaccgcggcgtgtggggacatcatcctgggtctacctgtctccgcccgaaggggaaaggagatatttctgggaccggccgacggtcttgaggggcaggggtggcgactccttgctcccatcacggcctactcccaacagacgcggggtctacttggctgcatcatcactagcctcacaggccgggacaagaaccaagtcgagggggaggttcaagtggtgtccaccgcaacacaatctttcctggcgacctgcgtcaacggtgtgtgttggactgtctatcatggcgccggctcaaagaccttagccggcccaaaaggtccaatcacccaaatgtacactaatgtagacctggacctcgtcggctggcaggcgccccccggggcgcgctctctgacaccgtgcacctgcggcagctcggacctttacttggtcacgagacacgctgatgtcattccggtgcgccggcggggcgacagtagggggagcctgctctctcccaggcctgtctcctacttgaaaggctcttcgggtggtccactgctctgcccctcggggcacgctgtgggcatcttccgggctgctgtgtgcacccggggggttgcgaaggcggtggacttcatacccgttgagtctatggaaaccactatgcggtctccggtcttcacagataactcatctcccccggccgtaccgcagacattccaagtggcccatctacacgctcccactggcagcggcaagagcactaaagtgccggctgcatatgcagcccaagggtataaggtgctcgtcctgaacccgtccgttgccgccaccttgagttttggggcgtatatgtctaaagcacatggtaccgaccccaacatcagaactggggcaaggaccatcaccacgggcgcccctatcacatactccacctatggcaagttccttgccgacggtggttgctctgggggcgcctatgacatcataatatgtgatgagtgccattcaactgactcaactaccattttgggcattggcacagtcctggaccaagcggagacggctggagcgcggctcgtcgtgctcgccaccgctacgcctccgggatcgatcaccgtgccacaccccaatatcgaggaggtggccctatccaacactggagagatccccttctacggcagggccatcccccttgaggtcatcaaggagggaagacatctcattttctgccattccaagaagaagtgtgatgagctcgccgcaaagctgtcagcccttggactcaacgctgtagcgtattatcggggccttgatgtgtctgtcataccgaccagcggaaacgttgttgtcgtggcgacagatgctctaatgacgggctataccggcgactttgactcagtgatcgactgtaacacatgtgtcacccagacagtcgacttcagcttggaccccaccttcaccattgagacgacaaccgtgccccaagacgcagtgtcgcgctcgcagcggcgaggcagaactggcaggggtaggagaggcatctataggtttgtgactccaggagaacgcccctcgggcatgttcgattcctcggtcctgtgtgagtgttatgacgcgggttgtgcttggtatgagctcacgcctgctgagacttcagtcaggttgcgggcttacctgaatacaccagggttgcccgtctgtcaggaccatctggagttctgggagagcgtcttcacaggcctcacccacatagatgcccactttctgtcccagaccaagcaggcaggagacaacttcccctacctggtagcataccaagccacagtgtgcgccagggctcaagctccacctccatcatgggatcaaatgtggaaatgtctcatacggctcaaacctacactgcacggaccaacacccctgctgtataggctaggagccgttcagaatgatgtcaccctcacacaccccataaccaagctcatcatggcatgcatgtcggcagacctggaggtcgttactagcacctgggtgttggtaggcggagtccttgcagctctggccgcatattgcttgacaacaggcagcgtggtcattgtgggcaggctcatcctgtccggaaggccggctgtcattcccgacagggaagttctctaccgggagttcgatgaaatggaagagtgcgcctcacacctcccttacatcgagcagggaatgcagctcgccgagcagttcaaacagaaggcgctcgggttgttgcaaacagccaccaagcaggcggaggctgctgttcccgtggtggaatccaagtggcgagcccttgagactttttgggcgaaacacatgtggaatttcatcagcgggatacagtacttagcaggcttatccactctgcccgggaatcctgcaatagcatcattgatggcattcacagcctctatcaccagcccgctcaccacccaaaataccctcctatttaacatcttggggggatgggtggctgcccaactcgccccccccagcgctgcttcggcttttgtgggcgccggcattaccggtgcggctgttggcagcataggccttgggaaggtgcttgtggacatcctggcgggatatggggcgggggtggctggcgcactcgtagcctttaagatcatgagcggcgagatgccctccaccgaggacctggttaatttactccctgccatcctctctcccggcgccctggtcgtcggggtcgtgtgtgcagcaatactgcgtcggcacgtgggcccgggagagggagctgtgcagtggatgaaccggctgatagcgttcgcttcacggggtaaccatgtttcccccacgcactatgtgcctgagagcgacgctgcagtgcgtgttactcagatcctctccagccttaccatcactcagctgctgaagaggcttcaccagtggattaatgaggactgctccacgccatgctccggttcgtggctgagggaagtttgggactggatatgcacggtgttgaccgacttcaagacctggctccagtccaagctcctgccgcgattgccgggagtccctttcttctcatgccaacgcgggtacaagggagtctggcggggggacggcatcatgcacaccacctgcccatgtggagcacagatcactggacatgtcaaaaacggttccatgaggatcgttgggcctaaaacctgcagcaacacgtggcatggaacattccccatcaacgcatacaccacgggcccctgcacaccctccccggcgccaaactattccagggcgctgtggcgggtggctgctgaggagtacgtggaggttacgcgggtgggggatttccactacgtgacgggcatgaccactgacaacttaaagtgtccatgccaggttccggcccccgaattcttcacggaggtggatggagtgcggttgcacaggtacgctccggcgtgcaaacctctcctacgggatgaggtcacattccaggtcgggctcaaccaatacctggtcgggtcacagctcccatgtgagcccgaaccggatgtagcggtgctcacttccatgctcaccgacccctcccacattacagcagagacggcaaggcgtaggctggccagggggtctcccccctccttggccagctcttcagctagccagttgtctgcgccttccttgaaggcgacttgcactacccatcatgactccccggacgttgacctcatcgaggccaacctcctgtggcaccaggagatgggcgggaacatcacccgcgtggagtcagagaataaggtagtaattctggactctttcgatccgcttcgagcggaggaggacgagagggaaccatccgttgcggcggagatcctgcggaaatccaggaagttccccccagcgatgcccatatgggcacgcccggattataaccctccattgctagagccctggaaggacccggactacgtccctccggtggtgcacgggtgcccattaccacctattaaggcccctccagtgccacccccgcggagaaagaggacggttgtcctgacagagtccactgtgtcttctgccttggcggagcttgccactaagaccttcggcagccccggatcgtcggcgcccgacagcggcacggcgaccgctcctcccgaccaggcccctgacgacggcgacaaagaatccgacgttgagtcgtactcctccatgccccctcttgagggagagccgggggaccccgatctcagtgacgggtcttggtctaccgtgagcgaggaggccggcgaggacgtcgtctgctgttcgatgtcctacacatggacaggcgccctgatcacgccgtgcgctgcggaggaaagcaagctgcccatcaacccgttgagcaactctctgttgcgtcaccataatatggtctatgccacaacatcccgcagtgcaggcctacggcagaagaaggtcacctttgacagactgcaagtcctggacgaccactaccgggacgtgcttaaggagatgaaggcgaaggcgtccacagttaaggctaaactcctatctatagaagaagcctgcaagctgacgcccccacattcggccaaatccaaatttggctatggggcaaaggacgtccggaacctatccaacaaggccattaaccacatccgctccgtgtggaaggacttgctggaagacaatgagacaccaattgacaccaccatcatggcaaaaagtgaggttttctgtgtccaaccagagaagggaggccgcaagccagctcgccttatcgtattcccagatttgggggttcgtgtatgcgagaagatggccctttacgacgtggtctccacccttcctcaggccgtgatgggctcctcatatggatttcagtactcccctgggcagcgggtcgagttcctagtgaatgcttggaaatcaaagaaatgccctatgggcttttcatatgacacccgctgttttgactcaacggtcactgagagtgacatccgtgttgaggagtcaatctaccaatgttgtgacttggcccccgaagccagacaggccataaagtcgctcacagagcggctctacatcgggggtcccctgaccaattcaaaagggcagaactgcggttatcgccggtgccgcgcgagcggcgtgctgacgactagctgtggtaatacccttacatgttacttgaaggcctctgcagcctgtcgagctgcgaagctccaggactgcacgatgctcgtgaacggagacgaccttgtcgtgatctgtgagagcgcggggacccaagaggatgaggcgaacctacgagtcttcacggaggctatgactaggtactctgccccccctggggatccgccccgaccagaatacgacttggagctgataacatcatgttcctccaacgtgtcggtcgcgcacgatgcatctggcaaaagggtgtactacctcacccgtgaccccaccaccccccttgcacgggctgcgtgggaaacagctaggcacactccagtcaactcctggctaggcaacatcatcatgtatgcacccaccttgtgggcgaggatgattctgatgactcacttcttctccatccttctagcccaggagcaacttgaaaaaaccctggattgtcagatctacggggcctgttactccattgagccacttgacctacctcagatcattgaacgactccatggtcttagcgcattttcactccacagttactctccaggtgagatcaatagggtggcttcatgcctcaggaaacttggggtaccacccttgcgagtctggagacatcgggccagaagtgtccgcgctaagctactgtcccaaggggggagggccgccacttgtggcaagtacctcttcaactgggcggtaaggaccaagctcaaactcactccaatcccagccgcgtcccggttggacttgtccagctggttcgtcgctggctacagcgggggagacatttatcacagcctgtctcgtgcccgaccccgttggtttatgttgtgcctactcctactttctgtaggggtaggcatctacctgctccccaaccgatgaacggggagctaaccact

SEQ ID NO: 667 - DNA, 9379 bp, Hepatitis C Virus
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggatgaccgggtcctttcttggatcaacccgctcaatgcctggagatttgggcgtgcccccgcgagactgctagccgagtagtgttgggtcgcgaaaggccttgtggtactgcctgatagggtgcttgcgagagccccgggaggtctcgtagaccgtgcatcatgagcacaaatcctaaaccccaaagaaaaaccaaacgtaacaccaaccgtcgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacagcctatccccaaggctcgccaacccgagggcaggacctgggctcagcccgggtacccttggcccctctatggcaacgagggcatggggtgggcaggatggctcctgtctccccgtggctcccggcctagttggggcccctcagacccccggcgtaggtcgcgtaatttgggtaaggtcatcgacaccctcacatgcggcttcgccgacctcttggggtacattccgcttgtcggcgcccccatagggggcgttgccagggccctggcacatggtgtccgggttctggaggacggcgtgaactatgcaacagggaatctgcccggttgctctttctctatcttcctcttagctctgctgtcctgtttgaccaccccagcttccgcttatgaagtgcgcaacgtgtccggggtataccatgtcacgaacgactgctccaactcaagcattgtgtatgaggcagcggacatgatcatgcatacccccgggtgcgtgccctgcgttcgggaggataatacctcccgttgctgggtagcgcttgctcccacgctagcggccaggaacgccagtgtccccactacgacaatacgacgccatgtcgacttgctcgttggggcggctgctttctgctccgctatgtatgtgggagatctctgcggatctgtttttctagtctcccagctgttcaccttctcacctcgccggcatgagacagtacaggactgcaattgctcaatctatcccggccacgtgtcaggccatcgcatggcttgggatatgatgatgaactggtcgcctacaacagccctagtagtgtcgcagttactccggatcccacaagctgtcgtggatatggtggcgggggcccactggggagtcctagcgggccttgcctactattccatggtggggaactgggctaaggtattgattgtgatgctactttttgctggcgttgatggccacacccacacgtcaggggggacggcagcccgcgagaccttcaggtttacgtccctgttttcagttgggtcctctcagaagatccaacttataaacaccaatggcagctggcacattaacaggactgccctgaactgcaatgacaccctccaaactgggtttctcgccgcgctgttctacacacacaagttcaacgcgaccggatgtccagagcgcttggccagctgccgctccattgacaagttcgatcaggggtggggtcccatcacttatgctgagaggggtggccaggaccagaggccttattgctggcactacgcacctaaaccgtgtggtatcgtacccgcgtcgcaggtgtgtggtccagtgtattgtttcaccccaagcccagttgtggtggggacgaccgatcgtttcggtgtccctacgtatagctggggggagaatgagacagacgtgctgctgcttaataacacgcggccgccgcaaggcaactggttcggctgtacatggatgaatggcactgggttcaccaagacgtgcgggggccccccgtgtaaaatcgggggggtcggcaataacaccttgacctgcccttcggattgcttccggaagcaccccgaggctacttacacaaaatgtggctcggggccttggttgacacccaggtgcttagttgactacccatacaggctctggcactacccctgcactgtcaactttaccatcttcaaggttaggatgtatgtagggggcatggagcacaggctcaatgctgcatgcaattggacacgaggagaacgttgtgacttggaggacagggatagatcggagcttagcccgctgctgctgtctacaacagagtggcagatactgccctgttccttcaccaccctaccggccctgtccactggtttaatccatctccatcagaacatcgtggacgtgcagtacctgtatggtatagggtcggcggtcgtctcctttgtaatcaaatgggagtatgtcgtgttgcttttcctcctcctggcggacgcgcgcatctgcgcctgcttgtggatgatgctgctgatagcccaggccgaggccgccttggagaacctggtggtcctcaatgcggcatccgtggccggagcgcatggcattctctccttccttgtgttcttctgtgccgcctggtacatcaagggcaggctggtccctggggcggcatatgctctctatggcgtatggccgctgctcctgctcctgctggcgttaccatcacgagcttacgccatagagcgggagatggctgcatcgtgcggaggcggggtctttctaggtctggcactcttgaccttgtcaccatactataaggtgttcctcgctaggctcatatggtggttacagtattttaccaccagagccgaggcgcacttgcaagtgtggatcccccccctcagcgtccgaggaggccgtgatgccatcatcctcctcgtgtgtgcggtccacccagagctaatctttgacatcaccaaactcctgctcaccatactcggtccgctcatggtgctccaggccagcatagctcgagtgccgtacttcgtacgcgctcaagggctcattcgtgtgtgcatgttggtgcggaaagcagctggcggtcattatgcccaaatggccttcatgaaagtggccgcactgacaggtacgtacgtgtatgaccatcttactccactgcgggattgggcccacgcgggcctgcgagacctcgcggtggcagtagagcccgtcatcttctctgagatggagaccaagatcatcacctggggagcagacaccgcggcgtgtggggacatcatcttgggtctacctgtctccgcccgaaggggaaaggagatatttctgggaccggccgatggtattgaagggcaggggtggcgactccttgctcccatcacggcctacgcccaacagacgcggggtcttcttggttgcatcatcacaagcctcacaggccgggacaagaaccaagtcgagggggaggttcaagtggtttccaccgcaacacaatctttcctggcgacctgcgtcaacggtgtgtgttggaccgtcttccatggcgccggctcaaagactctagccggcccaaaaggtccaatcacccaaatgtacaccaatgtggacctggacctcgtcggctggcaggcgccccccggggcgcgttctctgacaccatgcacctgtggcagctcggacctttacttggtcacgagacacgctgatgtcatcccggtgcgccggcggggcgacagtagggggagcctgctctctcccaggcctgtctcctacttgaagggctcttcgggtggtccactgctctgcccctcggggcacgctgtgggcatcttccgggctgctgtatgcacccggggggttgcgaaggcggtggacttcatacccgttgagtctatggaaaccactatgcggtctccggtcttcacagataactcatctcccccggccgtaccgcagacattccaagtggcccatctacacgctcccactggcagcggcaagagcactaaagtgccggctgcatatgcagcccaagggtataaggtgctcgtcctgaacccgtccgttgccgccaccttgagttttggggcgtatatgtctaaagcacatggtaccgaccccaacatcagaactggggcaaggaccatcaccacgggcgcccctatcacatactccacctatggcaagttccttgccgacggtggttgctctgggggcgcctatgacatcataatatgtgatgagtgccattcaactgactcaactaccattttgggcattggcacagtcctggaccaagcggagacggctggagcgcggctcgtcgtgctcgccaccgctacgcctccgggatcggtcaccgtgccacaccccaatatcgaggaggtggccctgtccaacactggagagatccccttctacggcagggccatcccccttgaggtcatcaaggagggaagacatctcattttctgtcattccaagaagaagtgtgacgagctcgccgcaaagctgtcagcccttggactcaacgctgtagcgtattatcggggccttgatgtgtctgtcataccgaccagtggaaacgttgttgtcgtggcgacagacgctctaatgacgggctataccggcgactttgactcagtgatcgactgtaacacatgtgtcacccagacagtcgactttagcttggacccaaccttcaccattgagacgacgaccgtgccccaagacgcagtgtcgcgctcgcagcggcgaggcagaactggcaggggtaggagaggcatctataggtttgtgaccccaggagaacggccctcgggcatgttcgattcttcggtcctgtgtgaatgttatgacgcgggctgtgcttggtacgagctcacgcctgctgagacttcagttaggttgcgggcttacctgaatacaccagggttgcccgtctgccaggaccatctggagttctgggagagcgtcttcacaggcctcacccacatagatgcccactttctgtcccagactaaacaggcaggagacaacttcccttacctggtagcataccaagccacagtgtgcgccagggctcaagccccacctccatcatgggatcaaatgtggaaatgtctcatacggctcaaacctacgctgcacggaccaacacccctgctgtataggctaggagccgtccaaaatgatgtcaccctcacacaccccataaccaagctcatcatggcatgcatgtcggcagacctggaggtcgttactagcacctgggtgttggtaggcggagtccttgcagctctggccgcatattgcttgacaacaggcagcgtggtcattgtgggcaggctcatcctgtccggaaggccggctgtcattcccgacagggaagttctctaccgggagttcgatgaaatggaagagtgcgcctcacacctcccttacatcgagcagggaatgcaactcgccgagcagttcaaacagaaggcgctcgggttgttgcaaacagccaccaagcaagcggaggctgctgttcccgtggtggaatccaagtggcgagcccttgagactttctgggcgaaacacatgtggaatttcatcagcgggatacagtacttagcaggcttatccactctgcccgggaatcccgcaatagcatcattgatggcattcacagcctctatcaccagcccgctcaccacccaaaataccctcctatttaacatcttggggggatgggtggctgcccaactcgccccccccagcgctgcttcagcttttgtgggcgccggcattgctggtgcggctgttggcagcataggccttgggaaggtgcttgtggacatcctggcgggatatggggcaggggtggctggcgcactcgtagcctttaagatcatgagcggcgagatgccctccaccgaggacctggtcaatttactccctgccatcctctctcccggcgccctggtcgtcggggtcgtgtgtgcagcaatactgcgacggcacgtgggcccgggagagggagctgtgcagtggatgaaccggctgatagcgttcgcttcacggggtaaccatgtctcccccacgcactatgtgcctgagagcgacgctgcagcgcgtgttactcagatcctctccagccttaccatcactcagctgctgaagaggcttcaccagtggattaatgaggactgctccacgccatgctccggctcgtggctaagggatgtttgggactggatatgcacggtgttgaccgacttcaagacctggctccagtccaagctcctgccgcgattgccgggagtccctttcttctcatgccaacgcgggtacaagggagtctggcggggagacggcatcatgcacaccacctgcccgtgtggagcacagatcaccggacatgtcaaaaacggttccatgaggatcgttgggcctaaaacctgcagcaacacgtggcatggaacattccccatcaacgcatacaccacgggcccctgcacacccaccccggcgccaaactattccagggcgctgtggcgggtggctgctgaggagtacgtggaggttgcgcgggtgggggatttccactacgtgataggcatgaccactgacaacataaaatgtccatgccaggttccggcccccgaattcttcacggaggtggatggagtgcggttacacaggtacgctccggcgtgcaaacctctcctacgggatgaggtcacattccaggtcgggctcaaccagtacctggtcgggtcacagctcccatgcgagcccgaaccggatgtagcggtgctcacctccatgctcaccgacccctcccacattacagcagagacggcaaggcgtaggctggccagggggtctccgccctccttggccagctcttcagctagccagttgtctgcgccttccttgaaggcgacctgccctaccaatcatgactccccgggcgttgacctcatcgaggccaacctcctgtggcaccaggagatgggcgggaacatcacccgcgtggagtcagagaacaaggtagtaatcctggactctttcgacccgcttcgagtggaggaggatgagagggaaccatccgtcgcggcggagatcctgcggaaatccaggaagttccccccagcgatgcccatatgggcacgcccggattacaaccctccattgctggagccctggaaggacccgggctacgtccctccggtggtgcacgggtgcccattaccacctattaaggcccctccagtgccacccccgcggagaaagaggacggttgtcctgacagagtccactgtgtcctctgccttggcggagcttgccactaagaccttcggcagctccggatcgtcggcgcccgacagcggcacggcgaccgctcctcccgaccaggcccctgacgacggcgacaaagaatccgacgttgagtcgtactcctccatgccccctcttgagggagagccgggggaccccgatctcagtgacgggtcttggtctaccgtgagcgaggaggccggtgaggacgtcgtctgctgttcgatgtcctacacatggacaggcgccctgatcacgccgtgcgctgcggaggaaagcaagttgcccatcaacccgctgagcaactctctgctgcgtcaccataatatggtctatgccacaacatcccgcagtgcaggcctacggcagaagaaggtcacctttgacagactgcaagtcctggacgaccactaccgggacgtgcttaaggagatgaaggcgaaggcgtccacagttaaggctaaactcctatctatagaagaagcctgcaagctgacgcccccacattcggccaaatccaaatttggctatggggcaaaggacgtccggaacctatccaacaaggccattaaccacatccgctccgtgtggaaggacttgctggaagacaatgagacaccaattgacaccaccatcatggcaaaaagtgaggttttctgtgtccaaccagagaagggaggccgcaagccagctcgccttatcgtattcccagatttgggggtccgtgtatgcgagaagatggccctttacgacgtggtctccacccttcctcaggccgtgatgggctcctcatacggatttcagtactcccctgggcagcgggtcgagttcctagtgaatgcttggaaatcaaagaaatgccctatgggcttttcatatgacacccgctgttttgactcaacggtcactgagagtgacatccgtgttgaggagtcaatctaccagtgttgtgacttggcccccgaagccagacaggccataaagtcgctcacagagcggctctatatcgggggtcccctgaccaattcaaaagggcagaactgcggttatcgccggtgccgcgcgagcggcgtgctgacgactagctgcggtaatacccttacatgttacttgaaggcctctgcagcctgtcgagctgcaaagctccaggactgcacgatgctcgtgaacggagacgaccttgtcgttatctgtgagagcgcgggaacccaagaggacgaggcgagcctacgagtcttcacggaggctatgactaggtactctgccccccccggggacccgccccgaccagaatacgacttggagctgataacatcatgttcctccaacgtgtcggtcgcgcacgatgcatctggcaaaagggtgtactacctcacccgtgaccccaccaccccccttgcacgggctgcgtgggagacagctaggcacactccagtcaactcctggctaggcaacatcatcatgtatgcacccaccttgtgggcgaggatgattctgatgactcacttcttctccatccttctagcccaggagcaacttgaaaaaaccctggattgtcagatctacggggcctgttactccattgagccacttgacctacctcagatcattgaacgactccatggtcttagcgcattttcactccacagttactctccaggtgagatcaatagggtggcttcatgcctcaggaaacttggggtaccacccttgcgagtctggagacatcgggccagaagtgtccgcgctaagctactgtcccaaggggggagggccgccacttgtggcaagtacctcttcaactgggcggtaaggaccaagctcaaactcactccaatcccagccgcgtcccggttggacttgtccagctggttcgtcgctggctacagcgggggagacatttatcacagcctgtctcgtgcccgaccccgttggtttatgttgtgcctactcctactttctgtaggggtaggcatctacctgctccccaaccgatgaacggggagctaaccact

SEQ ID NO: 668 - DNA, 9379 bp, Hepatitis C Virus
ttgggggcgacactccaccatagatcactcccctgtgaggaactactgtcttcacgcagaaagcgtctagccatggcgttagtatgagtgtcgtgcagcctccaggtccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacaaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggcagggcctgggctcagcccgggtacccctggcccctctatggcaatgagggtctggggtgggcaggatggctcctgtcaccccgcggctctcggcctagttggggccccacagacccccggcgcaggtcgcgtaatttgggtaaggtcatcgataccctcacatgcggcttcgccgacctcatggggtacattccgctcgtcggcgcccccctaggaggcgctgccagggccctggcgcatggcgtccgggttctggaagacggcgtgaactatgcaacagggaatcttcccggttgctctttctctatcttcctcttggctttgctgtcctgcttgaccaccccagtctccgctcatgaagtgcgcaacgtgtccgggctgtaccttgtcacgaacgactgctccaactcgagtatcgtgtatgaggcagcggacgtgatcatgcacacccccgggtgcgtgccctgcgtgcgggagggtaattcctcccgctgctgggtagcgctcactcccacgctcgcggccaggaacagcagcatccccaccacgacaatacggcgccacgtcgatttgctcgttggggcagctgcattctgctccgccatgtacgtgggggatctttgcgggtctgtcttcctcatctcccagctgttcaccttctcgcctcgccggtataacacggtacaagactgcaattgctcgctatatcccggccacgtatcaggccaccgcatggcttgggatatgatgatgaactggtcgcctacaacagccctagtggtatcgcagttactccggatcccacaagccgtcgtggatatggtgacaggggcccactggggagtcctggcgggccttgcctactattccatggcggggaactgggctaaggtcttgattgtgatgctactctttgccggcgttgacggggctacctatgtgacaggagggcaagcagctcgaaccacccagggccttacaagccttttctcaccaggggcatctcagaacatccaacttgtaaacaccaacggcagctggcacattaacaggactgccctgaattgcaacgactccctcaacaccgggttccttgccgcgctgttctacacacacaggttcaactcgtccggatgcccagagcgcatggccagctgccgccccattgacaagttcgctcaggggtggggtcccatcactcatgtcgtgcctaacatctcggaccagaggccttactgctggcactacgcgcctcgaccatgtggtattatacccgcgtcgcaggtgtgtggtccagtgtattgcttcaccccaagccccgttgtggtggggacgaccgatcgtttcggcgtccccacgtataactggggggagaatgagacggacatactacttctcaacaacacgcggccgccgcaaggcaactggttcggctgtacatggatgaatgccaccgggttcaccaagacgtgcgggggccccccgtgtaacatcggggggggcgacaacaacaccttgatctgccccacggattgcttccgaaagcatcccgaagccacttacacaaaatgtggctcggggccctggttgacacctaggtgtctagttgactacccgtacagactttggcactacccctgcactgtcaacttcaccatcttcaaggtcaggatgtatgtggggggcgtggagcacaggctcaacgccgcgtgcaattggacccgaggagagcgttgtgacttggaggacagggatagatcagagcttagcccgctgttactgtctacgacagagtggcaggtactaccctgttcctttaccaccctaccggctctgtctactggtttgatccacctccatcagaacatcgtggacgtgcaatacctgtacggtgtagggtcggcagttgtctccgttgcaatcagatgggagtatgtcgtgctgcttttccttctcctggcggacgcgcgtgtctgcgcctgcttatggatgatgttgctcatagcccaagctgaggccgccttagagaacttggtgatcctcaatgcggcgtccgtggctggagcgcatggcattctctccttccttgtgttcttctgcgctgcctggtacatcaagggcaagctgatccctggagcagcatatgctctctatggcgtatggccgctgctcctgctcctgctggcgttaccaccacgagcatacgccatggaccgggaggtgactgcatcgtgcggaggcgcggttcttataggtttggcactcttgaccttgtcaccacactataaagtgatcctcgctagactcatatggtggttacaatatcttatcaccagggccgaggcgcacttgcaagtatgggtcccccctctcaatgtccgggggggccgcgatgccatcatcctcctcacatgcgcggttcacccagggctgatttttgaaatcaccaagatcttgctcgccatatttggaccgctcacggtgctccaggccggcctaattagagtgccgtacttcgtgcgcgctcaagggcttatccgtgcgtgcatgctggtgcggaaggtcgctgggggtcagtatttccaaatggtcctcgtgaagctgggcgcactgacgggtacgtacgtttatgaccatcttactccgctacgggactgggcccacgccggcctgcgagaccttgcggtggcagttgaacccgtcgtcttttcggacatggagaccaagatcatcacctggggggcagacaccgcagcatgcggggacatcatctcgggtctacccgtctctgcccgaaggggaagggagatactcctgggcccagccgacagttttggagagcagggatggcgactccttgcgcccatcacggcctactcccaacagacgcgaggcctacttggctgcatcatcaccagcctcacaggtcgggacaggaaccaggtcgagggggaggttcaggtggtttccaccgcaacgcaatctttcctggcgacctgcgtcaatggcgtgtgttggactgtctaccatggcgccggctcaaagaccttagccgggccaaagggtccaatcacccaaatgtataccaatgtagaccaggacctcgtcggctggcaggcgccccccggggcacgctccatgacaccatgcacttgcggcagctcggacctttacttggtcacgaggcatgccgatgtcattccggtgcgccggcggggcgacagcaggggcagcctactttcccctaggcccatctcttacttgaagggctcctcgggtggtccactgctctgccccctggggcacgttgtgggcatcttccgggctgccgtgtgcacccggggggtcgcgaaggcggtggacttcatacccgttgagtctatggaaacatctatgcggtccccggtctttacggacaactcatctcccccagccgtaccgcagacattccaagtggcccatctacacgctcctactggcagcggcaagagcaccaaggtgccggctgcgtatgcggcccaagggtacaaggtactcgtcctgaacccgtctgttgccgccaccttaggttttggggcgtatatgtctaaagcacatggtgttgatcctaacatcagaactggagtgaggaccatcaccacgggcgctcccatcacttactccacctatggcaagttccttgccgacggtggttgctctgggggcgcctatgacatcataatatgcgatgagtgccactcaactgactcgacctccatcttaggcatcggcacagtcctggaccaagcggagacggctggagcgcggctcgtcgtgctcgccaccgctacgcctccgggatcagttaccgtgccacatcccaatatcgaagaggcggccctgtccaacaccggagagattcccttctatggtaaagccatccccctcgaggtcatcaagggggggaggcatcttattttctgccactccaagaagaaatgtgacgagctcgcttcaaagctgtcggccctcggggttaatgctgtagcatactaccggggtcttgatgtgtccgtcataccaacaagcggagacgtcgttgtcgtggcaacggacgctctgatgacgggctataccggcgactttgactcagtgatcgactgcaacacatgtgtcacccagacagtcgacttcagcttggaccctaccttcaccattgagacgacaacagtgccccaagacgcagtgtcgcgctcgcagcggcgaggcaggactggtaggggtagaatgggcatatacaggtttgtgactccaggggaacggccctcgggcatgttcgattcttcggtcctgtgtgagtgctatgacgcgggctgtgcttggtacgagctcacgcctgccgagaccacggttaggttgcgggcttacctgaatacaccggggttgcccgtctgtcaggaccacctggagttctgggagggcgttttcacaggcctcacccacatagatgcccactttctgtcccagactaagcaggcaggggacaatttcccctacttggtagcataccaggctacggtgtgcgccagggcccaggctccacccccatcatgggatcagatgtggaagtgcctcatacggcttaagcctgtgctgcatgggccaacacccctgttgtacaggctaggggccgtccaaaacgagatcaccctcacgcaccccataaccaaattcatcatgacatgcatgtcagctgacctagaggtcgtcacgagcacttgggtactagtagggggggttcttgcagctctggccgcgtactgtttgacaacgggcagcgtggtcattgtgggcaggatcatcttgtccgggaggcctgccattattcccgacagggaagttctctaccgggaattcgatgaaatggaggagtgcgcctcacaccttccttacatcgaacagggaatgcagcttgccgagcagttcaaacagaaggcgctcgggttgctgcaaacagccaccaagcaagcggaggctgccgcccccgtggtggagtccaagtggcaagcccttgaggccttctgggcaaagcacatgtggaatttcatcagcgggatacagtacctagcaggcttgtccactctgcccgggaaccccgcgatagcatcactgatggcattcacagcctccgtcaccagcccgctcaccacccaatacaccctcctttttaacatcttggggggatgggtggccgctcaaatcgccccccccagcgcttcttcagccttcgtaggcgccggcattgctggcgcggctgttggcagcataggccttgggaaggtgcttgtggacattctggcgggttacggagcaggggtggcaggcgcactcgtggctttcaaggtcatgagtggcgaggtaccctccaccgaggacctggtcaacttactccctgccatcctctctcccggtgccctggtcgtcggggtcgtgtgcgcagcaatactgcgtcgacatgtgggcccgggggagggggctgtgcagtggatgaaccggctgatagcgttcgcttcgaggggtaaccacgtctcccccacgcattatgtgcctgaaagcgacgccgcagcccgtgtcacccagatcctctccaatcttaccatcactcagctgttgaagaggctccaccagtggatcaatgaggactgctccacgccgtgctccggctcgtggcttagggatgtttgggactggatatgcacggtgttggccgacttcaagacctggctccagtccaagctcctgccgcggttaccgggagtccccttcctctcatgccaacgtgggtacaagggggcctggcggggagatggtatcatgtataccacctgcccatgtggggcacaaatcaccggacatgtaaaaaacggttccatgaggatcgttgggcctagaacctgcagcaacatgtggcatggaacgttccccatcaacgcgtacaccacgggcccttgcacaccctccccggcgccgaactactccagggcgctgtggcgggtggctgctgaggagtacgtagaggtcacgcgggtgggggatttccactacgtgacgggcgtgaccactgacaacataaaatgcccatgccaggttccggcccctgaattcttcacagaattggatggggtacggttgcacaggtacgctccggcgtgcaggcctctcctacgggaggaggtcacattccaggtcgggcttaaccagtacatagttgggtcgcaactcccgtgtgagcccgaaccggatgtagcagtgcttacttccatgctcaccgacccctcccacattacagcagagacagctaagcgcaggctggccagggggtctcctccctccttggctagctcttcagctagtcagttgtctgcgccttccttgaaagcgacgtgcactacccgtcatgactccccagacgctgacctcatcgaggccaacctcctgtggcggcaggagatgggcgggaacatcactcgcgtggagtcggagaataaggttgtaatcctggactcttttgaccctctgcgagcggaggaggatgagagggaagtgtccattgcggcggagatcctgcggaaaaccaggagtttccccccggcaattcctgtatgggcacgcccggactataatccaccactactagagtcttggaaagacccggactacgtccccccggtggtgcacgggtgtccattgccacctaccaaggctcccccgataccacctccacggagaaagaggacggttatcctgacagaatccaccgtgtcttccgccttggcggagcttgctacaaagaccttcggcagctccggatcgtcaggcgtcgacagcggcacagcgaccgcccctcctgatcaaccctccgacgacggcgatgcaggatccgatgttgagtcatactcctccatgcccccccttgagggagagccgggggaccccgacctcagcgacgggtcttggtctactgtgagcgaggaggccagcgaggatgtcgtctgctgctcgctgtcctatacatggacaggcgccttaattacaccatgcgccgcggaggagagcaagctgcccatcaatgcgttgagcaactctttgctgcgtaaccacaacatggtctacgcaacgacatcccgcagcgcaagcctgcgccagaagaaggtcacctttgacagacagcaagtcctggacgaccactaccgggacgtgctcaaggagatgaaggcgaaggcgtccacagttaaggctaagcttctatctgtagaagaagcctgcaagctgacgcccccacactcggccagatccaaatttggctatggggcgaaggacgtccggaacctatccagcagggccgttaaccacatccgctccgtgtggaaggacttgctggaagacactgagacaccaattgacaccaccatcatggcaaaaaatgaggtcttctgtgttcaaccagagaaaggaggccgcaagccagctcgccttatcgtattcccagacctgggggttcgtgtgtgcgagaaaatggccctttacgatgtggtctccattcttcctcaggccgtgatgggctcctcatacggattccagtactctcctgggcagcgggtcgagttcctggtgaacgcctggaaatcaaagaagaaccctatggggttcgcatatgacacccgctgttttgactcaacggtcactgagagtgatatccgtactgaggagtcaatttaccaatgttgtgacttggcccccgaggccagacaggtcataaggtcgctcacagagcggctttacatcgggggccccctgactaattcaaaagggcagaactgcggctatcgccggtgtcgcgccagcggcgtgctgacgactagctgcggtaacaccatcacatgttacttgaaggcctctgcagcctgtcgagctgcgaagctccaggactgcacgatgctcgtgtgcggagacgaccttgtcgttatctgtgaaagcgcagggacccaggaggacgcggcgagcctacgagtcttcacggaggctatgactaggtactctgccccccctggggacccgccccaaccagaatacgacttggagttgataacatcatgctcctccaacgtgtcggtagcgcacgatgcatctggcaaacgggtgtactacctcacccgcgaccccaccatcccccttgcgcgggctgcgtgggaaacagctagacacactccagttaactcctggctaggcaacatcatcatgtatgcgcccactttatgggcaaggatgattctgatgacccatttcttctccatcctcctagctcaggagcaacttgaaaaagtcctagattgtcagatctacgggaccacttactccattgaaccacttgatctacctcagatcattcagcgactccatggtcttagcgcattttcactccatagttactctccaggtgagatcaatagggtggcttcatgcctcaggaaacttggggtaccgcccttgcgagtctggagacatcgggccagaagtgtccgcgctaagctgctgtcacagggggggagggctgccacttgtggcaaatacctcttcaactgggcagtaaggaccaagctcaaactcactccaatcccggctgcgtcccagttggacttgtccggctggttcgtcgctggttacagcgggggagacatatatcacagcttgtctcgtgcccgaccccgctggttcatgtggtgcctactcctactctctgtaggggtaggcatctacctgctccccaaccgatgaacggggagctaaccact

SEQ ID NO: 669 - DNA, 9379 bp, Hepatitis C Virus
ttgggggcgacactccaccatagatcactcccctgtgaggaactactgtcttcacgcagaaagcgtctagccatggcgttagtatgagtgtcgtgcagcctccaggtccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacaaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggcagggcctgggctcagcccgggtacccctggcccctctatggcaatgagggtctggggtgggcaggatggctcctgtcaccccgcggctctcggcctagttggggccccacagacccccggcgcaggtcgcgtaatttgggtagggtcatcgataccctcacatgcggcttcgccgacctcatggggtacattccgctcgtcggcgcccccctaggaggcgctgccagggccctggcgcatggcgtccgggttctggaagacggcgtgaactatgcaacagggaatttgcccggttgctctttctctatcttcctcttggctttgctgtcctgcttgaccaccccagtctccgctcatgaagtgcgcaacgtgtccgggctgtaccttgtcacgaacgactgctccaactcgagtatcgtgtatgaggcagcggacgtgatcatgcacacccccgggtgcgtgccctgcgtgcgggagggtaattcctcccgctgctgggtagcgctcactcccacgctcgcggccaggaacagcagcatccccaccacgacaatacggcgccacgtcgatttgctcgttggggcagctgcattctgctccgccatgtacgtgggggatctttgcgggtctgtcttcctcatctcccagctgttcaccttctcgcctcgccggtataacacggtacaagactgcaattgctcgctatatcccggccacgtatcaggccaccgcatggcttgggatatgatgatgaactggtcgcctacaacagccctagtggtatcgcagttactccggatcccacaagccgtcgtggatatggtgacaggggcccactggggagtcctggcgggccttgcctactattccatggcggggaactgggctaaggtcttgattgtgatgctactctttgccggcgttgacggggcttcctatgtgacaggagggcaagcagctcgaaccacccagggccttacaggctttttctcaccaggggcatctcagaaaatccaacttgtaaacaccaacggcagctggcacattaacaggactgccctgaattgcaacgactccctcaacaccgggttccttgccgcgctgttctacacacacaggttcaactcgtccggatgcccagagcgcatggccagctgccgccccattgacaagttcgctcaggggtggggtcccatcactcatgtcgtgcctaacatttcggaccagaggccttactgctggcactacgcgcctcgaccatgtggtattatacccgcgtcgcaggtgtgtggtccagtgtattgcttcaccccaagccccgttgtggtggggacgaccgatcgtttcggcgtccccacgtataactggggggagaatgagacggacatactacttctcaacaacacgcggccgccgcaaggcaactggttcggctgtacatggatgaatgccaccgggttcaccaagacgtgcgggggccccccgtgtaacatcggggggggcgacaacaacaccttgatctgccccacggattgcttccgaaagcatcccgaagccacttacacaaaatgtggctcggggccctggttgacacctaggtgtctagttgactacccgtacagactttggcactacccctgcactgtcaacttcaccatcttcaaggtcaggatgtatgtggggggcgtggagcacaggctcaacgccgcgtgcaattggacccgaggagagcgttgtgacttggaggacagggatagatcagagcttagcccgctgctactgtctacgacagagtggcaggtactaccctgttcctttaccaccctaccggctctgtctactggtttgatccacctccatcagaacatcgtggacgtgcaatacctgtacggtgtagggtcggcagttgtctccgttgcaatcagatgggagtatgtcgtgctgcttttccttctcctggcggacgcgcgtgtctgcgcctgcttatggatgatgttgctcatagcccaagctgaggccgccttagagaacttggtgatcctcaatgcggcgtccgtggctggagcgcatggcattctctccttccttgtgttcttctgcgctgcctggtacatcaagggcaagctgatccctggagcagcatatgctctctatggcgtatggccgctgctcctgctcctgctggcgttaccaccacgagcatacgccatggaccgggaggtgactgcatcgtgcggaggcgcggttcttataggtttggcactcttgaccttgtcaccacactataaagtgatcctcgctagactcatatggtggttacaatatcttatcaccagggccgaggcgcacttgcaagtatgggtcccccctctcaatgtccgggggggccgcgatgccatcatcctcctcacatgcgcggttcacccagggctgatttttgaaatcaccaagatcttgctcgccatatttggaccgctcacggtgctccaggccggcctaattagagtgccgtacttcgtgcgcgctcaagggcttatccgtgcgtgcatgctggtgcggaaggtcgctgggggtcagtatttccaaatggtcctcgtgaagctgggcgcactgacgggtacgtacgtttatgaccatcttactccgctacgggactgggcccacgccggcctgcgagaccttgcggtggcagttgaacccgtcgtcttttcggacatggagaccaagatcatcacctggggggcagacaccgcagcatgcggggacatcatctcgggtctacccgtctctgcccgaaggggaagggagatactcctgggcccagccgacagttttggagagcagggatggcgactccttgcgcccatcacggcctactcccaacagacgcgaggcctacttggctgcatcatcaccagcctcacaggtcgggacaggaaccaggtcgagggggaggttcaggtggtttccaccgcaacgcaatctttcctggcgacctgcgtcaatggcgtgtgttggactgtctaccatggcgccggctcaaagaccttagccgggccaaagggtccaatcacccaaatgtataccaatgtagaccaggacctcgtcggctggcaggcgccccccggggcacgctccatgacaccatgcacttgcggcagctcggacctttacttggtcacgaggcatgccgatgtcattccggtgcgccggcggggcgacagcaggggcagcctactttcccctaggcccatctcttacttgaagggctcctcgggtggtccactgctctgccccctggggcacgttgtgggcatcttccgggctgccgtgtgtacccggggggtcgcgaaggcggtggacttcatacccgttgagtctatggaaacatctatgcggtccccggtctttacggacaactcatctcccccagccgtaccgcagacattccaagtggcccatctacacgctcctactggcagcggcaagagcaccaaggtgccggctgcgtatgcggcccaagggtacaaggtactcgtcctgaacccgtctgttgccgccaccttaggttttggggcgtatatgtctaaagcacatggtgttgatcctaacatcagaactggagtgaggaccatcaccacgggcgctcccatcacttactccacctatggcaagttccttgccgacggtggttgctctgggggcgcctatgacatcataatatgcgatgagtgccactcaactgactcgacctccatcttaggcatcggcacagtcctggaccaagcggagacggctggagcgcggctcgtcgtgctcgccaccgctacgcctccgggatcagttaccgtgccacatcccaatatcgaagaggcggctctgtccaacaccggagagattcccttctatggtaaagccatccccctcgaggtcatcaagggggggaggcatcttattttctgccactccaagaagaaatgtgacgagctcgcttcaaagctgtcggccctcggggttaatgctgtagcatactaccggggtcttgatgtgtccgtcataccaacaagcggagacgtcgttgtcgtggcaacggacgctctgatgacgggctataccggcgactttgactcagtgatcgactgcaacacatgtgtcacccagacagtcgacttcagcttggaccctaccttcaccattgagacgacaacagtgccccaagacgcagtgtcgcgctcgcagcggcgaggcaggactggtaggggtagaatgggcatatacaggtttgtgactccaggggaacggccctcgggcatgttcgattcttcggtcctgtgtgagtgctatgacgcgggctgtgcttggtacgagctcacgcctgccgagaccacggttaggttgcgggcttacctgaatacaccggggttgcccgtctgtcaggaccacctggagttctgggagggcgttttcacaggcctcacccacatagatgcccactttttgtcccagaataagcaggcaggggacaatttcccctacttggtagcataccaggctacggtgtgcgccagggcccaggctccacccccatcatgggatcagatgtggaagtgcctcatacggcttaagcctgtgctgcatgggccaacacccctgttgtacaggctaggggccgtccaaaacgagatcaccctcacacaccccataaccaaattcatcatgacatgcatgtcagctgacctagaggtcgtcacgagcacttgggtactagtagggggggttcttgcagctctggccgcgtactgtttgacaacgggcagcgtggtcattgtgggcaggatcatcttgtccgggaggcctgccattattcccgacagggaagttctctaccgggaattcgatgaaatggaggagtgcgcctcacaccttccttacatcgaacagggaatgcagcttgccgagcagttcaaacagaaggcgctcgggttgctgcaaacagccaccaagcaagcggaggctgccgtccccgtggtggagtccaagtggcaagcccttgaggccttctgggcaaagcacatgtggaatttcatcagcgggatacagtacctagcaggcttgtccactctgcccgggaaccccgcgatagcatcactgatggcattcacagcctccgtcaccagcccgctcaccacccaatacaccctcctttttaacatcttggggggatgggtggccgctcaaatcgccccccccagcgcttcttcagccttcgtaggcgccggcattgctggcgcggctgttggcagcataggccttgggaaggtgcttgtggacattctggcgggttacggagcaggggtggcaggcgcactcgtggctttcaaggtcatgagtggcgaggtaccctccaccgaggacctggtcaacttactccctgccatcctctctcccggtgccctggtcgtcggggtcgtgtgcgcagcaatactgcgtcgacatgtgggcccgggggagggggctgtgcagtggatgaaccggctgatagcgttcgcttcgaggggtaaccacgtctcccccacgcattatgtgcctgaaagcgacgccgcagcccgtgtcacccagatcctctccagtcttaccatcactcagctgttgaagaggctccaccagtggatcaatgaggactgctccacgccgtgctccggttcgtggcttagggatgtttgggactggatatgcacggtgttggccgacttcaagacctggctccagtccaagctcctgccgcggttaccgggagtccccttcctctcatgccaacgtgggtacaagggggcctggcggggagatggtatcatgtataccacctgcccatgtggggcacaaatcaccggacatgtaaaaaacggttccatgaggatcgttgggcctagaacctgcagcaacatgtggcatggaacgttccccatcaacgcgtacaccacgggcccttgcacaccctccccggcgccgaactactccagggcgctgtggcgggtggctgctgaggagtacgtagaggtcacgcgggtgggggatttccactacgtgacgggcgtgaccactgacaacataaaatgcccatgccaggttccggcccctgaattcttcacagaattggatggggtacggttgcacaggtacgctccggcgtgcaggcctctcctacgggaggaggtcacattccaggtcgggcttaaccagtacatagttgggtcacaactcccgtgtgagcccgaaccggatgtagcagtgcttacttccatgctcaccgacccctcccacattacagcagagacagctaagcgcaggctggccagggggtctcctccctccttggctagctcttcagctagtcagttgtctgcgccttccttgaaagcgacgtgcactacccgtcatgactccccagacgctgacctcatcgaggccaacctcctgtggcggcaggagatgggcgggaacatcactcgcgtggagtcggagaataaggttgtaatcctggactcttttgaccctctgcgagcggaggaggatgagagggaagtgtccattgcggcggagatcctgcggaaaaccaggagtttccccccagcaattcctgtatgggcacgcccggactataatccaccactactagagtcttggaaagacccggactacgtccccccggtggtgcacgggtgtccattgccacctaccaaggctcccccgataccacctccacggagaaagaggacggttatcctgacagaatccaccgtgtcttccgccttggcggagcttgctacaaagaccttcggcagctccggatcgtcaggcgtcgacagcggcacagcgaccgcccctcctgatcaaccctccgacgacggcgatgcaggatccgatgttgagtcatactcctccatgcccccccttgagggagagccgggggaccccgacctcagcgacgggtcttggtctactgtgagcgaggaggccagcgaggatgtcgtctgctgctcgctgtcctatacatggacaggcgccttaattacaccatgcgccgcggaggagagcaagctgcccatcaatgcgttgagcaactctttgctgcgtaaccacaacatggtctacgcaacgacatcccgcagcgcaagcctgcgccagaagaaggtcacctttgacagacagcaagtcctggacgaccactaccgggacgtgctcaaggagatgaaggcgaaggcgtccacagttaaggctaagcttctatctgtagaagaagcctgcaagctgacgcccccacactcggccagatccaaatttggctatggggcgaaggacgtccggaacctatccagcagggccgttaaccacatccgctccgtgtggaaggacttgctggaagacactgagacaccaattgacaccaccatcatggcaaaaaatgaggtcttctgtgttcaaccagagaaaggaggccgcaagccagctcgccttatcgtattcccagacctgggggtccgtgtgtgcgagaaaatggccctttacgatgtggtctccattcttcctcaggccgtgatgggctcctcatacggattccagtactctcctgggcagcgggtcgagttcctggtgaacgcctggaaatcaaagaagaaccctatggggttcgcatatgacacccgctgttttgactcaacggtcactgagagtgatatccgtactgaggagtcaatttaccaatgttgtgacttggcccccgaggccagacaggtcataaggtcgctcacagagcggctttacatcgggggccccctgactaattcaaaagggcagaactgcggctatcgccggtgtcgcgccagcggcgtgctgacgactagctgcggtaacaccatcacatgttacttgaaggcctctgcagcctgtcgagctgcgaagctccaggactgcacgatgctcgtgtgcggagacgaccttgtcgttatctgtgagagcgcagggacccaggaggacgcggcgagcctacgagtcttcacggaggctatgactaggtactctgccccccctggggacccgccccaaccagaatacgacttggagttgataacatcatgctcctccaacgtgtcggtagcgcacgatgcatctggcaaacgggtgtactacctcacccgcgaccccaccatcccccttgcgcgggctgcgtgggaaacagctagacacactccagttaactcctggctaggcaacatcatcatgtatgcgcccactttatgggcaaggatgattctgatgacccatttcttctccatcctcctagctcaggagcaacttgaaaaagtcctagattgtcagatctacgggaccacttactccattgaaccacttgatctacctcagatcattcagcgactccatggtcttagcgcattttcactccatagttactctccaggtgagatcaatagggtggcttcatgcctcaggaaacttggggtaccgcccttgcgagtctggagacatcgggccagaagtgtccgcgctaagctgctgtcacagggggggagggctgccacttgtggcaaatacctcttcaactgggcagtaaggaccaagctcaaactcactccaatcccggctgcgtcccagttggacttgtccggctggttcgtcgctggttacagcgggggagacatatatcacagcttgtctcgtgcccgaccccgctggttcatgtggtgcctactcctactctctgtaggggtaggcatctacctgctccccaaccgatgaacggggagctaaccact

SEQ ID NO: 670 - DNA, 9661 bp, Hepatitis C Virus
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctgtgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacactaaccgtcgcccacaagacgttaagtttccgggcggcggccagatcgttggcggagtatacttgttgccgcgcaggggccccaggttgggtgtgcgcgcgacaaggaagacttcggagcggtcccagccacgtaggaggcgccagcccatccccaaagatcggcgctccactggcaggtcctggggaaaaccaggatacccctggcccctatatgggaatgagggactcggctgggcaggatggctcctgtccccccgaggttcccgtccctcttggggccccaatgacccccggcataggtcgcgcaatgtgggtaaagtcatcgacaccctaacgtgcggctttgccgacctcatggggtacatccccgtcgtaggcgccccgcttggyggcgtcgccacagctctcgcgcacggcgtgagagctctggaggacgggattaattttgcaacagggaacytacctggttgctccttttctatcttcttgctggccctgttgtcttgcatcactgttccggtctccgctgcccaagtgaagaacactagyagcggttacatggtgaccaacgactgtgccaatgacagcatcacctggcagcttcaggccgtggtcctccacgtccctggatgtgtcccatgcgagmrcgtgrrtrrcacctcgcggtgttggataccggtctcaccaaacgtggctgtgcggcagcccggcgccctcacgcaaggcctgcggacgcacctmgacatggttgtgatgtccgccacgctctgttcygctctatacgtgggagacctctgcggcggggtgatgctcgcagcccagatgttcattgtctcgccggaacatcactggtttgtgcaagaatgcaattgctccatctaccctggtgccatcactgggcagcgtatggcatgggacatgatgatgaactggtcgcccacggctaccatgatcttggcgtacgcgatgcgcgttcccgaggtcatcatagacatcatcagcggggctcactggggcgtcatgttcggcttagcctatttctccatgcagggagcgtgggcgaaagtcgttgtcatccttctactggccgctggggtggacgcgaayacccwcrctryygggggtgctgccgcacgcaacgcctacggtgtcaccagtctcttcagytytggcgccyagcagaacatccagctcattaacaccaatggcagttggcacatcaaccgcactgccctgaattgcaatgactctttgaacactggcttcctcgcgwccctrttctacgykaaccgcttcaactcgtcaggatgtcctgaacgcctgtccgtttgccgcaatatcgaggccttccggataggatggggcaccttgcaatacgaggataatgtcaccaatccagaggatatgagaccatattgctggcactacccaccaaaacagtgtagcatagtccccgcgaggtctgtgtgtggcccggtgtactgtttcacccccagtccagtggtagtgggcacgaccgatagacgtggagtgcctacttacacatggggagagaatgagacagatgtcttcctactgaacagcacccgaccaccgcaggggtcatggttcggttgcacgtggatgaactccactggctttaccaagacttgtggcgcaccaccctgtcgtaccagagctgacttcaatgccagcactgacctgttgtgccccacggactgttttaggaagcatcctgaagccacttacatcaaatgtggttctgggccttggctgacgccaaggtgcctggtcgattacccctacaggctctggcattacccctgtacagttaactataccatcttcaagataaggatgtatgtggggggagttgagcacaggctcacggccgcgtgtaacttcactcgcggggaccgttgcgacttggaggacagagataggagtcagctgtctcctttgttgcactctaccacggaatgggccattttgccctgctcctactcggacctgcccgcyttatcgactggccttctccacctccaccaaaacatcgtggatgtacaatacatgtatggtctgtcacctgccctcacaaaatacatcgtccgatgggagtgggtagtactcttattcctgctcttagcggacgctagggtctgtgcctgcttatggatgttcatcttgatgggccaggccgaagcagcactagagaaactagtcgtcttgcacgctgcgagcgcggctagctgcaacggcttcttatactttgtcatcttttttgtggctgcttggtacatcaagggtcgggcagtccccttggctgcctattccctcaccggcctatggtctttctgcctattgctcctagtactgccccagcaggcttatgcctatgaggcatctgtgcacggacagataggcgcggctttgttggtactaattaccctctttacactcaccccggggtataagacccttctcagtcggtgtctgtggtggttatgctatctcctgactctgggggaggccatggtccaggagtgggcaccatccatgcaggcgcgcggtggccgggatggcatcatctgggccgccactatattctgcccgggcgtggtgtttgacataaccaagtggcttttggcggcgcttgggtctggctatctcctaagaggtgctttgacgcgcgtgccgtatttcgtcagagctcacgctctgctgaggatgtgcactatagcgaagcacctcgcagggggtaagtacgtccaaatggcgctattagcccttggtaggtggactggcacttacatctatgatcacctcacccctatgtcggattgggctgccagtggcctgcgggacttggcagtcgctgtggagcctatcatcttcagtccgatggagaagaaagttatcgtctggggagcggagacggctgcatgcggggacatcttacacggacttcctgtgtccgcccgrctcggtcgggagatcctccttggcccagctgatggctacacctccaaggggtggaggcttcttgcccccatcaccgcttacgcccagcagacacgaggyctcttgggygctatagtggtgagtatgacggggcgtgacaagacagaacaggccggggagatccaggtcctgtccacggtcactcagtccttccttggaacatccatctcgggggtcttatggactgtctaccacggagctggcaataagactctagccggctcacggggcccagtcacccagatgtactccagtgccgagggagacttggtagggtggcccagccctcctggaactaaatcattggagccgtgcacgtgtggagcggtcgacctgtacctggtcacgcgcaacgctgacgttatcccggctcgaagacgcggggacaagcggggagcgttgctctccccgagacctctttccaccttgaaggggtcctcrgggggaccggtgctttgtcccaggggccacgctgtcgggatcttccgggcagctgtgtgctctcggggcgtggctaagtccatagatttcatccctgttgagacactcgacatcgtcacgcggtctcccacctttagtgacaacagcacaccaccagctgtgccccagacctatcaggtcgggtatttgcatgccccgactggcagtggcaagagcaccaaagtccctgtcgcataygcctctcaggggtataaagtgctggtgcttaatccctcggtggctgctaccctggggtttggggcgtacttgtccaaggcacatggcatcaatcccaacattaggactggagtcaggactgtgacgacaggggaggccatcacgtactccacgtatggcaaattcctcgccgatgggggctgcgcaggcggcgcctatgacatcatcatatgcgatgaatgccatgccgtggacgctactactattctcggcatcggaacagtccttgatcaggcagagacagccggggtcaggttaacagtgctggctacggccacgccccccgggtcggtaacaaccccccatcccaatatagaggaggtagccctagggcacgagggtgagatccccttctatgggaaggcgattcccctgtcttacatcaagggaggaaggcacttgatcttctgtcactcaaagaaaaagtgtgacgagctctcggcggcccttaggggcatgggcttgaacgctgtggcatattacagagggttggacgtctccgcaataccagctcagggagatgtagtggtcgtcgccaccgacgccctcatgacggggtatactggagactttgactccgtgatcgactgcaaygtagcggtcactcaagtcgtagacttcagcttagaccccaccttcaccataaccacacagaccgtccctcaagacgctgtctcacgcagccagcgccgggggcgtacaggcagaggaagactgggcatctataggtacgtttccactggtgagcgagcttcaggaatgtttgacagcgtagtgctctgtgagtgctacgacgcaggggctgcrtggtatgagctcacaccagcggagactactgtcaggctgagagcatatttcaacacgcctggcctgcccgtatgccaagatcaccttgagttttgggaggcagtcttcaccggcctcacacacatagatgcccacttcctgtcccaaacaaagcaatcgggggagaatttcgcatacttagtagcctaccaggctacagtgtgcgccagagccaaagctcctcctccgtcctgggacgtcatgtggaagtgcttgacccgactcaagcccacgcttgtgggccctacacctctcctgtaccgtttgggctctgttaccaacgaagtcaccctcacacatcctgtgacgaagtacatcgccacatgtatgcaagctgatcttgaggtcatgaccagcacgtgggtcctagctgggggagtcctggcagccgtcgcmgcgtattgtctcgcgaccgggtgtgtttccatcatcggccgcttgcacatcaaccagcgagccgtcgttgcgccggacaaggaagtcctctatgaggcttttgaygagatggaggaatgtgcctctagagcggctctcattgaagaggggcagcggatagctgagatgctgaagtccaaaattcaaggcttattgcagcaagcctctaaacaagcccaggacatacaacccgctgtrcaagcttcatggcccaaggtggagcaattctgggccaagcacatgtggaacttcattagcggcatccaatacctcgcgggactgtcaacgctgccaggaaaccccgctgtggcttccatgatggcattcagtgccgccctcaccagcccgttgtcaactagcaccactatcctccttaacatcctgggaggctggctggcgtcccaaattgcgccacccgcgggggccaccggcttcgtcgtcagtggcctggtgggggctgccgtaggcagcgtaggcttgggcaaggtgctggtggacatcctggcagggtatggcgcgggcatttcgggggccctcgtcgcattcaaggtcatgtctggcgagaagccctccatggaagatgtcgtcaacctrctgcctgggattctgtctccgggtgccctggtagtgggagtcatctgcgcggccatcctgcgccgccacgtggggccgggggaaggcgcggtccaatggatgaacaggctcattgccttcgcttccagaggaaaccacgttgcccccacccactacgtgacggagtcggatgcrtcgcagcgtgtgacccagctgcttggctcccttaccataactagcctgctcagaagactccataattggattactgaggactgccccatcccatgcgcgggctcrtggctccgcgatgtgtgggactgggtttgcaccatcctaacagactttaaaaactggctgacctccaagttgtttccaaagatgcccggcctcccctttatctcttgccaaaaggggtatagaggcgtatgggccggcactggcatcatgaccacacgatgttcttgcggcgccgaaatctctggcaaygtccgcctgggctctatgagaatcacagggcctagaacctgcatgaayacctggcaggggaccttccctatcaattgttacacggagggccagtgcgtgccaaaacccgcgccaaacttcaaaaccgccatctggagagtggcggcttcggagtacgcggaggtgacgcagcacgggccrtactcctatataacaggactgaccactgacaacctgaaagttccctgtcaaataccttctccagagttcttttcctgggtggacggagtgcaaatccataggtttgctcccaagccaaagccgtttttccgggatgaggtctcgttctgcgttgggcttaattcatttgtcgtcgggtctcagcttccttgtgaccctgaacccgacacagacgtattgatgtccatgctaacagatccatcccatattacggcggaggctgcagcacggcgcttagcgcggggctcacccccatctgaggcaagctcctcagcaagccagctgtcggcaccatcgctgcgggcyacctgtgccacccacggcaagacctatgatgtggacatggtggatgccaacctgttcatggggggcgatgtgactcggatagagtctgagtccaaagtggtcgttctggattctctcgacccaatggccgaagaaaggagcgacctcgagccttcgataccatcggagtatatgctccccaggaacaggttcccaccagccttaccggcctgggcacggcctgactacaaccctccgcttgtggaatcgtggaagaggcccgattaccaaccgcccactgttgcgggctgtgctctcccccctcctaagaaggctccgacgccccccccaaggagacgtcggacggtgggtttgagtgagagcaccataggagatgctctccaacagctggccattaagaccttcggccagccccccccaagcggcgactcaggcctttccacgggggcggacgctgccgactccggcggccaggcgtcccccgatgagttggctctttcggagacaggttctacctcctccatgccccccctggagggggagcctggggatccagacctggagcctgagcgggtggagctccaggctctcccccagggaggggaggtggctcccggctcggactcggggtcctggtctacttgctccgaggaagacgactctgtcgtgtgctgctccatgtcatactcctggaccggggctctaataactccttccggccccgaagaggagaagttgccaatcaaccccttgagcaactcgctgttgcgataccacaacaaggtgtactgtactacatcaaggaccgcctcactgagggctaaaaaggtaacttttgataggacgcaagtgctcgacgcctattatgactcaaccttaaaggacatcaagctagcggcctccagggtcagcgcaaggctccttaccttggaggaggcgtgtcagctaactccgccccactctgcaagatccaggtacgggtttggggctaaggaggtccgcagcttgtccgggagggccgtcaaccacatcaagtccgtgtggaaggacctcctggaagactcacaaacaccaattcccacgaccatcatggccaaaaatgaggtgttctgcgtggaacccaccaaggggggtaagaaagcagctcgcctcatcgtttaccctgacctcagcgtcagggtttgcgagaagatggccctttatgatgtcacacaaaagcttcctcaggcggtgatgggggcttcttatggattccagtactcccccgctcagcgggtggagtttcttttgaaagcatgggcggaaaagaaagaccctatggggttttcgtatgatacccgatgctttgactcaacagtcactgagagagacatcagaactgaggagtccatataccaggcctgctccctgcccgaggaggcccgcactgccatacactcgctgactgagagactttacgtaggtgggcccatgctgaatagcaagggccaagcctgcgggtacaggcgttgccgcgccagcggggtgctcaccactagcatggggaacaccatcacatgctacataaaagccctagcggcttgcaaggctgcggggatagttgcgcccacaatgctggtatgcggcgacgacttggtcgtcatctcagaaagccaggggactgaggaggacgagcggaacctgagagccttcacggaggctatgaccaggtattctgcccctcctggtgacccccccagaccggaatatgacctggagctaataacatcttgttcctcaaatgtgtctgtggcgctgggcccgcagggccgccgcagatactayctgaccagagaccctaccactccaytcgcccgggctgcctgggaaacagttagacactcccccgtcaattcatggctgggaaacatcatccagtacgccccaaccatatgggttcgcatggtcctgatgacacacttttactccattctcatggcccaagacaccctggaccagaaccttaactttgagatgtacggagcggtgtactccgtgagtcccttggacctcccagccataattgaaaggttacacgggcttgacgctttttcactgcacacatatactccccacgaactgacgcgggtggctgcagccctcagaaaacttggggcaccacccctcagagcgtggaagagtcgggcgcgtgcggttagggcgtccctcatctcccgtggagggagagcggccgtctgcggtcggtatctcttcaactgggcggtgaagaccaagctcaaactcactccattgccggaggcacgccacctggatttatccagttggttcaccgtcggcgccggcgggggcgacatttatcacagcgtgttgcgcgcccgaccccgcttattactccttggcctactcctacttttcgtaggggtaggcctcttcctactccccgctcggtagagcggcacacaatagctacactccatagctaactgtttttttttttttttttttttttttttttttttttttttttttttcttttctttcctttccttcttactctactttactttttctggtggctccatcttagccctagtcacggctagctgtgaaaggtccgtgagccgcatgactgcagagagtgccgtaactggtctctctgcagatcatgta

SEQ ID NO: 671 - DNA, 9693 bp, Hepatitis C Virus
acccgcccctaataggggcgacactccgccatgaaccactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacaccaaccgtcgcccacaagacgttaagtttccgggcggcggccaaatcgttggcggagtatacttgttgccgcgcaggggccccaggttgggtgtgcgcgcgacaaggaagacttcggagcggtcccagccacgtggaaggcgccagcccatccctaaacatcggcgctccactggcaagtcctggggaacaccaggatacccttggcccctatatgggaatgaggggctcggctgggcaggatggcttctgtccccccgaggttcccgtcccacttggggccccactgacccccggcataggtcgcgcaatgtgggtaaggtcatcgataccctaacgtgcggctttgccgacctcatggggtacatccccgtcgtaggcgccccgctcggtggcgtcgccagagctctcgcgcacggcgtgagagtcctggaggacggggttaattacgcaacagggaacttacccggttgctccttttctatcttcttgctggccctactgtcctgcatcaccattccggtctctgctgcccaagtgaagaacaccagtagcggttacatggtgacaaatgactgctccaatgacagcatcacctggcagcttgaggccgcggtccttcacgtccccgggtgtgtcccgtgcgagaaagtgggaaatacatcacggtgttggattccggtctcgccaaatgtggccgtgcagcggcccggtgctctcacgcagggcttgcggactcatatcgacatggttgtgatgtccgccacgctctgctccgctctctacgtgggggacttctgcggcggggtgatgctcgcggctcagatgtttatcgtctcgccgcagcaccactggtttgtgcaggaatgcaattgctccatctaycctggcaccatctcmggacaccgtatggcatgggacatgatgatgaactggtcgccgacggccaccatgatcatggcgtacgtgatgcgtgtgcccgaggtcatcatagacatcattgccggggctcactggggcgtcatgttcggcttagcctacttctcyatgcagggggcgtgggcgaaagtcgttgtcatccttctgctgacygctggggtggacgcgcayaccarcattgggagcgcygtkrcgmgcrctaccagcggcytcgycggcctyttctaccgtggcgctcagcagaacattcaactcattaacaccaayggcagttggcacatcaaccgcactgccctgaaytgcaatgactccttgaacaccggcttcctcgcgtccctgttctacgctargcgcttcaactcgtcaggatgtccygaacgcctgtccgtctgccgcaatatcgaggccttccggataggatggggtaccttgcaatacgaggataatgtcaccaatccagaagatatgagaccatattgctggcactacccaccaaaaccgtgtrgcatagtccccgcggggtctgtgtgyggcccagtgtactgtttcacccccagcccagtggtggtgggcacgaccgatagacttggcgygcctacttacacgtggggagaaaatgaaacagatgtctkcctattgaacagtacccgaccaccgcaggggtcatggttcggctgcacgtggatgaactccactggttttactaaaacttgtggcgcaccaccttgccgcactagagctgacttcaatgccagcacggacctgctgtgccccacggactgttttaggaagcatcctgaagccacttacatcaaatgtggttctgggccctggctyackccaaggtgtatggtcgactacccctacaggctctggcattacccttgcacagtcaactattccatcttcaagataaggatgtacgtgggaggggttgagcacaggctcatggccgcgtgtaacttcactcgcggggatcgttgcgacttggaggacagggacagaagtcaactgtctcctttgttgcactccaccacggaatgggccattttgccctgctcatactcagacctgcctgctttgtcgactggccttctccacctccaccaaaacattgtggacgtacaatacatgtatggyttgtcaccwgccrtcacaaaatacgtcgtccgatgggagtggrtagtrctcttattcctgctcctagcggacgccagggtctgcgcctgcctgtggatgctcatcttgttgggccaagccgaagcagcactrgagaagctggtcgtcctgcacgctgcgagcgcggccagctgcaatggctttgtatamtttgtcatctttttcgtggctgcttggcayatcaagggtcgggcggtccccttagctgcctattcccttactggcctatggtccttctgcctactgctcctaatactgcctcaacaggcctatgcctatgatgcatccgtgcacgggcagataggcgtggttttgttgacaytgattaccytctttacactcaccccgggatataagacccttctcagccggtgtctgtggtggttgtgctatttcctgaccctgggggaagccatggtccaggaatgggcaccatccatgcasgcgcgyggcggccgcgatggcatcatatgggccgccaccatattctgcccgggcttrgtgtttgacataaccaagtggcttctggcggtgtttgggcctggttacctcctaagagatgctttgacgcgcgtgccatatttcgtcagagctcacgctctgctgagrgtgtgcactatggtgaggcatctcgcggggggtaagtacgtccagatggcgctgttagcacttggtaggtggaccggcacctacatttatgaccacctcacccctatgtcggattgggctgctagcggcctgcgggacttggcggtcgctgtggaaccyatcatcttcagcccgatggagaagaaagtcatcgtctggggggcagartcggccgcatgcggggacattytacatggactccccgtgtccgcccgacttggtcgggagatcctccttggcccagctgatggctacacttccaaggggtggcggcttcttgctcccatcaccgcctacgcccagcaaacacgaggtcttttgggcgccatagtggtgagcatgacgggacgcgacaagacagaacacgccggggaaatccaagtcctgtccacagtcactcagtccttcctcggaacaaccatttcggggatcttatggactgtttaccacggagctggcaacaagactctcgccggctcacggggtccggtcacgcagatgtactcgagtgccgagggggacttggttggatggcctagcccccctggaactaaatctctggagccgtgcacgtgtggggcggtcgacctgtacctggtcacgcggaacgctgatgtcattccggctcggagacgcggggacaagcgaggagcactactctccccgagacccytttcaaccttgaaggggtcctcggggggaccggtgctttgccctaggggccacgccgtcgggatcttccgggcagctgtgtgttctcggggcgtggccaagtccatagatttcatccccgttgaggcactcgacatcgtcacgcggtctcctacctttagtgacaatagcactccaccggctgtgccccagacctatcaggtcgggtacttgcatgctccractggcagtggaaagagtaccaaagtccctgtcgcatacgcctcccaggggtacaaagtgctagtgcttaacccctcggtggctgccaccctggggtttggggcgtacttgtccaaggcacatggcatcaatcccaacatcaggaccggagtcaggactgtgacgaccggggagcctattacgtactccacgtatggcaaatttctcgccgatgggggctgcacaggcggcgcctatgacatcatcatatgcgatgaatgccactccgtggatgccaccaccattctcggcatcggaacagttcttgaccaagcagagacggccggggtcaggctaaccgtgctggccacggccacacccccygggtcggtgacaaccccccatcccaatatagaggaggtggccctcggccaggagggcgagatccccttctatgggagggcaattcccctgtcttacatcaagggagggagacacttgatcttctgccactcaaagaaaaagtgtgacgagctcgcggcggcccttcggggcatgggcttgaacgctgtggcatactacagagggttagacgtctctacaataccaactcaaggagacgtagtggtcgtcgccaccgacgccctcatgacggggtacactggagactttgactcagtgatcgactgcaacgtagcggtcactcaagtcgtggacttcagcttggaccccacctttaccataaccacacagactgtcccccaggacgctgtctcacgtagccagcgccgggggcgcactggtagaggaagactgggcatttataggtatgtctccactggtgagcgagcctcaggaatgtttgacagtgtagtgctctgcgagtgctacgacgcaggggcggcatggtatgagctcacaccagtggagaccaccgtcaggctcagagcgtatttcaacacgcctggcttgcctgtgtgccaagaccatcttgagttttgggaggcggttttcaccggcctcacacacatagatgctcacttcctctcccaaacgaagcaatcgggggasaatttcgcatacttagtagcctatcaggctacagtgtgcgctagagccaaagcccctcccccgtcctgggatgtcatgtggaagtgtttgactcgactcaagcccacgctygtgggccctacacctctcctgtaccggttgggctctgtcaccaacgaggtcactctcacacatcctgtgacgaaatacatcgccacatgcatgcaagccgaccttgaggtcatgaccagtacgtgggtcctagctgggggggtcttggcagccgtcgccgcgtattgcttggcgactgggtgtgtttccatcatcggccgcttgcacatyaaccagcgagccgtcgttgcaccggacaaggaggtcctctatgaggcttttgatgagatggaggaatgtgcctctagagcggctctcattgaagaggggcagcggatagccgagatgttgaggtccaagatccaaggcttattgcagcaagcctccaaacaggcccaggacatacaacccgctgtgcaggcttcatggcccaaggtggagcaattttgggccaaacacatgtggaacttcatcagcggcattcagtacctcgcgggactgtcaacactgccagggaaccctgctgtggcttccatgatggcattcagtgccgccctcaccagcccgttgtcgactagcaccactatccttctcaacattttgggaggctggctggcgtcccaaatcgcgccacccgcgggggccaccggcttcgtcgtcagtggcctggtgggggctgccgtaggcagcataggcctgggtaaggtgctggtggacatcttggcagggtatggtgcgggcatttcgggggccctcgtcgcattcaagatcatgtctggcgagaagccctccatggaagatgtcgtcaacctgctgcctgggattttgtctccgggcgccctggtggtgggagtcatctgcgcggccatcctgcgccgccacgtgggaccgggggaaggcgcggtccaatggatgaacaggctcattgccttcgcttccagaggaaaccacgtcgcccctacccactacgtgacggaatcggatgcgtcgcagcgtgtgacccaactgcttggttcccttactataactagcctgctcagaagactccacaattggattactgaggactgccccatcccatgcgccggctcgtggctccgcgatgtgtgggactgggtttgcaccatcctaacagacttcaaaaattggctgacttccaagytgtttccaaaaatgcccggcctcccctttatctcttgccaaaaggggtacaagggcgtgtgggccggtactggtatcatgaccacacgatgtccttgcggtgccaacatctctggcaatgtccgcctgggctctatgagratcacagggcccaagacctgcatgaacacttggcaggggactttccctatcaactgttacacggagggccagtgcgtgccgaaacccacgctaaacttcaagaccgccatctggagggtggcggcctctgagtacgcggaggtgacgcagcatgggtcgtattcctatataacaggactgaccaccgacaatttgaaagttccctgccaattaccttctccagagttcttttcctgggtggacggagtrcaaatccataggtttgctcccayaccaaagccgtttttccgggacgaggtctcgttttgcgttgggctcaattcatttgtcgtcggatctcagcttccttgygaccctgagcccgacactgacgtattgatgtccatgctaacagatccaacccatattacggcggaggctgcagctcggcgcttagcgcggggatcacccccatctgaggcaagctcctcggcgagccagctatcagcaccatcgctgcgagctacctgcaccacccacggcaaggcctatgatgtggacatggtggacgccaacttgttcatggggggcgatgtgactcggatagagtctgagtctaaagtggtcgttctggattctctcgacccaatggccgaagaaaagagcgatctcgagccttcgataccatcggagtacatgctccccaagagcaagttcccgccagccttaccggcctgggcacggcctgattacaacccaccgcttgtggaatcgtggaagaagccagattaccagccgcccaccgttgctggctgcgctcttcccccccccaagaaaaccccgaccccccccccaaggagccgccggacagtgggtctgagggagagcaccataggagatgctctccagcagctggccattaagacctttggccagccccccccaagcggcgattcaggcctttccacgggggcggacgtcgcggattccggcggtcagacaccccctgacgagttggctctttcggagacaggttctatctcctccatgccccccctcgagggggagcctggggacccagacctggarcctgaactggtagagcttcaacctcccccccaggggggagaggtagctcccggctcggactcggggtcctggtctacttgctccgaagaggatgactccgtcgtgtgctgctccatgtcatactcttggaccggggctctaataactccttgtagccccgaagaggagaagttaccaattaaccccttgagcaactcgctgttgcggtaccacaacaaggtgtactgtactacatcaaagagcgcctcactgcgggctaaaaaggtaacttttgataggatgcaagtgctcgacgcctattatgattcagtcttaaaggacatcaagctagcggcctccaaggtcagcgcgaggctcctcaccttggaggaggcatgccaattgactccaccccattctgcaagatctaagtatggatttggggccaaggaggtccgcagcttgtccgggagggccgtcaaccacatcaagtccgtgtggaaggacctcctggaagactcacaaacaccaattcctacgaccatcatggccaaaaatgaggtgttctgcgtcgaccccaccaaggggggtaagaaagcagctcgccttatcgtctaccctgacctcggtgtcagggtctgcgagaagatgcccctttatgatgtcacacaaaagcttcctcaggcggtgatgggggcttcttatggcttccagtactcccccgctcaacgggtggagttcctcttgaaggcatgggcggaaaagaaagaccctatgggtttttcgtatgatacccgatgctttgactcaaccgtcactgagagagacatyagaactgaagagtccatataccgggcctgctccctgyccgaggaggcccacactgccatacattcgctgactgagagactttacgtgggggggcccatgttcaacagcaagggccagacctgcgggtacaggcgttgccgcgccagcggggtgctcaccactagcatggggaacaccatcacatgctacgtraaagccctagcggcttgcaaggctgcggggatagttgcacccacaatgctggtatgcggcgacgacttggtcgtcatctcagaaagccaggggactgaggaggacgagcggaacttgagagycttcacggaggctatgaccaggtattctgccccttccggcgacccccccagaccggaatatgacctggagctgataacatcttgctcttcaaatgtgtctgtggcacgggacccacagggccgccgcagatactacctgaccagagaccctaccactccaatcgcccgggctgcctgggaaacagtcagacacttccctgtcaattcatggctgggaaacatcatccagtacgctccaactatatgggttcgtatggtcctgatgacacacttcttctccattctcatggcccaagacaccctggaccagaacctcaactttgaaatgtacggatcggtgtactccgtgagtccttcggacctcccagccataattgaaaggttacacgggcttgacgccttctctctgcacacatacactccccacgaactgacgcgggtggcttcagccctcagaaaacttggggcgccacccctcagagcgtggaagagtcgggcgcgtgcagtcagggcgtccctcatctcccatggagggagggcggccgtttgcggccggtatctcttcaactgggcggtgaakaccaagctcaaactcactccattgccggaggcacgcctcctggatttatccagctggtttaccgtcggcgccggcgggggcgacatttatctctgcgtgttgcgtgcccgaccccgcttattactccttagcctactcctactttccgtgggactaggccttttcctactccccgctcggtagagcggcacacactagctacactccatagctaactgttcttttttttttttttttttttttttttttttttttttttttttttttttttttttttttttttttttttttttttttttcttttccttcttctttcttaccttattttccttctttcttggtggccccatcttagccctagtcacggctagctgtgaaaggtccgtgagccgcatgactgcagagagtgccgtaactggtctctctgcagatcatgt

SEQ ID NO: 672 - DNA, 9653 bp, Hepatitis C Virus
acccgcccctaataggggcgacactccgccatgaaccactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcatcatgagcacaaaacctaaacctcaaagaaaaaccaaaagaaatactaaccgtcgcccacaagacgttaagtttccgggcggcggccagatcgttggcggagtatacttgttgccgcgcaggggccccaggttgggtgtgcgcgcgacaaggaagacttcggagcggtcccagccacgtgggaggcgccagcccatccccaaagatcggcgctccactggcaagtcctggggaaaaccaggatacccctggcccctatatgggaatgagggactcggctgggcagggtggctcctgtccccccgaggytcccgtccctcttggggccccactgacccccggcataggtcgcgcaacgtgggtaaggtcatcgataccctaacgtgcggctttgccgacctcatggggtacattcccgtcgtaggcgccccgcttggtggcgtcgccagagctctcgcgcatggtgtgagagtcctggaggacggggttaattatgcaacagggaacttacctggttgctccttttctatcttcttgctggccctactgtcctgcatcaccatcccggtctctgctgcccaggtgaagaacaccagcaccggttacatggtgaccaatgactgttccaatgacagcatcacctggcagcttcaggctgcggtcctccacgtccccgggtgtgtcccgtgtgagaaagtgggaaatayatcacggtgttggataccggtctcaccaaacgtggctgtgcagcggccaggcgccctcacgcagggcttgcggacgcacatcgacatggttgtgatgtccgccacgctgtgctctgctctctacgtgggggacctctgcggcggggtgatgctcgcagcccagatgttcatcgtctcgccgcagcaccactggtttgtgcaggaatgcaattgctccatctaccctggtaccatyactggacaccgtatggcatgggacatgatgatgaactggtcgcccacggccaccatgatcctggcgtacgcgatgcgcgttcccgaggtcatcatagacatcattggcggggctcactggggcgtcatgttcggcttagcctacttctccatgcagggagcgtgggcgaaagtcgttgtcatccttctgttggcygctggagtggacgcgvvvacccrcactrttgcgggtaswgscgcgcamaccgtcagcggcatcrccagkctkttcwcgcccggbgctaagcagaacatscagcttattaactccaatggcagttggcatatcaaccgcactgccctgaattgcaatgactccctgaacaccggctttctcgcgtccctgttctacacccacagyttcaactcgtcaggatgtcccgaacgcctgtccgcctgccgtaatatcgaggcctttcggataggatggggcaccttgcaatacgaggagaatgtcaccaacccagaagatatgagaccatattgctggcaytatccaccaaaacagtgtggtatagtccccgcggagtctgtgtgcggtccagtgtactgtttcacccccagcccagtrgtrgtgggcacgaccgataggcttggagtgcctacttacacgtggggagagaatgagacagatgtcttcctattgaacagcacccgaccgccgtcggggtcatggttcggctgcacgtggatgaactccactggtttcaccaaggcttgtggcgcaccaccttgccgcaytagagctgatttyaatgccagcacggacttgttgtgccccaccgactgttttaggaagcatcctgaagccacttacatgaaatgtggttctggaccctggcttacgccaaggtgcttggtcgactacccctacaggctctggcattacccctgcacagtcaactataccatcttcaagataaggatgtatgtggggggggttgagcacaggctcacggccgcgtgcaacttctctcgtgggtaycgttgcaacttggaggacagggacagaggtcaagtgtctcctttgttgcactccaccacagagtgggccattttgccctgctcttacacagacttgcctgctttgtccactggtcttattcacctccaccaaaatatcgtggacgtacaatacatgtatggcctgtcacctgccctaacaaartatgtcgtccgrtgggagtgggtagtactcctattcctgctcttagcggacgccagggtttgcgcctgcctgtggatgctcatcttgctgggccaagccgaagcagcactagagaagctggtcgtcttgcacgctgcgagtgcagctagctgcaatggcttcctatactttgtcatctttttcatagctgcttggtacatcaagggtcgggyggtccctttggctacctattccctcactggcctatggcccttctgcctactgctcctagcactgccccaacaggcttacgcctatgatggatctgtgcacggacagataggcgcggctytgttgatactgattaccctgttcacactcaccccggcgtataagacccttctcagccggtgtctgtggtggttgtgctatctcctgaccctgggggaagccatggtccaggagtgggcaccatccatgcaggcgcgcggtggccgcgatggcatcatatgggccgccaccatattctgcccgggtgtggtgtttgacataaccaagtggctcttggcggtgcttgggcctggttatctcctaagagatgctttgacacgtgtgccgtatttcgtcagagctcacgctctgctgaggatgtgcaccrtggtgaggcacctcgcagggggtaggtacgtccagatggcgctattagcccttggtaggtggaccggcacttacatctatgatcatctcacccctatgtcggactgggctgccagtggcctgcgggacttggcggtcgccgtggagcctatcatcttcagtccgatggagaagaaggtcatcacctggggagcggagacggctgcatgcggggacatcttacacggacttcctgtgtccgcccggctaggccgggagatcctccttggcccagctgatggctacacctccaaggggtggaggctccttgcccccatcactgcctacgcccagcagacacgaggcctcttgggcgccatagtggtgagcatgacggggcgcgacaagacagagcaggccggggaaatccaagtcctgtctacggtcactcagtccttcctcggaacatccattkcgggggtcttgtggaccgtctaccatggagctggcaacaagactctagccggttcacggggtccagtcacgcagatgtactcgagtgccgagggagacttggtggggtggccragccctcctgggaccaagtctttggagccgtgcacgtgtggagcggtcgacctgtatctggtcacgcgaaacgctgatgtcatcccggctcgaagacgcggggacaagcggggagcattactctccccgagacctctttcgaccttgaaggggtcctcggggggaccggtgctttgccctaggggccacgccgtcgggatcttccgggcggctgtgtgctctcggggcgtagctaagtccatagacttcatccccgttgaggcgctcgccatcgtcacgcggtctcccacctttagtgacaacagcacaccaccggctgtgccccagacctatcaggtcggatacctgcatgccccaactggcagtggaaagagtaccaaagtccctgtcgcgtatgccgctcaggggtataaagtgctagtgcttaatccttctgtggctgccaccctagggtttggggcgtacttgtctagagcacatggcatcaatcccaacattaggactggagtcagaactgtgacgaccggggcggccatcacgtactccacgtatggcaaattcctcgccgatgggggctgckcaggcggcgcctatgacatcatcatatgcgatgaatgccactctgtggattctaccaccattctcggcatcggaacagttcttgatcaagcagagacagccggggtcaggctgactgtgctggccacggccacgccccccgggtcagtgacaaccccccatcccaatatagaggaggtagccctcgggcaggagggtgagatccccttctatgggaaggcgattcccctgtcttacatcaagggagggagacacttgatcttctgccattcaaagaaaaagtgtgacgagctcgcggcggcccttcggggcatgggcttgaacgctgtggcatattacagagggctggacgtctccgtaataccaactcagggagacgtagtggtcgtcgccaccgacgccctcatgacggggtatactggagactttgactccgtgatcgattgcaacgtagcggtcactcaagtcgtagacttcagcttggaccccaccttcaccataaccacacagactgtccctcaagacgctgtctcacgtagccagcgccgggggcgcacgggtagagggagactgggcatctataggtatgtttccactggtgagcgagcctcaggaatgtttgacagtgtagtgctctgtgagtgctacgacgcaggggctgcgtggtatgagctcacaccagtggagaccaccgtcaggcttagggcgtatttcaacacacctggcttgcctgtgtgccaagaccatcttgagttttgggaggcggttttyaccggcctcacacacatagacgcccacttcctttcccagacaaagcaatcgggggagaatttcgcatacttagtagcctatcaggctacagtgtgcgccagagccaaagctccccccccrtcctgggacatcatgtggaagtgcttgactcgactcaagcccacgctcgtgggccctacacctctcctgtaccgcttgggctctgttaccaacgaggtcaccctcacacatcctgtgacgaagtacatcgccacatgtatgcaagctgaccttgaggtcatgaccagcacgtgggtcctagctgggggagtcttggcagccgtcgccgcgtattgcttggcgactgggtgtgtttccatcatcggccggttgcacrtcaaccagcaagtcgtcgttgcaccggacaaggaggtcctttatgaggcttttgacgagatggaggaatgtgcctctagagcggctctccttgaagaggggcagcggatagccgagatgctgaagtccaagatccaaggcttattgcagcaagcctccaaacaggcccaggacatacaacccgctgtgcaggcttcatggcccagagtggagcaattctgggccaaacacatgtggaacttcattagcggcattcaatatctcgcaggactgtcaacrctcccagggaaccctgctgtggcttccatgatggcgttcagtgccgcccttaccagtccactgtcgactagcaccactatccttctcaacatcttrggaggctggctggcgtcccaaattgcgccgcccgcgggggccactggcttcgtcgtcagtggcctggtgggggctgccgtaggcagcatcggcctgggtaaggtgctggtggatatcctggcggggtacggtgcgggcatttcgggggccctcgtcgcatttaagatcatgtctggcgagaagccctccatggaggatgtcgtcaacctgctgcccgggattctgtctccgggtgccctggtggtgggagtcatctgcgcggccattctgcgccgccacgtgggtccgggggagggcgcggtccaatggatgaacaggctcattgccttcgcttccagaggaaaccacgtcgcccctacccattacgtgacggagtcggatgcgtcgcagcgtgtgacccaactgcttggctctcttaccataactagcctactcaggagactccataactggattactgaggactgccccattccatgcgccggctcgtggctccgcgacgtgtgggactgggtttgttccatcctgatagacttcaaaaattggctgacttccaagttgttcccraagatgcccggcctccccttaatctcttgccaaaaggggtacaagggcgtgtgggccggcactggtatcatgaccacacggtgtccttgcggcgctaacatctctggcaatgtccgcctgggctctatgagaatcacagggcccaaaacctgcatgaacacttggcatgggacttttcctatcaattgttacacggagggccagtgcgtgccgaaacccgcgccaaacttcaagaccgccatctggagggtggcggcctcagagtacgcggaggtaacgcagcacgggtcatactcctatataacaggactgaccactgacaatttgaaagttccctgccaactaccttctccagagtttttttcctgggtggacggagtgcaaatccataggtttgctcccacaccaaagccgtttttccgggatgaggtctcgttttgcgttgggctcaattcgttcgtcgtcgggtctcagcttccttgtgatccagagcccgatacagacgtattgacgtccatgctaacagatccatcccatatcacggcggaggctgcagcgcggcgcttagcgcgggggtcacccccatctgaggcgagctcctcagcgagccaactatcggcaccatcgctgcgagccacctgcaccacccacgggaaaacctatgatgtggacatggtggatgctaacttgttcatggggggcgatgtgactcggatagagtctgagtccaaggtgatcgttctggactctctcgactcaatggtcgaagaagggagcgaccacgagccttcgataccatcagagtatatgctccccaggaccaagttcccgccagccttgccggtctgggcacggcctgattacaacccaccggttgtggaatcgtggaagaggccagattaccaaccacccactgttgcgggctgcgctctccccccctccaaggagaccccgacgcccccaccaaggaggcgccggacggtgggtttgagcgagagcaccataggagatgctctccagcagctggccatcaagaccttcggccagcccccctcaaccggtgactcaggccwttccacgggggcggacgctgccgactccggcggtcggacgccccctgatgaattgactccttcggagacaggttctacatcctccatgccccccctcgagggggagcctggggatccagacctggagcctgagcaggtagagcttcagcctccccctcaggagggggasgtagctcccggctcggactcggggtcctggtctacttgctccgaggaggatgactccgtcgtgtgctgctccatgtcatactcctggaccggggctctaataactccttgtagccccgaggaggaaaagttgccaattaaccccwtgagcaactcgctgttgcgataccacaacaaggtgtactgtactacatcaaagagcgcctcactgagggctaaaaaggtaacttttgataggatgcaagtgctcgacgcccattatgactcagtyttaaaggacatcaagctagcggcttccaaggttagtgcaaggctcctcaccgtggaggaggcgtgccagcttactccaccccattctgcaaaatccaagtatgggtttggagctaaggaggtccgcagcttgtccaggagggccgtcaaccacatcaagtccgtgtggaaggacctcctggaagactcaggaacaccaattcctacgaccataatggccaaaaatgaggtgttctgcgtggaacccaccaaggggggtaagaaagcagctcgccttatcgtttaccctgacctcggcgtcagggtctgcgagaagatggccctttatgatgtcacacaaaagcttcctcaggcggtgatgggggcttcttatggcttccagtactcccctgcccaacgggtggagttcctcttgaaggcatgggcggataagaaagaccctatgggtttttcgtatgatacccgatgctttgactcaactgtcactgagagggacatcagaactgaggagtccatataccaggcctgctccctgcccgaggaggcccgcactgccatacactcgctgactgagagactttacgtgggagggcccatgtttaacagcaagggtcagacctgcgggtacaggcgttgccgcgccagcggggtgctcactactagcatggggaacaccatcacatgctacgtgaaagccctggcggcttgtaaggctgcggggatagttgcgcccacaatgctggtatgcggcgacgacttggttgtcatctcggaaagccagggggctgaggaggacgagcggaacttgagagtcttcacggaggctatgaccaggtattctgccccttccggcgacccccccagaccggaatatgacctggagctgataacatcttgctcttcaaatgtgtctgtggcacgggacccacagggccgccgcagatactacctgaccagagaccctaccactccaatcgcccgggctgcctgggaaacagtcagacacttccctgtcaattcatggctgggaaacatcatccagtacgctccaactatatgggttcgtatggtcctgatgacacacttcttctccattctcatggcccaagacaccctggaccagaacctcaactttgaaatgtacggatcggtgtactccgtgagtccttcggacctcccagccataattgaaaggttacacgggcttgacgccttctctctgcacacatacactccccacgaactgacgcgggtggcttcagccctcagaaaacttggggcgccacccctcagagcgtggaagagtcgggcgcgtgcagtcagggcgtccctcatctcccatggagggagggcggccgtttgcggccggtatctcttcaactgggcggtgaagaccaagctcaaactcactccattgccggaggcacgcctcctggatttatccagctggtttaccgtcggcgccggcgggggcgacatttatctctgcgtgttgcgtgcccgaccccgcttattactccttagcctactcctactttccgtgggactaggccttttcctactccccgctcgatagagcggcacacattagctacactccatagctaactgttttttttttttttttttttttttttttttctttttttttcttttctttccttcttaccttactttactttcttttctggtggctccatcttagccctagtcacggctagctgtgaaaggtccgtgagccgcatgactgcagagagtgccgtaactggtctctctgcagatcatgt

SEQ ID NO: 673 - DNA, 9700 bp, Hepatitis C Virus
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccagccgtcgcccacaagacgttaagtttccgggtggcggccagatcgttggcggagtatacttgttgccgcgcaggggccccaggttgggtgtgcgcgcgacgaggaagacttcggagcggtcccagccacgtggaagacgccagcccatccccaaagatcggcgctccactggcaagtcctggggaaaaccaggatacccctggcccctgtatgggaatgagggactcggctgggcagggtggctcctgtccccccgaggttcccgtccctcctggggccccactgacccccggcataggtcgcgcaacgtgggtaaggtcatcgacaccctaacgtgcggctttgccgacctcatggggtacatccccgtcgtaggcgccccgcttggtggcgtcgccagagctctcgcgcacggcgtgagagtcctggaggacggggttaattatgcaacagggaacttacctggttgctccttttctatcttcttgctggccttactgtcctgcatcaccgttccggtttcagccgtccaagtgaagaacatcagcgacagctatatggtgactaatgactgctctaatgacagcattacctggcagcttcaggccgcggtcctccacgtccccgggtgcgtcccgtgtgagaaaatgggaaacatatcacggtgctggataccggtttcaccaaacgtggctgtgcagcggcctggcgccctcacgcagggcttgcgggcgcacatcgacatggtggtgatgtccgccacgctctgctccgccctctacgtgggggacctctgtggcggggtgatgctcgcagcccagatgttcattgtctcgccgcagcaccaccattttgtgcaggaatgcaattgctccatctaccctggtgctatcactggacaccgcatggcatgggacatgatgatgaactggtcgcccacggccaccatgatcctggcgtacgcgatgcgcgttcctgaggtcatcatagacatcattagcggggctcactggggcgtcatgtttggcttggcctacttctctatgcaaggagcatgggcgaaagtcgttgtcatccttctgctgaccgctggggtggacgcgcatacccgcagcattgcgggtagcgtcgcgcacgcaaccagcggccttgccggcctcttcacttctggcgctaagcagaacatccagctcattaacaccaatggcagttggcacatcaaccgcactgccctgaattgcaatgactccttgaacaccggctttatcgcgtccctgttctacacctaccgcttcaactcgtcagggtgtcctgaacgcttgtccgcctgccgcggtatccaggccttccggatagggtggggcaccttgcgatacgaggataacgtcaccaacccagaagatatgagaccatactgctggcactacccaccaaaacagtgtggcatagtctccgcgaggtctgtgtgtggcccagtgtactgcttcacccccagcccagtggtagtgggcacgaccgacaggctcggagtgcctacttacacgtggggagagaatgagacggatgtcttcatattgaacagcacccgaccaccgggggggtcatggttcggctgcacgtggatgaactccactggtttcaccaagacctgtggcgcaccgccgtgccgcattagagctgacttcaatgccagcatggacctgttgtgccccacggactgctttaggaagcatcctgatgccacttacatcaagtgtggttctgggccctggctcacgccaaggtgcctggtcgactacccttacaggctctggcattacccctgcacaatcaactataccatcttcaagataaggatgtatgtggggggggttgagcacaggctcacggccgcatgcaacttcactcgtggggatccttgcaacttggaggacagggacagaagccaactgtctcccttgttgcactccaccacggaatgggccattttgccttgctcttactcagacttgcccgctttgtcgactggccttcttcatctccaccaaaatatcgtggacgtacagtacatgtatggcctgtcacctgctctcacaaaatacatcgttcggtgggagtgggtagtactcttattcctgctcttggcggatgccagggtctgcgcttgcttgtggatgctcatcttgctgggccaggccgaagcagcactagagaagctggtcgtcttgcatgccgcgagcgcagccagctgtaatggcttcctatattttgtcatctttttcgtggctgcttggtacatcaagggtcgggcggtccccttggccgcttattccctcactggcttgtggcccttttgcctgttgctcctagcactgccccaacaggcttatgcatatgatgcatccgtgcacggacagacaggcgtggctttgttgatactgattaccctcttcacacttaccccggggtataagatccttctcagccggtctctgtggtggttgtgctatctcctgactctgggggaggccatgatccaggagtgggtaccacccatgcaggcgcgtggtggccgcgatggcatcatatgggccgccaccatgttctgcccgggtgtagtatttgacataaccaagtggctcttggcgatgcttgggcccgcttatctcctgcgagatgctctgacacgcgtgccgtatttcgtcagagctcacgctctgttgaggttgtgcactatggtgaggcatctcgcggggggtaggtacgtccagatggcgctattagcccttggtaggtggaccggcacttacatctatgaccacctctcccctatgtcggattgggctgctagcggcctgcgggacttggcggtcgccgtggagcccatcatcttcagtccgatggagaagaaagtcatcgtctggggagcggagacggctgcatgcggggacgtcttgcacggacttcccgtgtccgcccgacttggccgggagatcctccttggcccagctgatggctacacctctaaggggtggaggcttcttgcccccatcactgcttacgcccagcagacacgaggtctcttgggcgctatagtggtgagcatgacggggcgtgacaagacagaacaggccggggaaatccaagtcctatccacagtcactcagtccttcctcggaacatccatttcgggggtcttatggactgtttatcatggagctggcaataaaactctagccggctcgcggggcccggtcacgcagatgtactcgagcgccgagggggacttggtagggtggcccagccctcctgggaccaaatctttggagccgtgcacatgtggagcggtcgacctgtacttggtcacgcggaacgctgatgtcatcccggcccgaagacgaggggacaagcggggagcgctactctccccgagacctctttcgaccttgaaggggtcttcggggggaccggtgctttgccctaggggccacgctgtcgggattttccgggcagctgtgtgctctcggggcgtggctaagtccatagatttcatccccgttgaggcgctcgacgtcgtcacgcggtctcccacctttagtgacaacagcacaccaccggccgtgcctcagacctatcaggtcgggtacttgcatgccccaaccggcagtggaaagagtaccaaagtccctgtcgcgtacgccgctcaggggtacaaagtactagtgcttaatccctcggtggctgccaccctggggttcggggcgtacttgtccaaggcacatggcatcaatcctaacattaggactggagtcagaaccgtgacgaccggggagtccatcacatactccacgtacggcaaattcctcgctgatgggggctgtgcaggcggcgcctatgacatcatcatatgcgatgaatgccacgctgtggatgctaccaccattctcggcgtcggaacggttcttgaccaagcagagacagccggggtcagactaaccgtgctggccacggctacgccccctgggtcggtgacaaccccccatcccaatatagaggaggtagccctcgggcaggagggcgagatccccttctatgggagggcgattcccctgtcttacattaagggagggaggcacctgattttctgccactcaaagaaaaagtgtgacgagctctcggcggctcttcggagcatgggcttgaatgctgtggcatactacagagggttggacgtctccgtaataccaactcagggagacgtagtggtcgtcgccaccgacgccctcatgacggggtatactggagacttcgactccgtgatcgactgcaacgtagcggtcactcaagtcgtggacttcagcttagaccccactttcactataaccacacagactgtcccgcaagacgctgtctcacgtagccagcgccgggggcgcacaggtagaggaagactgggcatttataggtatgtttccactggtgagcgagcctcaggaatgtttgacagtgtagtgctctgtgagtgctacgacgcaggggctgcttggtatgagctcacaccatcggagactaccgtcaggcttagagcgtatttcaacacgcctggtttgcctgtgtgtcaagatcatcttgagttttgggaggcagtctttactggcctcacacacatagatgcccacttcctttcccaaacaaagcaatcgggggagaatttcgcatacttagtagcctatcaggctacagtgtgcgccagagccaaagcccctcccccgtcctgggacgtcatgtggaagtgcttgactcgactcaagcccacactcgtgggccctacacctctcctgtaccgtttgggccctgttaccaacgaggtcactctcacacatcctgtgacgaaatacatcgccacatgcatgcaagctgaccttgaggtcatgaccagcacgtgggtcttagctgggggagtcctggcagccgtcgctgcgtattgcttggcgaccgggtgcgtttccatcattggccgcttgcacgtcaaccagcgagccgtcgttgcaccggacaaagaggtcctctatgaggcgttcgacgagatggaagaatgtgcctctagagcggctctcattgaagaggggcagcgaatagctgagatgctgaagtccaagatccaaggcttattgcagcaagcctctaaacaggcccaggatatacaacccgctgtgcaggcctcatggcccaaggtggagcaattctgggccaaacacatgtggaacttcattagtggcatccaatatctcgcaggactgtcaacactgccagggaaccctgctgtggcttccatgatggcattcagtgccgccctcaccagtccgttgtcgactagcaccactatccttctcaacatattgggaggctggctggcgtcccaaatcgcgccgcccgcgggggccactggcttcgtcgtcagtggcctagtgggggctgccgtaggcagcataggcctgggtaaggtgctggtggatatcctggcagggtatggtgcgggcatttcgggggccctcgtagcattcaagatcatgtctggcgagaagccctccatggaggacgtcatcaacctgctgcctgggatcttgtctccgggcgccctggtagtgggagtcatctgtgcggccattctgcgccgccacgtggggccgggggagggcgcggtccaatggatgaataggctcattgccttcgcttccagaggaaaccacgtcgcccccacccactacgtgacggagtcggatgcgtcgcagcgcgtgacccaactgcttggctcccttactataactagcctgctcagaagactccacaattggattactgaagactgccccatcccatgcgccggctcatggctccgcgaggtgtgggactgggtttgcaccatcttaacagactttaaaaactggctgacctccaagttgttcccaaagatgcccggcctcccctttatctcctgccaaaaggggtacaggggcgtgtgggccggcactggcatcatgaccacacgatgtccttgcggcgccaacatttccggtaatgtccgcttgggctctatgagaattacagggcctaaaacctgcatgaacacttggcaggggacctttcccatcaattgttacacggagggccagtgcgtgccgaaacccgcgccaaacttcaagaccgccatctggagggtggcggcctcggagtacgcggaggtgacgcagcacgggtcatactcctatataacaggactgactactgacagtttgaaagttccctgtcaattaccttctccagagtttttttcctgggtggacggagtgcagatccataggtttgctcccacgccaaagccgtttttccgggatgaggtctcgttctgcgttgggctcaattcgtttgtcgtcgggtctcagcttccctgtgaccctgagcccgacgcagacgtattgacgtccatgctaacagatccgtcccatatcacggcggaggctgcagcgcggcgcttagcgcggggatcacccccgtccgaagcaagctcctcggcgagccagctatcggcaccgtcgctgcgagccacctgcaccacccacggcaaggcctatgatgtggacatggtggatgcgaacctgttcatgggaggcgatgtgactcggatagagtctgagtccaaagtggtcgttctggactctctcgacccaatggccgaagaaaggagcgacctcgagccttcaataccatcggagtatatgctccccaggaacaggttcccgccagccttaccggcctgggcacggcctgattacaacccgccgcttgtggaatcatggaagaggccagattaccaaccgcctactgttgcgggctgtgctctcccccctcccaagaagactccgacgccccccccaaggagacgtcggacagtgggtctaaacgagaacaccataggagatgccctccaacagctggccatcaaggccttcggccagccccctctgagcggcgattcaggcctttccacgggggcggacgccgccgactccggcagtcggacgccccccgatgagtcggctctttcggagacaggttctatctcctccatgccccccctcgagggggagcccggggacccagacctagagcctgagcaggtggagcttcagcctcccccccagggggaggaggtagttcctggctcggactcggggtcctggtccacttgctccgaggaggatgactccgtcgtgtgctgctccatgtcatattcctggaccggggctctaataactccttgtagccccgaagaggaaaagttgccaattaaccccttgagtaactcgctattgcgatatcacaataaggtgtactgtactacatcaaagagcgcctcattgagggccaagaaggtaacttttgacaggatgcaagtgctcgacgcccattatgactcagtcttaaaggacatcaagctagcggcctccaaggtcagcgcaaggctcctcaccttggaggaggcgtgccagttgactccaccccattccgcaagatccaagtatgggtttggggctaaggaggtccgcagcttgtccgggagggccgtcaaccacatcaagtccgtgtggaaggacctcctggaagactcacaaacaccaattcctacgaccatcatggccaaaaatgaggtgttctgcgtggaccctgccaaggggggcaagaaagcagctcgccttatcgtctaccctgacctcggcgtcagggtttgcgagaagatggccctttatgatgtcacacaaaagcttcctcaggcggtgatgggggcttcctacggcttccagtactcccccgctcaacgggtggagtttctcttaaaggcatgggcggaaaagaaagaccctatgggtttttcgtatgatacccgatgctttgattcaaccgtcactgagagagacattagaactgaggagtccatataccgggcctgctccctgcccgaggaggcccacactgccatacactcgctaactgagagactctacgtgggagggcccatgctcaacagcaagggtcagacctgcggatacaggcgttgccgcgccagcggggtgctcaccactagcatggggaacaccatcacatgctacataaaagccctagcggcttgcaaggctgcggggatagttgcgcctaccatgctggtatgcggcgacgacttggttgttatctcagaaagccaggggactgaggaggacgagcgaaacctgagagccttcacggaggctatgaccaggtattctgcccctcctggtgacccccccagaccggaatatgacctggagctgataacatcttgttcctcaaatgtatccgtggcartcggcccacagggccgccgcagatactacctgaccagagaccctaccactccactctcccgggctgcctgggaaacagttagacactcccctgtcaattcatggctgggaaacatcatccagtacgccccaaccatatgggtkcgcatggtcctgatgacacacttcttctccattctcatggctcaagacaccctagaccagaacctcaactttgagatgtacgggkcggtctactccgtgagtcctttggacctcccagccataattgaaaggttacacgggcttgacgctttttctctgcacacatactctccccacgagctgacgcgggtggcttcrgccctcagaaaacttggggcgccacccctcagagcgtggaagagtcgggcgcgtgcagttagggcgtccctcatctcccgtggagggagagcggccatttgcggtcggtatctcttcaactgggcggtgaagaccaagctcaaactcactccattgccggaggcacgcctcctggatttatccagttggtttaccgtcggcgccggcgggggcgacatttatcacagcgtgtcgcgcgcccgaccccgcttattactccttagcctactcctacttcttgtaggggtaggccttttcctactccccgctcggtagagcggcacacattagctacactccayagctaactgtttttttttttttttttttttttttttttttttttttttttttttttttttttttttttttttttttttttttttttttttcctttttccttttccttctctttttaccttactttacttttcttggtggctccatcttagccctagtcacggctacctgtgaaaggtccgtgagccgcatgactgcagagagtgccgtaactggtctctctgcagatcatgt

SEQ ID NO: 674 - DNA, 9600 bp, Hepatitis C Virus
gccagcccccgattgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggcggagtttacctgttgccgcgcaggggccccaggttgggcgtgcgcgcgactaggaagacttccgagcggtcgcaacctcgtggaaggcgacaacctatccccaaggctcgccatcccgagggcaggacctgggctcagcctgggtacccttggcccctctatggcaatgagggcttggggtgggcaggatggctcctgtcaccccgtggctctcggcctagttggggccccacggacccccggcgtaggtcgcgcaatttgggtaaggtcatcgataccctcacgtgcggcttcgccgacctcatggggtacattccgctcgtcggcgcccccctagggggcgtcgccagggccctggcgcatggcgtccgggtcctggaggacggcgtgaattacgcaacagggaatctgcccggttgctctttctctatcttcctcttggctttattgtcctgcctgaccatcccagcttccgcttatgaagtgcgcaacgtgtccggggtgtaccatgtcacgaacgactgctccaactcaagcatagtgtatgaggcagcggacgtgatcatgcatactcccgggtgcgtgccctgcgtgcaggatggcaacacctcccgctgttgggtagcgctcactcccacgcttgcggccaggaatgccagcgtccccgtcacagcaatacgacgtcatgtcgatttgctcgttgggacggctgctttctgttccgctatgtacgtgggagatctttgcggatctgtcttccccgtctcccagctgttcaccttttcgcctcgccggcatcagacagtacaggactgcaactgttcaatttatcccggccatatatcaggccaccgcatggcctgggatatgatgatgaactggtcacctacggcagccctagtggtatcgcagttactccggatcccacaagccatcgtggatatggtggcgggggcccactggggagtcctggcgggccttgcctactattccatggtggggaactgggctaaggttatgattgttttgctactctttgccggcgttgacgggactacccacaccacagggggggcggcagcccgcgctacccagggattcacatctttcttctcacttgggccgtctcagaaaatccagctcataaataccaacggcagctggcacatcaacagaactgccctgaactgcaatgactccctccagactgggttccttgccgcgctgttctacacatacaggttcaacgcgtccggatgcccagagcgcatggccagctgccgccccattgacaagttcgatcaagggtggggtcccatcacttatgctgagcctgacagctcggaccagaggccctactgctggcactacgcgcctagaccgtgtggtattgtacccgcatcgcaggtgtgtggtccagtgtactgcttcaccccaagcccggttgtagtggggacaaccgaccgtttcggtgtccctacgtatacctggggggagaatgagacggacgtgctgctcctcaacaacacgcggccgccgctgggcaactggttcggctgtacatggatgaacagcactgggttcaccaagacgtgcgggggccccccgtgtaacatcgggggggccggtaacaccaccttgacctgccccacggattgcttccggaaacaccccgaggccacttacaccaaatgcggctcggggccttggttgacacctaggtgcttggttgattatccatacaggctctggcattacccctgcgctgtcaactttaccatcttcaaggttaggatgtatgtggggggcgtggagcataggctcaacgctgcatgcaattggactcggggagagcgctgcgacctagaggacagggataggtcagagctcagcccgctgctactgtctacaacagagtggcaggtactgccctgttccttcaccaccctgccggccctgtccactggtttgattcacctccatcagaacatcgtggacgtgcagtacctgtacggtatagggtcagcggtcatcccctttgcaatcaaatgggagtatgtcctgctgctcttccttctcctggcggacgcgcgcgtctgcgcctgcttgtggatgatgctgctgatagctcaagctgaggccgccttggagaacttggtggtcctcaatgctgcgtccgtggccggagcgcatggcattctctccttccttgtgttcttctgtgctgcctggtacatcaagggcaggctggtccccggggcggcatatgctctttatggcgtatggccgctgctcttgctcctgctggcattaccaccacgagcatatgccatggaccgagaaatggccgcatcgtgcggaggcgcggttttcgtaggtctagtactcttgaccctatcaccacactataaggtgttcctcgctaggctcatatggtggtcacaatattttaccaccagggccgaggcgcttttgcaagtgtgggtcccccctctcaacatccgggggggccgcgatgccatcatcctcctcatgtgcgcggtccactcagagctaatctttgatattaccaaatttttgctcgccatactcggtccgctcatgatgttccaagctcgcataaccagggtgccgtactttgtacgggctcaagggctcatccgtgcatgcatgttggtgcggaaagccgctgggggtcattacatccaaatggctctcatgaagctggccgcactgtcaggtacgtacgtttatgaccatcttactccgctgcaggactgggcccacgcgggcctacgggacctcgcagcggcagttgagcccgttgtcttctctgacatggagactaaggtcatcacctggggggcagacaccgcggcgtgtggggacatcatttcgggcctacccgtctccgcccgaagggggagggagatactcttgggaccggccgatggtcttgaagagcagggttggcggctcctcgcgcctatcacggcttactcccaacagacacggggcctacttggctgcatcatcactagcctcacaggccgggacaaaaaccaggtcgaaggggaggttcaagtggtttctaccgcgacacaatctttcctggcgacctgcgtcaacggcgtgtgttggactgtctatcacggcgccggcacaaagactctagccggcccaaaaggcccgatcacccaaatgtacactaatgtggaccaggacctcgtcggctggcaggcgccccctggggcgcgttccttaacaccatgcacctgcggcagctcggacctttacttggtcacgaggcatgctgatgtcattccggtgcgccggcggggcgacagcagggggagcctgctctctcccaggcccatctcctacttgaagggctcttcgggtggtccactgctttgcccctcggggcacgctgtaggcatcttccgggctgctgtatgcacccggggggttgcgaaggctgtggactttgtacccgttgagtccatggaaactaccatgcggtctccggtcttcacggacaattcatcccctccggccgtaccgcagacattccaggtggcccatctacacgctcccaccggcagcggcaaaagcactaaggtgccggctgcatatgcggcccaagggtacaaggtactcgtcttgaacccgtctgttgccgctaccttaggctttggggcgtatatgtccaaggcacatggtgtcgaccctaacctcagaactggggtaaggaccatcaccaccggcgcccccattacgtattccacctatggtaagttccttgccgacggtggttgctctgggggcgcttacgacatcataatatgtgatgagtgccactcaactgactctactaccattttgggcattggcacagtcctggaccaagcggaaacggctggagcgcggctcgtcgtgctcgctaccgctacacctccgggatcggtcaccgtgccacatcccaacattgaggagatagccctgtccaacactggagagatccccttctatggcaaagccatccccatcgagatcatcaagggagggaggcatctcattttttgccattccaagaagaaatgtgacgagctcgccgcaaagctgtcaggcctcggactcaatgctgtagcgtattaccggggtcttgatgtgtccgtcataccgactagtgggaacgtcgttgtcgtggcaacagacgccctaatgacgggctttaccggcgactttgactcagtgatcgactgtaacacttgtgtcacccagacagtcgatttcagcttagaccctaccttcaccattgagacaacgaccgtgccccaagacgcagtgtcacgctcacagcggcgaggcaggactggtaggggcaggaggggtatctacaggtttgtgactccaggagaacgaccttcgggtatgttcgactcttcggtcctgtgtgagtgctatgacgcgggctgtgcttggtatgagctcacgcccgccgagacctcagttaggttacgggcttacctaaatacaccagggttgcccgtttgccaagaccacctggagttctgggagagcgtcttcacgggcctcacccacatagacgcccacttcctgtcccagactaagcaggcaggagacaacttcccctacctggtggcataccaggccacagtgtgcgccagggctcaggccccacctccatcgtgggatcaaatgtggaagtgtctcatacgactaaaacctacgctgcacgggccgacacccctgctgtataggttaggagccgtccaaaatgagaccaccctcacacaccccataaccaaatacatcatggcatgcatgtcggctgacctggaagtcgtcacgagcacctgggtgctagtaggcggggtccttgcagctctggccgcgtactgcctaacaacgggcagcgtggtcattgtgggcaggatcgtcttgtccgggaagccggccatcattcccgacagggaagtcctttaccaggagttcgatgagatggaagagtgcgcttcacaccttccgtacatcgaacagggaatgcagctcgccgagcaattcaaacagaaggcgctcgggttgttgcaaacagccactaagcaagcggaagctgctgctcccgtggtggagtccaaatggcgagcccttgaagccttctgggcgaagcatatgtggaatttcatcagcggggtacagtacttagcaggcttgtccaccctgcctgggaaccccgcaatagcatcactgatggcattcacagcctccatcactagcccgctcaccacccagtacacccttctgtttaacatcttggggggatgggtggccgctcaactcgctccccccagcgccgcctcagctttcgtgggcgccggcattgctggcgcggctgttggcagcataggcctcgggaaggtgctcgtggacatcctggcgggctatggagcgggagtggcaggcgcactcgtggcctttaaggtcatgagcggcgagatgccctccactgaggacctggtcaacttgctccctgccatcctctcccctggtgccctggtcgtcggagtcgtgtgtgcagcaatactgcgtcggcatgtgggcccgggagaaggagccgtgcagtggatgaaccggctgatagcgttcgcctcgcggggtaaccacgtctcccccacgcactatgtgcctgagagcgacgccgcggcacgtgtcacccagatcctctccaaccttaccatcactcaactgttgaagaggctccaccagtggattaatgaggactgctccacgccatgctcaggttcgtggctaagggatgtttgggactggatatgcacggtgttgactgacttcaagacctggctccggtccaagctcctgccgcggttaccgggagttcccttcctctcatgccaacgtgggtacaagggagtctggcggggagacggcatcatgcagaccacctgcccatgtggagcgcaaattgccggacatgtcaaaaacggttccatgaggatcgtagggcctagaacctgcagcaacacgtggcatggaacattccccatcaacgcgtacaccacgggcccctgcacaccctccccggcgccaaactattccagggcgctgtggcgggtcgctgctgaggagtacgtggagattacgcgggtgggggatttccactacgtgacgggcatgaccactgacaacgtaaagtgcccgtgccaggttccggcccctgagttcttcacggaagtggatggggtacggctgcacaggtacgctccggtgtgcaaacctcttctacacgaggatgtcacattccaggtcgggctcaaccaatacttggttgggtcacagctcccatgcgagcccgaaccggacgtagcagtgctcacttccatgcttaccgacccctcccacattaccgcggaaacggctaagcgcaggctggccagggggtcttccccctccttggccagctcctcagctagccagttgtctgcgccttccttgaaggcgacatgcactacccgtcatgactccccagacgctgacctcattgaggccaacctcctgtggcggcaggagatgggcgggaacatcactcgcgtggagtcagagaacaaggtagtaattctggactctttcgacccgctccgagcggaggaggatgagagggaagtatccgttccggcggagatcctgcgaaaaaccaggaaattcccctcagcgatgcccatatgggcacgcccagactacaaccctccactgctagagtcctggaaggacccggactacgtcccaccggtggtacatgggtgtccattgccacctaccaaggtccctccgataccacctccacggagaaagaggacagttgtcctgacggaatctactgtgtcttctgccttggcggagctcgccacaaagaccttcggcagctccgaatcgtcagccgtcgacagcggcacggcggccgcctctcctgaccagccctccgataacggcgacacaggatccgacgttgagtcatactcctccatgcccccccttgagggggagccgggggaccccgatctcagcgacgggtcttggtctaccgtgagcgaggaggctagtgaggacgtcgtctgctgttcgatgtcctacacatggacaggcgccctgatcacgccatgcgctgcggaggaaagccagttgcccatcaatgcgttgagcaactccttgctgcgtcatcgcaatctggtctacgccacaacatctcgcagcgcaagccagcggcagaagaaggtcacctttgacagactgcaagtcctggacgaccactaccaggacgtgcttaaggagatgaaggcgaaggcgtccacagtcaaggctaaacttctatccgtagaggaagcctgtaagctgacgcccccacattcggccaaatctaaatttggctatggggcaaaggacgtccggaacctatccagcaaggccgttaaccacatccactccgtgtggaaggacttgctggaagacactgagacaccaattgacactaccatcatggcaaagaatgaggttttctgcgttcaaccagagaaaggaggccgcaagccagctcgccttatcgtgttcccagatttgggggttcgcgtgtgcgagaaaatggctctttacgacgtggtctccacccttcctcaggccgtgatgggctccgcatacggattccagtactctcctggccagcgggtcgacttcctggtaaatgcctggaaatcaaagaagtgccccatgggcttctcgtatgacacccgctgctttgactcaacagtcactgagagtgatatccgtgttgaggagtcaatctaccaatgttgtgacttggcccccgaagccaggcaggccataaggtcgctcacagagcggctttacgtcgggggtcccctgaccaattcaaaggggcagaactgcggctatcgccgatgccgcgcgagcggcgtgctgacgaccagctgcggtaatacccttacctgctacttgaaggccactgcggcctgtcgagctgcaaagctccgggactgcacattgctcgtgaacggcgacgaccttgtcgttatctgtgaaagcgcggggacccaggaggacgcggcgagcctacgagtcttcacggaggctatgactaggtactctgccccccccggggacctgccccaaccagaatacgacttggagctgataacatcacgttcctcaaatgtgtcggtcgcgcacgatgcatctggcaaaagggtgtactacctcacccgcgaccccaccacccccctcgcacgggctgcgtgggaggcggctagacacactccagttaactcctggctaggcaacatcattatgtatgcgcccaccttgtgggcgaggatgattctgatgacacacttcttctccatccttctattccaggagcaacttgaaaaagccctagattgccagatctacggggcctattactccattgaaccacttgacctacctcagatcattcagcgactccatggtcttagcgcattttcactccatagttactctccaggtgaaatcaatagggtggcttcatgcctcaggaaacttggggtaccacccttgcgagcctggagacatcgggccaggaatgtccgcgctaagctgctgtcccagggggggagggccgccacttgtggcaagtacctcttcaactgggcagtaaggaccaagctcaaactcactccaatcccggctgcgtcccagttggacttgtccggctggttcgttgctggttacggcgggggagacatatatcacagcctgtctcgcgcccgaccccgctggcccatgttgtgcctactcctactcttcgtaggggtaggcatctacctgctccccaaccggtgaacggggagctaaacactccaggccaataggccatcctgtgtttttttttttttttttttttttttttttttttttttttttttttttttttttttttttttttttttttttttttatttccttttcttggtggctccatcttagccctagtcacggctagctgtgaaaggtccgtgagccgcatgactgcagagagtgctgatactggcctctctgcaggtcatgt

SEQ ID NO: 675 - DNA, 9711 bp, Hepatitis C Virus
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcatctcgcggggggcaggtacgtccagatggcgctactagcccttggcaggtggactggcacttacatctatgaccacctcacccctatgtcggattgggctgctagtggcctgcgggacctggcggtcgccgttgagcctatcatcttcagtccgatggagaagaaagtcattgtctggggagcggagacagctgcttgtggggacattttacacggacttcccgtgtccgcccgacttggtcgggaggtcctccttggcccagctgatggctatacctccaaggggtggagtcttctcgcccccatcactgcttacgcccagcagacacgtggccttttgggcaccatagtggtgagcatgacggggcgcgacaagacagaacaggctggggaaattcaggtcctgtccacagtcactcagtccttcctcggaacatccatctcgggggttttgtggactgtctaccatggagctggcaacaagactctggccggctcacggggtccggtcacgcagatgtactccagtgctgagggggacttagtagggtggcccagcccccctgggactaaatctttggagccgtgcacgtgtggagcggtcgacctgtacctggtcacgcggaacgctgatgtcatcccggctcgaagacgcggggacaaacggggagcgctactctccccgagacctctttccaccttgaaggggtcctcaggaggcccggtgctatgccccaggggccacgctgtcggagtcttccgggcagctgtgtgctctcggggcgtggctaagtccatagatttcatccccgttgagacactcgacatcgtcacgcggtcccccacctttagtgacaacagcacaccacctgctgtgccccagacctatcaggtcgggtacttgcatgccccgactggcagtggaaagagcaccaaagttcctgtcgcatatgctgctcaggggtataaagtgctagtgcttaatccctcagtggctgccaccctggggtttggggcgtacttgtctaaggcacatggcatcaatcccaacattaggactggagtcaggactgtgacgaccggggcgcccatcacgtactccacatatggcaaattcctcgccgatgggggctgtgcgggcggcgcctacgacatcatcatatgtgatgaatgccatgccgtggactctaccaccatccttggcatcggaacagtccttgatcaagcagagacagctggggtcagactaactgtgctggctacagctacgccccctgggtcagtgacaaccccccaccccaacatagaggaggtggcccttgggcaggagggcgagatccccttctatgggagggcgattcccctgtcttacatcaagggaggaagacatctgatcttctgccattcaaagaaaaagtgtgacgagctcgcggcggcccttcggggtatgggcttgaactcagtggcatactacagagggttggacgtctccgtaataccaactcagggagacgtagtggtcgtcgccaccgacgccctcatgacagggtatactggggactttgactccgtgatcgactgcaacgtagcggtcactcaagttgtagacttcagtttagaccccacattcaccataaccacacagattgtccctcaagacgctgtctcacgtagccagcgccggggtcgcacgggtaggggaagactgggcatttataggtatgtttccactggtgagcgagcctcaggaatgtttgacagtgtagtgctctgtgagtgctacgacgcaggggccgcatggtatgagctcacaccatcggagaccaccgtcaggctcagggcgtatttcaacacgcccggtttgcctgtgtgccaagaccatcttgagttttgggaggcagttttcaccggcctcacacacatagatgcccacttcctttcccaaacaaagcaatcgggggaaaatttcgcatacttaacagcctaccaggctacagtgtgcgctagggccaaagccccccccccgtcctgggacgtcatgtggaagtgtttgactcgactcaagcccacactcgtgggccccacacctctcctgtaccgcttgggctctgttaccaacgaggtcaccctcacacatcccgtgacgaaatacatcgccacctgcatgcaagccgaccttgaggtcatgaccagcacatgggtcttggcagggggagtcttggcggccgtcgccgcgtattgcctggcgaccgggtgtgtttgcatcatcggccgcttgcacattaaccagcgagccgtcgttgcgccggacaaggaggtcctctatgaggcttttgatgagatggaggaatgtgcctctagggcggctctcattgaagaggggcagcggatagccgagatgctgaagtccaagatccaaggcttattgcagcaagcttccaaacaagctcaagacatacaacccactgtgcaggcttcatggcccaaggtagaacaattctgggccaaacacatgtggaacttcattagcggcatccaatacctcgcaggactatcaacactgccagggaaccctgcagtagcttccatgatggcgttcagtgccgccctcaccagtccgctgtcaacaagcaccactatccttctcaacattttggggggctggctagcatcccaaattgcaccacccgcgggggccactggcttcgttgtcagtggcctagtgggagctgccgtaggcagtataggcttaggtaaggtgctagtggacatcctggcagggtatggtgcgggcatttcgggggctctcgtcgcattcaagatcatgtctggcgagaagccctccatggaggatgtcgtcaacttgctgcctggaattctgtctccgggtgccttggtagtgggagtcatctgcgcggccattctgcgccgacacgtgggaccgggggaaggcgccgtccaatggatgaatagactcattgcctttgcttccagaggaaatcacgtcgcccccacccactacgtgacggagtcggatgcgtcgcagcgtgtgacccaactacttggctcccttaccataaccagcctgctcagaagactccacaactggattactgaggactgccccatcccatgcggcggctcgtggctccgcgatgtgtgggactgggtttgcaccatcctaacagactttaaaaattggctgacctccaaattattcccaaagatgcccggcctcccctttgtctcctgtcaaaaggggtacaagggcgtgtgggccggcactggcatcatgaccacacggtgtccttgcggcgccaatatctctggcaatgtccgcttgggctccatgagaatcacggggcctaagacctgcatgaatatctggcaggggacctttcctatcaattgttacacggagggccagtgcgtgccgaaacccgcgccaaactttaaggtcgccatctggagggtggcggcctcagagtacgcggaggtgacgcagcacgggtcataccactacataacaggactcaccactgataacttgaaagtcccctgccaactaccctctcccgagttcttttcctgggtggacggagtgcagatccataggtttgcccccacaccgaagccgtttttccgggatgaggtctcgttctgcgttgggcttaattcatttgtcgtcgggtcccagcttccttgcgaccctgaacccgacacagacgtattgatgtccatgctaacagatccatctcatatcacggcggagactgcagcgcggcgtttagcgcgggggtcacccccatccgaggcaagctcctcggcgagccagctatcggcaccatcgctgcgagccacctgcaccacccacggcaaagcctatgatgtggacatggtggatgctaacctgttcatggggggcgatgtgactcggatagagtctgggtccaaagtggtcgttctggactctctcgacccaatggtcgaagaaaggagcgaccttgagccttcgataccatcagaatacatgctccccaagaagaggttcccaccagctttaccggcctgggcacggcctgattacaacccaccgcttgtggaatcgtggaaaaggccagattaccaaccggccactgttgcgggctgtgctctccctcctcctaggaaaaccccgacgcctcccccaaggaggcgccggacagtgggcctaagtgaggactccataggagatgcccttcaacagctggccattaagtcctttggccagccccccccaagcggcgattcaggcctttccacgggggcgggcgctgccgattccggcagtcagacgcctcctgatgagttggccctttcggagacaggttccatctcttccatgccccccctcgagggggagcttggagatccagacctggagcctgagcaggtagagccccaaccccccccccaggggggggtggcagctcccggctcggactcggggtcctggtctacttgctccgaggaggacgactccgtcgtgtgctgctccatgtcatactcctggaccggggctctaataactccttgtagtcccgaagaggagaagttaccgattaaccccttgagcaactccctgttgcgatatcacaacaaggtgtactgtaccacaacaaagagcgcctcactaagggctaaaaaggtaacttttgataggatgcaagtgctcgactcctactacgactcagtcttaaaggacattaagctagcggcctccaaggtcaccgcaaggctcctcaccatggaggaggcttgccagttaaccccaccccattctgcaagatctaaatatgggtttggggctaaggaggtccgcagcttgtccgggagggccgttaaccacatcaagtccgtgtggaaggacctcctggaggactcagaaacaccaattcccacaaccattatggccaaaaatgaggtgttctgcgtggaccccaccaaggggggcaagaaagcagctcgccttatcgtttaccctgacctcggcgtcagggtctgcgagaagatggccctttatgacattacacaaaaacttcctcaggcggtgatgggggcttcttatggattccagtattcccccgctcagcgggtagagtttctcttgaaagcatgggcggaaaagaaggaccctatgggtttttcgtatgatacccgatgctttgactcaaccgtcactgagagagacatcaggactgaggagtccatatatcgggcctgctccttgcccgaggaggcccacactgccatacactcgctaactgagagactttacgtgggagggcctatgttcaacagcaagggccaaacctgcgggtacaggcgttgccgcgccagcggggtgctcaccactagcatggggaacaccatcacatgctacgtgaaagccttagcggcttgtaaagctgcagggataatcgcgcccacaatgctggtatgcggcgatgacttggttgtcatctcagaaagccaggggaccgaggaggacgagcggaacctgagagccttcacggaggctatgaccaggtattctgcccctcctggtgacccccccagaccggagtatgatctggagctgataacatcttgctcctcaaatgtgtctgtggcgctgggcccacaaggccgccgcagatactacctgaccagagaccctaccactccaatcgcccgggctgcctgggaaacagttagacactcccctgtcaattcatggctgggaaacatcatccagtacgccccgaccatatgggctcgcatggtcctgatgacacacttcttctccattctcatggctcaagacacgctggaccagaacctcaactttgagatgtacggagcggtgtactccgtgagtcccttggacctcccagctataattgaaaggttacatgggcttgacgctttttctctgcacacatacactccccacgaactgacacgggtggcttcagccctcagaaaacttggggcgccacccctcagagcgtggaagagccgggcacgtgcagtcagggcgtccctcatctcccgtggggggagagcggccgtttgcggtcgatatctcttcaattgggcggtgaagaccaagctcaaactcactccattgccggaagcgcgcctcctggatttatccagctggttcaccgtcggcgccggcgggggcgacatttatcacagcgtgtcgcgtgcccgaccccgcttattgctctttggcctactcctactttttgtaggggtaggccttttcctactccccgctcggtagagcggcacacattagctacactccatagctaactgtcccttttttttttttttttttttttttttttttttttttttttttttttttttttttttttttttttttttttttttttttttttttctttttttctcttttccttctttcttaccttattttactttctttcctggtggctccatcttagccctagtcacggctagctgtgaaaggtccgtgagccgcatgactgcagagagtgccgtaactggtctctctgcagatcatgt

SEQ ID NO: 676 - DNA, 9375 bp, Hepatitis C Virus
ttgggggcgacactccaccatagatcactcccctgtgaggaactactgtcttcacgcagaaagcgtctagccatggcgttagtatgagtgtcgtgcagcctccaggatcccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcatcatgagcacaaatcctaaacctcaaagaaaaaccaaacgtaacaccaaccgtcgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccagcccgagggtagggcctgggctcagcccgggtacccttggcccctctatggcaatgagggcatggggtgggcaggatggctcctgtcaccccgcggctctcggcctagttggggccccacggacccccggcgtaggtcgcgtaatttgggtaaggtcatcgataccctcacatgcggcttcgccgacctcatggggtacattccgctcgtcggcgcccccttagggggcgctgccagggtcctggcacatggtgtccgggttctggaggacggcgtgaactatgcaacagggaatttacccggttgctctttctctatcttcctcttggctctgctgtcctgtttgaccatcccagcctccgcttatgaagtgcgcaacgtgtccggggtataccatgtcacgaacgactgctccaactcaagcattgtgtatgaggtagcggacatgatcatgcatacccccgggtgcgtaccctgcgttcaggagggcaactcctcccgttgctgggtagcgctcactcccacgttggcggctaggaatagcagcatccccactacgacaatacgacgccacgtcgacttgctcgttggggcggctgctttctgctctgccatgtacgtgggggatctttgcggatccgttttcctcgtctcccagctgttcaccttctcgcctcgccggcataggacaatacaagaatgcaattgctcaatctatcccggccacgtgtcaggtcatcgcatggcttgggatatgatgatgaactggtcgcctacaacagccttagtagtgtcgcaattgctccggatcccacaagctgtcgtggatatggtggcaggggcccactggggagtcctagcgggccttgcctactattccatggtggggaattgggctaaggttttgattgtgatgctactcttcgccggcgttgacgggcaaacctacgcgacagggggggcggcagccttcaacacccgcgggctcatgtctttcctcagccctggaccagctcagaaaatccagctcataaaaaccaacggcagttggcacatcaacaggactgccctgaactgcaatgactccctccagactgggtttattgcagcgctgttctacacacacaggttcaactcatccggatgcccagagcgtatggccagctgccgccccattgacaagttcactcaggggtggggtcccatcacttatactgagggtagcaaccaagaccagaggccctattgctggcactacgcacccaaaccgtgtggtatcgtacccgcgtcacaggtgtgtggtccagtgtattgtttcaccccaagcccagttgtagtggggacgaccgatcgcttcggtgtccctacgtatagctggggggagaatgagacagacgtgctactccttaacaacacgcggccgccgcaaggcaactggttcggctgtacatggatgaatagcactgggttcaccaagacatgcgggggccccccgtgtaacatcgggggggaaggcaatgagaccctgacctgtcctacggactgcttccggaagcaccccgaagccacttacacaaaatgtggctcggggccttggctgacacctaggtgcatggttgactacccatacaggctctggcactacccctgcactgttaactttaccatcttcaaggttaggatgtatgtggggggcgtggagcacaggctcaatgctgcatgcaattggacccgaggggagcgttgtgatttggaggacagggatagatcggagctcagcccgctgctgctgtctacaacagagtggcaggtactgccctgttccttcaccaccctaccggctctgtccaccggtttaatccatctccatcagaacatcgtggacgtgcaatatctgtacggtatagggtcggcggttgtctcccttacaatcaaatgggagtatgtcgtgttgctttcccttctcctggcggacgcgcgcgtctgcgcctgcttgtggatgatgctgatgatagcccaggccgaggccgccttagaaaacctggtggtcctcaatgcggcgtccgtggccggagcgcatggcattctctccttccttgtgttcttctgtgccgcctggtacattaagggcaggctagtccctggggcggcatatgctttctatggcgtatggccgctgctcctgctcctgctgacattgccaccgcgagcttacgccatggaccgggagatggctgcatcgtgcggaggcggggtccttgtgggtctggcactcttgaccttatcaccatactataaagtgttcctcgctaggctcatatggtggttgcaatatttcatcaccagagccgaggcgcacttgcaagtgtggatcccccctctcaacgttcggggaggccgcgatgccatcatcctcctcgcgtgcgcagtccacccagagctaatctttgacatcaccaaactgctgctctccatacttggtccgctcatggtgctccaggccagcataatccgagtgccgtacttcgtacgcgctcaagggctcatccgtgcatgcatgttggtgcggaaggtcgccgggggtcattatgtccaaatggccttcatgaagctggccgcactgacaggtacgtacgtgtataaccaccttactccactgcgggattgggcccacgtgggcctacgagacctcgcggtggctgtagagcccgtcgtcttctctgatatggagaccaagatcatcacctggggggcagacaccgcggcgtgtggggatatcatctcgggtctacccgtctccgcccgaaggggaaaggaaatacttcttggaccggccgacaattttgaagagcaggggtggcgactccttgcgcccatcacggcctactcccaacagacacggggcctacttggttgcatcatcactagcctcacgggccgggacaagaaccaggtcgagggggaggttcaagtggtttctaccgcaacacaatctttcctggcgacctgtgttaacggtgcgtgctggactgtcttccacggcgccggctcaaagaccttagctggcccaaaaggcccaatcacccaaatgtacaccaatgtagaccaggacctcgtcggctggccggcgccccctggggcgcgttccctgacaccatgcacctgcggcagctcggacctttacttggtcacgagacacgctgatgtcatcccggtgcgccggcggggcgacactagggggagtttactctctcccaggcctatctcctacttgaagggctcttcgggtggtccactgctctgcccctcggggcatgctgtgggcatctttcgggctgctgtgtgcacccggggggttgcgaaagcggtggacttcatacccgttgaatctatggaaactactatgcggtctccggtgttcacagacaattcatcccccccggccgtaccgcagaccttccaagtggcccatcttcatgcccctactggcagcgggaaaagcactaaggtgccggctgcatatgcagcccaagggtacaaggtactcgtcctgaacccgtccgttgccgctaccttgggttttggggcgtatatgtctaaggcacatggcaccgaccccaacatcagaactggggtaaggaccatcaccacgggcgcccctatcacatactccacctatggcaagttccttgccgacggtggatgctctggaggtgcctatgacatcataatatgtgatgagtgccactcaactgactcgactaccatcttgggcatcggcacagtcctggaccaagcggagacggctggagcgcggctcgtcgtgctcgccaccgctacgcctccgggatcggtcaccgtgccacaccccaacatcgaggaggtggccctgtccaacactggagagatccccttctacggcaaagccatccccattgacctcatcaaggggggaaggcatctcattttctgccattccaagaagaagtgtgacgagcttgccgggaaactgtcagccctcggactcaatgctgtagcatattaccgggggcttgacgtgtccgtcataccgaccagcggagacgtcgttgtcgtggcgacagacgctctgatgacgggctttaccggcgactttgactcagtgatcgactgtaacacatgtgtcacccagacagtcgatttcagcttggatcccaccttcaccattgagacaacgaccgtgccccaagacgcggtgtcacgctcgcaacggcgaggtaggactggcaggggtaggagaggtatctacaggtttgtgactccaggcgagcggccctcgggcatgttcgattcctcggtcctgtgtgagtgctatgacgcgggctgcgcttggtacgagctcacgcccgcggagacttcagttaggttgcgggcttacctaaatacaccagggttgcccgtctgccaggaccatctggagttttgggaaagtgtcttcacaggccttacccacatagatgcccattttctgtcccagactaagcaggcaggagacaacttcccctacctggtagcataccaagctacggtgtgtgccagagctcaggctccacctccatcgtgggaccaaatgtggaagtgtctcatacggcttaaacctacgttgcatgggccaacacccttgctgtataggttaggggccgtccagaatgaggtcaccctcacacaccccataaccaaatacatcatggcatgcatgtcggccgacctggaggtcgtcactagcacctgggtgctggtaggcggagtccttgcagctctggccgcatattgcttgacaacaggcagcgtggtcattgtgggtaggatcatcttgtccgggagaccggctgttgttcccgacagagaagttctctaccggcagtttgatgagatggaagagtgtgccacacacctcccttacatcgaacagggaatgcagctcgccgagcaattcaaacagaaagcgctcgggttgttgcaaacagcctccaagcaagcggaagctgctgctcccgtggtggaatccaaatggcgagccctcgagaccttctgggcgaagcacatgtggaatttcatcagcgggatacagtacttagcaggcttatccactctgcctgggaatcccgcgatagcatcactgatggcattcacagcctccattaccagcccgctcaccacccaaaacaccctcctattcaacatcttggggggatgggtggctgcccaactcgcccctcccagcgctgcttcggctttcgtgggcgccggcattgccggtgcggctgttggcagcataggccttgggaaggtgcttgtggacatcttggcgggctatggggcaggggtggctggtgcgctcgtagctttcaagatcatgagcggcgaggtgccctccaccgaggacctggttaatctactccctgccatcctctctcccggcgccctggttgtgggggtcgtgtgtgcagcgatcctacgtcggcacgtgggcccgggagagggggccgtgcagtggatgaaccggttgatagcgttcgcttcgcggggtaaccacgtctcccccacgcactatgtgcctgagagcgacgctgcagcgcgtgttactcagatcctctccagccttaccatcactcagctgctgaagaggctccaccagtggatcaatgaggactgctccacgccatgctccggctcgtggctaagggatgtttgggactggatatgcacggtgttgtctgacttcaagacctggctccagtccaagctcctgccgcggttgccgggagtccctttcctctcatgccaacgtgggtacaagggagtctggcggggggacggcatcatgcaaaccacctgtccatgtggagcacagatcaccggacatgtcaagaacggttccatgaggattgttgggcctaaaacctgcagcaacacgtggcatggaacattccccatcaacgcatacaccacgggcccctgcacaccctccccagcgccaaactattctagggcgctgtggcgggtggctgctgaggagtacgtggaggttacgcgggtgggggatttccactacgtgacgggcatgaccactgacaacgtaaaatgcccatgccaggtcccggcccccgaattcttcactgaggtggatggagtgcggctgcacaggtacgctccggcgtgcaaacctctcctacgggaggaggtcgtattccaggtcgggctcaaccaatacttggttggatcacagctcccgtgtgagcctgaaccggatgtagcagtgctcacctccatgctcaccgacccctcccacatcacagcagagacggccaagcgtaggctggccagggggtctcccccctccttggccagctcttcagccagccagttgtctgcgccttccttgaaggcgacttgtactacccatcatgactccccggacgccgacctcatcgaggccaacctcctgtggcggcaggagatgggcgggaacatcacccgcgtggagtcagagaataaggtagtaattctggactctttcgatccgcttcgagcggaggaggatgagagggaaatatctgttgcggcggagatcctgcggaaatccaggaatttcccctcagcgatgcccgtatgggcacgcccggattacaaccctcccctgctagagtcctggaaggacccggactacgtccccccggtggtgcacgggtgcccattgccacctaccaagggccctccaataccacccccccggaggaagaggacggttgtcctgacagagtccaccgtgtcttctgccttggcggagctcgctactaagaccttcggcagctccggatcgtcggccgtcgacagcggcacggcgaccgctcctcccgaccaggcctccgacgacggcgacaaagggtccgacgttgagtcgtactcctccatgcccccccttgagggagagccgggggaccccgatctcagcgacgggtcttggtctaccgtgagcgaggaggccagcgaggacgtggtctgctgctcaatgtcctacacatggacaggcgccctgatcacgccatgcgctgcggaggaaagcaagttgcccatcaacccgttgagcaactctctgttgcgtcaccacaacatggtctatgctactacatcccgcagcgcagtcctccggcagaagaaggtcacctttgacagactgcaagtcctggacgaccactaccgggacgtgctcaaggagatgaaggcgaaggcgtccacagttaaggctaaacttctatctgtagaagaagcctgcaagctgacgcccccacattcggccagatctaagtttggctatggggcaaaggacgtccggaacctaaccggcaaggccgttaaccacatccgctccgtgtggaaggacttgctggaagacactgagacaccaattgacaccaccatcatggcaaaaagtgaggtcttctgtgtccaaccagagaaaggaggccgcaagccagctcgctttatcgtattcccggacctgggagttcgtgtatgcgagaagatggccctttatgacgtggtctccaccctccctcaggccgtgatgggctcctcatacggattccagtactcccctggacagcgggttgagttcctggtgaatgcctggaaatcaaagaaatgccctatgggcttctcatatgacacccgctgttttgactcaacggtcactgagaatgacatccgtgttgaggagtcaatttatcaatgttgtgacttggcccccgaagccagacaggtcataaagtcgctcacagagcggctctatatcgggggtcccctgactaattcaaaggggcagaactgcggttatcgccggtgccgtgcaagcggcgtgctgacgaccagctgcggtaataccctcacatgctacttgaaggcctctgcagcctgtcgagctgcaaagctccaggactgcacgatgctcgtgaacggagacgatcttgtcgttatctgtgaaagcgcgggaacccaagaggatgaggcgagcctacgagtcttcacggaggctatgactaggtactcagcccctcccggggacctgccccaaccagaatacgacttggagttgataacatcatgctcctccaatgtgtccgtcgcgcacgatgcatctggcaaaagggtgtactacctcacccgagatcccgccaccccccttgcacgggctgcgtgggagacagctagacacactccagtcaactcctggctaggcaatatcatcatgtatgcgcccaccttatgggcaaggatggttctgatgactcacttcttctccatcctcctagctcaggagcaacttgaaaaaaccctggattgtcagatctacggggcctgttactccattgagccacttgacctacctcagatcattgagcgactccatggtcttagcgcattttcactccatagttactctccaggtgagatcaatagggtggcttcatgcctcaggaaacttggggtaccacccttgcgagtctggagacatcgggccagaagtgtccgcgctaagctactgtcccagggggggagggctgccacttgtggcaagtacctcttcaactgggcagtaaagaccaagctcaaactcactccaattccggctgcgtcccagttggacttgtccaactggttcgttgctggttacaacgggggagacatatatcacagcctgtctcgtgcccgaccccgttggttcatgttgtgcctactcctactttctgtaggggtaggcatctacctgctccccaatcggtgaacggggagctaac

SEQ ID NO: 677 - DNA, 9374 bp, Hepatitis C Virus
ttgggggcgacattccaccatagatcactcccctgtgaggaactactgtcttcacgcagaaagcgtttagccatggcgttagtatgagtgtcgtgcagcttccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcatcatgagcacaaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggttcgccagcccgagggcaggacctgggctcagcccgggtacccttggcccctctatggcaacgagggcatggggtgggcaggatggctcctgtcaccccgtggctcccggcctagttggggccccacagacccccggcgtaggtcgcgtaatttgggtaaggtcatcgataccctcacatgcggcttcgccgacctcatggggtacattccgctcgtcggcgcccccctagggggcgctgccagggtcttggcacatggtgtccgggttctggaggacggcgtgaactatgcaacagggaatttacccggttgctctttctctatcttcctcttggctctgctgtcctgtttgaccaccccagcttccgcttatgaagtgcgcaacgtgtccgggatgtaccatgtcacgaacgactgctccaactcaagcattgtgtatgaggcggcggacatgatcatgcatgcccccgggtgcgtgccttgcgttcgggagaacaactcctcccgttgctgggtagcgctcactcccacgcttgcggccaggaacgccagcgtccccactacgacaatacgacgccacgtcgacttgctcgttggggcggctgctttctgttccgctatgtacgtgggggatctctgcggatctgtttttctcatctcccagctgttcaccttctcgcctcgccggcatgagacagtacaggactgcaattgctcgatctatcccggccacgtatcaggccatcgcatggcttgggatatgatgatgaattggtcacccacagcagccttagtggtgtcgcagttactccggatcccacaagccgtcgtggacgtggtggcaggggcccactggggggtcctggcgggccttgcctactattccatggcggggaactgggctaaggttttgattgtgatgctgctctttgccggcgttgacggccagacccgtatatcgggggggacgcaaggccacaccacctctggcctcgtatccctcttttcatctgggtcgtctcagaacatccagcttataaacaccaatggtagttggcacatcaacaggaccgccctgaactgcaatgactccctcaacaccgggttccttgccgcgctgttctacacacacaagttcaacgcgtccggatgcccggcgcgcatggccagctgccgttccattgacacgttcgctcaggggtgggggcccatcacctatgctcaacccagcatctcggaccagaggccttattgctggcactacgcacctcggcagtgtggtatcgtacccgcgtcgcaggtgtgtggtccagtatactgctttaccccaagccctgttgtggtggggacgaccgatcgctccggtgtccctacgtatagctggggggagaatgagacagatgtgctgctcctcaacaacacgcggccgccgcaaggcaactggttcggttgtacatggatgaatagcactgggttcaccaagacgtgcggggggcccccgtgtaacatcgggggggtcggcaacaacaccttgacctgccccacggactgcttccggaagcaccctgaggccacttacacaaaatgtggctcgggtccttggttgacacctagatgcctagttgactacccatacaggctctggcactacccctgcactgtcaatttttccatcttcaaggttaggatgtacgtggggggagtggagcacaggctcaatgctgcatgcaactggactcgaggagaacgttgtggcctggaggacagggatagatcagagctcagcccgctgctgctgtctacgacagagtggcaggtattgccctgttcctttaccaccctaccggctctgtccactggcttaatccacctccatcagaacgtcgtggacgtgcaatacctgtacggtatagggtcagcggttgtctcctttgtagtcaaatgggattatgtcgtgctgcttttccttctcctggcggatgcgcgcgtctgtgcctgtttgtggatgatgctgctgatagcccaggctgaggccgccttagagaacctggtggtcctcaatgcggcgtccgtggccggagcgcatggctttctctccttccttgtgttcttctgcgccgcctggtacatcaagggcaggctggtccctggagcggcatatgctctctacggcgtatggccgttgctcctgctcctgctggcgttgccaccacgggcttacgccatggaccgagagatggctgcatcttgcggaggcgcggtccttgtaggtctgatgatcttgaccttgtcaccatactataaagtgttcctcgctaggctcatatggtggttacaatatcttatcaccagagccgaggcgcacttgcaagtgtgggtcccccccctcaacgttcggggaggccgcgacgccatcatcttcctcacgtgcgcgacccacccagagctaatctttgacatcaccaaactcctgctcgccatactcggtccgctcatggtgctccaggccggcataactagagtgccgtacttcgtacgcgctcaagggctcatccgtgcatgcatgttagtgcggaaggtcgctgggggtcattatgtccaaatggccttcatgaagctggccgcgctgacaggcacgtacgtttatgaccatcttactccactgcggggttgggcccacacgggcctacgggaccttgcggtggcagtagagcccgttgtcttctctgacatggagaccaagatcatcacatggggggcggacaccgcggcgtgtggtgacatcatcttgggcctacccgtctccgcccgtaggggaagggagatacttctgggacccgccgacagtctcgaggggcaggggtggcgactccttgcgcccatcactgcctactcccaacagacgcggggcctgcttggttgcatcatcaccagcctcacaggccgggacaagaaccaagtcgagggggaggttcaagtggtttctaccgcaacacaaactttcctggcgacctgtgtcaacggcgtgtgttggactgtctttcatggcgccggctcaaagaccctagccggcccaaaaggtccaatcacccaaatgtacaccaatgtggaccaggacctcgtcggctggcaggcgccccccggggcgcgttccatgacaccatgcacctgcggcagctcggacctttacttagtcacgagacatgctgatgttattccggtgcgccggcggggcgacggtaggggaagcctactctcccccaggcccgtctcttacttgaagggctcttcgggtggtccgctgctctgcccttcggggcacgttgtgggcatcttccgagccgctgtgtgcacccggggggttgcgaaggcagtggacttcgtgcccgttgagtctatggagaccactatgcggtctccggtcttcacagacaactcatcccccccagctgtaccgcagacattccaagtggcccatctgcacgcccctactggcagcggtaagagcaccaaagtaccggctgcatacgcagcccaagggtacaaggtactcgtcctgaacccgtccgttgcagccactttaggttttggggcgtatatgtctaaggcatatggcactgaccctaacatccgaactggggtaaggaccatcaccacgggcgcccccattacatactccacctatggcaagttccttgccgatggcggttgctccgggggcgcctatgatatcataatatgtgatgagtgccactcaactgactcgaccaccattttgggcatcggcacagtcctggaccaagcggagacggctggagcgcggcttgtcgtgctcgccaccgctacacctccgggatcggtcaccgtgccacaccccaatatcgaggaggtagccctgtccaacactggggagatccccttctatggcaaagccatccccatcgagaccatcaaggggggaaggcatctcatcttctgccattccaagaagaagtgtgatgagctcgccgcaaagctatcggccctcggaatcaatgctgtagcgtattaccgaggtcttgatgtgtccgtcataccgactagcggagacgtcgttgtcgtggcaacagacgctctaatgacgggctttaccggcgactttgactcagtgatcgactgtaacacatgtgtcacccagacagtcgacttcagcttggatcccaccttcaccatcgacacgacgaccgtgccccaagatgcggtctcgcgcacgcagcggcggggcagaactggcaggggtaggagaggcatctacaggtttgtgactccaggagagcggccctcgggcatgttcgattcctcggtcctctgtgagtgttatgacgcgggctgtgcttggtacgagctcacgcccgctgagacctcggttaggttgcgggcttacctaaatacaccagggttgcccgtctgccaggaccatctggagttctgggagggcgtctttacaggcctcacccgcatagatgcccacttcctgtcccagactaagcaggcaggagacaacttcccctacatggtagcataccaagccacggtatgcgccagggctcaggctccacctccatcgtgggaccaaatgtggaagtgcctcacacggctaaagcctactttgcacgggccaacgcccctgctatataggctaggagccgtccaaaatgaggtcaccctcacacaccccataaccaaatacatcatgacatgcatgtcggctgacctggaggtcgtcaccagcacctgggtgctggtaggcggagttcttgcagcactggccgcgtattgcctgacaacaggcagcgtggtcattgtgggtaggatcatcttgtccgggaggccggccattattcccgatagggaagtcctctaccgggagttcgatgaaatggaggagtgcgcctcacaacttccttacatcgaacagggaatgcagctcgccgagcaattcaaacagaaggcgctcgggttgctgcaaacagctaccaagcaagcggaggctgctgctcccgtggtggaatccaagtggcgagccctcgaggccttctgggggaagcacatgtggaatttcattagcgggatacagtacttagcaggcttgtccactctgcctgggaaccccgcaatagcatcactgatggcattcacagcctctgtcaccagcccgctcaccacccaaagtaccctcctgtttaacatcttggggggatgggtggctgcccaactcgctccccccagcgctgcttcggctttcgtgggcgccggtattgccggtgcggctgtaggcagcataggcctcgggaaggtgcttgtggacatcctggcgggctatggggcaggagtggctggcgcactcgtggcctttaaggtcatgagcggcgagatgccctccactgaggacctggttaatttactccctgccatcctctctcctggcgccctggtcgtcggggtcgtgtgcgcagcaatactgcgtcggcacgtgggcccgggagagggggctgtgcagtggatgaaccggctgatagcgttcgcctcgcggggtaaccacgtctcccccacgcactatgtgcctgagagcgacgccgcagcacgtgttactcagatcctctccaaccttaccatcactcagctgctgaggaggcttcaccagtggattaatgaggactgctccacgccatgctccggctcgtggctaagggatgtttgggactggatatgcacggtgttgtctgacttcaagacctggctccagtccaagctcctgccgcggctgccgggagtccctttcctctcatgccaacgtgggtacaagggagtctggcggggggacggcatcatgcaaaccacctgtccatgtggagcacagatcaccggacatgtcaagaacggttccatgaggattgttgggcctaaaacctgcagcaacacgtggcatggaacattccccatcaacgcatacaccacgggcccctgcacaccctccccagcgccaaactattctagggcgctgtggcgggtggctgctgaggagtacgtggaggttacgcgggtgggggatttccactacgtgacgggcatgaccactgacaacgtaaaatgcccatgccaggtcccggcccccgaattcttcactgaggtggatggagtgcggctgcacaggtacgctccggcgtgcaaacctctcctacgggaggaggtcacattccaggtggggctcaaccagtacctggttgggtcacagctcccatgcgagcccgaaccggacgtggcagtgctcacttccatgcttaccgacccctcccacattacagcagagacagctaagcgtaggttggccagggggtctcccccctccttggccagctcttcagctagccagttgtctgcgccctccttgaaggcgacatgcactacccaccatgactccccggacgctgacctcatcgaggccaacctcctgtggcggcaggagatgggcgggaacatcacccgcgtggagtcagagaataaggtagtaattctggactctttcgatccgctccgggcggaggaggatgagagggaaatatccgttccggcggagatcctgcggaaacccaggaagttccccccagcgttgcccatatgggcacgcccggattacaaccctccactgctagagtcctggaaggacccggactacgtccctccggtggtgcacgggtgcccattgccacctaccaaggggcctccattaccacctccacggagaaagaggacagttgtcctaacagagtccaccgtgtcttctgccctggcggagcttgctactaagacctttggcagctccgggtcgtcggccgccgacagtggcacggcgaccgcccctcctgatcagacctctgacgacggcgacaaaggatccgacgttgagtcgtactcctccatgccccccctcgagggagagccgggggaccccgatctcagcgatgggtcttggtctaccgtgagcgaggaagctggtgaggacgtcgtctgctgctcaatgtcctacacatggacaggcgccctgattacgccatgcgctgcggaggaaagcaagctgcccatcaacgcgctgagcaactctttgctgcgtcaccacaacatggtctatgctacaacatcccgcagcgcatgccagcggcagaagaaggtcacctttgacagactgcaagtcctggacgaccactaccgggacgtgctcaaggagatgaaggcgaaggcgtccacagtgaaggctaaacttctatctgtagaggaagcctgcaagctgacgcccccacattcggccaaatccaaatttggctacggggcaaaggacgtccggaacctatccagcaaggccgttaaccacatccgctccgtgtggaaggacttgctggaggacactgagacaccaattaacaccaccgtcatggcaaaaaatgaggttttctgcgtccaaccagagaaaggaggccgcaaacccgctcgccttatcgtattcccagacctgggagttcgtgtgtgcgagaagatggccctttacgacgtggtttccacccttcctcaggccgtgatgggctcctcatacggattccagtactctcctgggcagcgggtcgagttcctggtgaatacctggaaatcaaagaaatgccccatgggcttttcatatgacacccgttgttttgactcaacggtcactgagaatgacatccgtgttgaggagtcaatttatcaatgttgtgacttggcccccgaagctagacaggtcataaggtcgctcacagagcggctctatgtcgggggtcccctgaccaattcaaaagggcagaactgcggttatcgccggtgccgcgcgagcggagtactgacgactagctgcggcaataccctcacatgctacttgaaggcctctgcggcctgtcgagctgcgaagctccaggactgcacgatgctcgtgaacggagacgaccttgtcgttatctgtgagagcgcgggaacccaagaggatgcggcgagcctacgagtcttcacggaggctatgactaggtactctgccccccccggggacccgccccaaccagaatacgacttggagttgataacatcatgctcctccaatgtgtcggtcgcgcacgatgcatctggcaagagggtgtactacctcacccgtgaccccaccaccccccttgcacgggccgcgtgggagacagctagacacactccagttaactcctggctaggcaatatcatcatgtatgcgcccactttgtgggcaaggatgattctgatgactcatttcttctccatcctcctagcccaggaacaacttgagaaagccctggattgtcagatctacggggcctgttactccattgagccacttgacctacctcagatcattgagcgactccatggtcttagcgcattttcactccatagttactctccaggtgagatcaatagggtggcttcatgcctcaggaagcttggggtaccacccttgcgagtctggagacatcgggccagaagtgtccgcgctaagctactgtcccagggggggagggctgccacttgtggcaagtacctcttcaactgggcagtaaggaccaagcttaaactcactccaatcccggctgcgtcccggctggacttgtccggttggttcgtagctggttacagcgggggagacatatatcacagcctgtctcgtgcccgaccccgctggttcatgttgtgcctactcctactttccgtaggggtaggcatctacctgctccccaaccggtgaacggggagctaa

SEQ ID NO: 678 - DNA, 9375 bp, Hepatitis C Virus
ttgggggcgacactccaccatagatcactcccctgtgaggaactattgtcttcacgcagaaagcgtctagccatggcgttagtatgagtgtcgtacaacctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggccagatcgttggtggagtttacctgttgccgcgcaggggccccaggttgggtgtgcgcgcgactaggaagacttccgagcggtcgcaacctcgtggaaggcgacaacctatccccaaggctcgccagcccgagggcaggacctgggcccagcccgggtatccttggcccctctatggcaacgagggcatggggtgggcaggatggctcctgtcaccccgtggctctcggcctagctggggccccacggacccccggcgtaggtcgcgtaatttgggtaaggtcatcgataccctcacgtgcggcttcgccgacctcatggggtacattccgctcgtcggcgcccccctagggggcgccgccagggccttggcacatggtgtccgggttctggaagacggcgtgaattatgcaacagggaatttacccggttgctctttctctatcttcctcttggctctgctgtcctgtttgaccatcccagcatccgcttatgaagtgcgcaacgtatccgggatataccatgtcacgaacgactgctccaacacaagtattgtgtatgaggcggcggacatgatcatgcacacccccgggtgcgtgccctgcgttcgggaaggtaattcctcccgttgctgggtagcgctcacccccacgctcgcggccaggaatagcagcgtccccactacggcaatacgacgccacgtcgacttgctcgttggggcggctgctttctgttccgctatgtacgtgggggatctctgcggatctgtcttcctcgtctctcagctgttcaccttctcacctcgccggcatgagacaacacaggactgcaattgctcaatctatcccggccacttaacaggtcaccgtatggcttgggatatgatgatgaactggtcacctacaacagccatagtggtgtcgcagttactccggatcccgcaagctgtcgtggatatggtggcgggggcccactggggagtcctggcgggccttgcctactactccatggcggggaactgggctaaggttttgattgtgatgctgctctttgctggcgttgacggggaaacccgtgtgacagggggggcggcagcccgggccacctccgggttcgcgtccctcttcagatctgggtcgtctcagaatatccagcttataaacaccaatggcagttggcatatcaacaggactgccctgaactgcaatgattccctccagaccgggttcctcgccgcgctgttctacacacacaagttcaacgcgtccggatgcccagagcgcatggccagctgtcgctccattgataagtttgatcaggggtggggtcccatcacttatgccgagcctagcaattcggaccagaggccttattgctggcactacgcacctcgacagtgtggtatcgtacccgcgtcgcaggtatgtggtccagtatattgtttcacccctagccctgttgtggtggggacgaccgatcggttcggtgtccctacgtacagctggggggagaatgagacagacgtgctgctcctcaacaacacgcggccgccgcaaggcaactggttcggctgtacatggatgaatagcactgggttcaccaagacgtgtgggggccccccgtgtgacatcgggggggtcggcaacaacaccttgacctgccccacggactgcttccggaagcatcccgaggccacttacacaaaatgtggctcggggccttggttgacacctaggtgcttagttaactacccatataggctttggcactacccctgcactgtcaattttaccatcttcaaggttaggatgtatgtggggggcgtggagcacaggctcgaggctgcatgcaattggactagaggggagcgctgcgacttggatgacagggatagatctgaactcagcccgctgctgctgtctacgacggagtggcagatactgccctgttccttcaccaccctaccggctctgtccactggtttgatccatctccatcggaacatcgtggacgtgcagtacctgtacggtatagggtcggcggttgtctccttcgccatcaaatgggagtatgtcctgctgctcttcctccttttggcggacgcgcgcgtctgtgcctgcttgtggatgatgctgctgatagcccaggctgaggccgccttagagaacctggtggtcctcaatgcggcgtccgtggccgggacgcgcggcattctctccttccttgtgtttttctgcgccgcctggtacatcaagggcaggctggtccctggggcggcatatgctctctatggcgtatggccgctgctcatgctcctgttggcattaccaccacgggcttacgccatggaccgggagatggctggatcgtgtggaggcgcggttttcgtaggtctggcactcttgaccttgtcaccatactataaagtgttcctcgctaggatcatatggtggttacaatatcttatcaccagagctgaggcgcacttgcatgtgtgggtcccccctctcaacgttcgaggaggccgcgatgccatcatcctcctcacgtgcgcagtccacccagagctaatctttgacatcaccaaactcctgctcgccatactcggtccacttatggtgttccaggctggcataactagagtgccgtactttgtgcgcgctcaggggctcattcgtgcatgcatgttagtgcggaaggtcgtcgggggtcattatgttcaaatggccttcatgaagctggccgcgctgacaggcacgtacgtttatgaccatctcaccccactgcgggattgggcccacacgggcctacgagaccttgcggtggcggtggagcctgttgtcttctctgacatggagaccaagatcatcacctggggggcagacaccgcggcgtgtggggacatcatttcgggcctacccgtctccgcccgaaggggaaaggagatacttcttgggccggccgacagtcttgaggggcaggggtggcggctccttgctcccatcacggcctactctcaacagacgcggggtatgcttggttgcatcatcaccagcctcacgggccgggacaagaatcaagtcgagggggaggttcaagtggtctccaccgcgacgcaatctttcctggcgacctgcgtcaacggcgcgtgctggactgtttatcatggcgccggctcaaagaccctagctggcccaaaaggtccaatcactcagatgtataccaatgtagaccaggacctcgtcggctggcaggcgccccccggggcgcgttccttgacaccgtgcacctgcggcagctcggacctttacttggtcacgagacacgctgatgtcattccggtgcgccggcggggcgacggcaggggaagtctactctcccccaggcccgtctcctacttgaagggctcttcgggtggcccactgctctgcccttcggggcacgttgtgggcatcttccgggctgctgtgtgcacccggggggtagcgaaggcggtagacttcgtacccgttgagtctatggaaaccaccatgcggtctccggtcttcacagacaattcatctcccccggccgtaccgcagacattccaagtaggccatttacatgcccccactggcagtggcaagagcaccaaggtgccggctgcatatgcagctcaagggtacaaggtactcgtcttgaacccgtccgtcgccgccaccttaggttttggggcgtatatgtctaaggcacatggtgtcgaccctaacatcagaactggggtaaggaccatcaccacgggcgcccccatcacgtactccacctatggcaagttccttgccgacggtggttgctccgggggcgcctatgacatcataatatgtgatgagtgccactcaactgactcgactaccatcttgggcattggcacagtcctggaccaagcggagacggctggagcgcggctcgtcgtgctcgccaccgctacgcctccgggatcggtcaccgtgccacaccccaatatcgaggaggcggccctgtccaacactggagagatccccttctatggtaaagccatccccatcgaaaccatcaaggggggaaggcatctcatcttctgtcactccaagaagaagtgtgacgagctcgccgcaaagctgtcaggcctcgggctcaatgctgtagcatattaccggggtcttgatgtgtccgtcataccgactagcggagacgtcgttgtcgtggcaacagacgctctaatgacgggctacaccggcgactttgactcagtgatcgactgtaacacatgtgtcacccagacagtcgacttcagcttggatcccaccttcaccattgagacgacaaccgtgccccaagacgcggtgtcgcgctcacagcggcgaggtaggactggcagaggcaggagaggcatctacaggtttgtgaccccgggtgaacgaccctcaggcatgttcgactcctcggtcctgtgtgagtgctatgacgcgggctgtgcttggtacgagctcacgcccgctgagacctcggttaggttgcgggcttacttgaatacaccagggttgcccgtctgccaggaccatttggagttctgggagagcgtctttacaggcctcacccatatagatgcccacttcttgtcccagactaaacaggcaggagacaacttcccctacctggtggcataccaagctacggtgtgcgccagggcccaggccccacctccatcgtgggatcaaatgtggaagtgtctcacacggctaaagcctacactgcacgggccgacacccctgctgtataggctaggagccgtccaaaatgaggtcaccctcacacaccccataaccaaatacatcatggcatgcatgtcggctgacctggaggtcgtcacgagcacctgggtgctggtaggcggggtccttgcagctctggccgcgtactgcctgacaacaggcagcgtggtcattgtgggtaggatcatcctgtccgggaggccggctgtcattcctgatagggaagtcctttaccgggagttcgatgaaatggaagagtgtgcctcacaccttccctacatcgaacagggaatgcagctcgctgagcaattcaagcagaaggcgctcgggttgctgcaaacagccaccaagcaagcggaggctgctgctcccgcggtggagtccaagtggcgagccctcgagaccttctgggcgaagcacatgtggaacttcatcagcgggatacagtacctagcaggcttatccactctgcctgggaaccccgcgatagcatcactgatggcattcacagcctctgtcaccagcccgctcaccacccaaaataccctcctgtttaacatcttggggggatgggtggctgcccaactcgctccccccagcgctgcttcggcttttgtgggcgccggcatcgccggcgcagctgttggcagcataggccttgggaaggtgcttgtggacatcctggcgggatatggggcgggggtggctggcgcactcgtggcctttaaggtcatgagcggcgagacgccctccgccgaggaactggtcaatttgctccctgccatcctctctcccggtgccttggtcgtcggggtcgtgtgcgcagcaatactgcgccggcacgtgggcccgggagagggggctgtgcagtggatgaaccggctgatagcgttcgcttcgcggggcaaccacgtctcccccacgcactatgtgcctgagagcgacgccgcagcgcgtgttactcagattctctccagccttaccatcacccagctgctgaagaggcttcaccagtggattaatgaggactgctccacgccatgctccggctcgtggctgagagatgtttgggactggatatgcacggtgctagctgacttcaaggcctggcttcagtccaagctcttgccgcggctgccgggagtccctttcttctcatgccaacgtgggtacaagggagtctggcggggggacggcatcatgcagaccacctgcccatgcggagcacagatcaccggacatgtcaaaaacggttccatgaggatcgttgggccaagaacctgcagcaacacgtggcatggaacattccccatcaacgcgtacaccacgggcccctgcacaccctccccggcgccgaactattccagggcgctgtggcgggtggccgctgaggagtacgtggaggtcacgcgggtgggggatttccattacgtgacgggcatgaccactgacaacgtaaagtgcccatgccaggtcccggcccccgaattcttcacggaagtggatggggtgcggttgcacaggtacgctccggcgtgcaaacctctcctacgggaggaggtcacattccaggtggggctcaaccagtacctggtagggtcacagctcccatgtgagcccgagccggatgtggcagtgttcacttccatgctcaccgacccttcccacatcacagcagagacagctaagcgtaggctggctagggggtctcccccttccttagccagttcttcagctagccaactgtctgcgccctccttgaaggcgacatgcactacccaccatgactccccggacgctgacctcatcgaggccaacctcctgtggcggcaggagatgggcggaaacatcacccgcgtggagtcagagaacaaggtagtaattctggactctttcgatccgctccgagcggaggaggatgagagggaagtgtccgttccggcggagatcctgcggaagtccaggaagttcccctcagcgctgcccatatgggcgcgcccggactacaaccctccagtgctagagtcctggaaggacccggactacgtccctccggtggtacacgggtgcccattgccacctaccaaggcccctccaataccgcctccacggaggaaaaggacggttgtcctgacagagtccactgtgtctgctgctttggcggagctcgccactaagaccttcggcagctccgaatcgtctgccgccgacagcggcacggcgaccgcccctcctgaccaagcctccgacgacggcgacaaagaatccgacgttgagtcgtactcctccatgcccccccttgagggagagccgggggatcccgatctcagtgacgggtcttggtctaccgtgagtgaggaggccagtgaggacgtcgtctgttgctcaatgtcctacacatggacaggtgccctgatcacaccatgcgctgcggaggagagcaaactgcccatcaacccgttgagcaactccttgctgcgtcaccacaacatggtgtatgccacaacatcccgcagtgcaggcctgcggcagaagaaggtcacctttgacagactgcaagtcctggacgaccactaccgggacgtgctcaaggagatgaaggcgaaggcgtccacggttaaggctaaacttctatctgtagaagaagcctgtaagctgacgcccccacattcggccaaatccaaatttggctacggggcaaaggacgtccggaacctatccggcaaggccgttaaccacatccgctccgtgtggaaggacttgctggaagacactgagacaccaattgataccaccatcatggcaaaaaatgaggttttctgcgtccaaccagagaaaggaggccgcaagccagctcgccttatcgtattcccagacctgggagttcgtgtatgcgagaagatggctctttacgacgtggtctccacccttcctcaggccgtgatgggctcctcatacggattccagtactctcccaagcagcgggtcgagttcctggtgaatacctggaagtcaaagaaatgccctatgggcttctcatatgacacccgttgttttgactcaacggtcactgagagtgacatccgtgtggaggagtcaatttaccaatgttgtgacttggcccccgaagccagacaggccataaggtcgctcacggagcggctctacatcgggggtcccctgactaattcaaaagggcagaactgcggttatcgccggtgccgcgcaagcggcgtactgacgaccagctgcggtaataccctcacatgttacttgaaggccactgcagcctgtcgagctgcgaagctccaggactgcacgatgctcgtgaacggcgacgaccttgtcgttatctgtgaaagcgcggggacccaggaggatgcggcgagcctacgagccttcacggaggctatgactaggtactctgccccccccggggacctgccccaaccagaatacgacttggagctgataacatcatgttcctccaatgtgtcggtcgcgcacgatgcatctggcaaaagggtgtactacctcactcgtgaccccaccaccccccttgcacgggctgcgtgggagacagctagacacactccagtcaactcctggctaggcaatatcatcatgtatgcgcccactttgtgggcaaggatggttctgatgactcatttcttctccatcctcctagcgcaggaacaacttgacaaagccctggattgtcagatctacggggcctgttactccattgagccacttgacctacctcagatcattgaacgactccatggtcttagcgcattttcactccatagttactctccaggtgagatcaatagggtggcttcatgcctcaggaaacttggggtaccacccttgcgagtctggagacatcgggccagaagtgtccgcgctaagctactgtcccagggggggagggctgccacttgtggcaagtacctcttcaattgggcagtaaggaccaagcttaaactcactccaaacccggctgcgtcccggttggacttgtccggctggttcgttgctggttacaacgggggagacatatatcacagcctgtctcgtgcccgaccccgttggtttatgttgtgcctactcctactttctgtgggggtaggcatttacctgctccccaaccggtgaacggggagctaac

SEQ ID NO: 679 - DNA, 9379 bp, Hepatitis C Virus
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggatgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcatcatgagcacaaatcctaaacctcaaagaagaaccaaacgtaacaccaaccgccgcccacaggacgtcaagttcccgggcggtggtcagatcgttggtggagtttacctgttgccgcgcaggggccccaagttgggtgtgcgcgcgactaggaagacttccgagcggtcgcaacctcgtggaaggcgacaacctatccccaaggctcgccggcccgagggcagggcctgggcccagcccgggtacccctggcccctctatggcaatgagggtctggggtgggcaggatggctcctgtcaccccgaggctctcggcctagttggggccccacggacccccggcgtaggtcgcgtaatctgggtaaggtcatcgatacccttacatgcggcttcgccgacctcatggggtacattccgctcgtcggcgcccccctaggaggcgctgccagggccctggcgcatggcgtccgggttctggaggacggcgtgaactatgcaacaggaaatctgcccggttgctctttttctatcttcctcttggctttgctgtcttgtttaaccatcccagcttccgcttacgaagtgcgcaacgtgtccggggtgtaccatgttacgaacgactgctccaactcaagtattgtgtatgaggcggcggacataatcatgcatacccccgggtgcgtgccctgcgtccgggaggagaattcctcccgttgctgggtagcgcttactcccacgctcgcggccaggaacagcagcgtccccactgcgacaatacgacgccatgtcgatttgctcgtcgggaccgctgctttctgctccgctatgtacgtgggggatctctgcggatctgtcttcctcgtctcccagctgttcaccttctcacctcgccggtatgagacggtacaagattgcaattgctcactctatcccggccatataacaggtcaccgcatggcttgggatatgatgatgaactggtcacctacaacggccctagtggtatcgcagctactccggatcccccaggccatcgtggacatggtggcgggggcccactggggagtcctagtgggccttgcctactattccatggtggggaactgggctaaggtcttggttgtgatgctactctttgccggcgttgacgggactacccacgtgtcaggggcgcaagcaggccacgccacccgtagctttacgtccctcttcacattaggggcgtctcagaaagtccaactcataaacactaacggcagctggcatatcaataggactgctctgaactgcaatgactccctccagactgggttccttgccgcgctgttctacacacacaggttcaactcgtccggatgcccggagcgcatggccagctgccgccccatcgacacgttcgctcaggggtggggtcccatcacttatgctaaggcttcggcttcggaccagaggccatactgctggcattacgcacctcaaccgtgtggtatcgtacctgcgttggaggtgtgtggtccagtgtattgcttcaccccgagccccgtcgtggtggggacgaccgatcgttccggcgcccccacgtatagatggggggagaatgagacggacgtgctgctcctcaacaacacgcggccaccccacggcaactggtttggctgcacatggatgaatagcaccgggttcaccaagacgtgcgggggccccccgtgcggcatcgggggggtcggcaacaacactttgacctgccctacagattgcttccggaaacaccctgaagccacttacacaaaatgtggctcgggtccttggttgacacctaggtgtttagttgactatccatacagactttggcactacccctgcactgtcaattttagcatctttaagatcagaatgtacgtggggggcctggaacacaggctcaacgccgcgtgcaattggactcggggagagcgctgtgacgtgacggacagggacaggtcagagctcagcccgctgctactgtccacaacagagtggcagatactgccctgttccttcaccaccctaccggctctgtccactggtttaatccatctccatcagaacatcgtggacgtgcaatacctgtacggtgtagggtcaacggttgtctccatcgtaatcagatgggagtacgtcgtgctgctcttccttctcctggcagatgcgcgcgtctgcgcctgcttatggatgatgctgctggtagcccaggctgaggccgccttagagaacctggtggtcctcaatgcggcgtccgtggctggagcgcacggcattctctccttccttgtgttcttttgtgctgcctggtacatcaaaggcaagctggtccctggggcggcatacgctatttatggcgtatggccgctgcttctgctcctgctgtcgttaccaccacgagcatacgccatggaccgggaggtggccgcatcgtgcgggggcgcggtttttgtaggtctggtactcttgaccttgtcaccgcactataaagtgttcctcgctaggctcatatggtggctacaatatttaatcaccagggccgaagcgcacttgcaagtgtgggtcccccccctcaacgttcgggggggccgcaatgccatcatcctcctcacgtgcgtggtccaccctgagctaatttttgaaatcaccaaaaccttgctcgccatactcgggccgctcacagtgctccaggttggcctaactaaagtgccgtactttgtgcgcgctcaagggctcatccgtgcgtgtatgttggtgcggaaaaccgctgggggtcattatgtccaaatggccctcatgaggctggccgcgctgacaggtacgtacgtctatgaccatcttaccccactgcaggactgggcccacgtgggcctgcgggacctcgcagtggcagttgagcccgtcgtcttctctgacatggagaccaagatcatcacctggggggcagacaccgcggcgtgtggagacatcatctcgggtctacccgtctccgcccgaagggggagggagatactcctaggaccggccgatagttttggagagcaggggtggcggctccttgcgcccattacggcctattcccaacagacgcggggcctacttggctgtatcatcactagcctcacaggtcgggacaagaaccaggtcgagggggaggttcaggtagtctctaccgcaacgcaatctttcctagcgacctgtgtcaatggcgtgtgttggaccgtctatcacggcgctggctcgaagaccctggccggcccaaagggtccgatcgcccaaatgtacaccaatgttgaccaggacctcgttggctgggcggcgccccccggggcgcgttccttgacaccatgcacctgtggcagctcggacctttacttggtcacgaggcatgccgatgtcattccggtgcgccggcggggtgatagcaggggaagcctcctttctcccagaccaatctcctaccttaagggctcctcaggtggtccactgctttgccccgcggggcacgctgtgggcatcttccgggccgctgtgtgcacccggggggttgcgaaggcggtggactttgtacccgtcgagtctatggaaactaccatgcggtctccggtcttcacggacaattcatctcccccggccgtaccgcagacattccaagtggcccatctacacgctcccaccggcagcggcaagagcaccaaggtgccggctgcatacgcagctcaagggtacaaggtgctcgtcttgaacccatccgtcgccgccaccttgggttttggggcgtatatgtctaaagcacatggtgtcgaccccaacatcagaactggggtaaggaccatcaccacgggcgctcccattacgtactccacctacggcaagttccttgccgacggtggttgctctgggggcgcctatgacatcataatatgtgatgagtgccactcaactgactcgacttccattttgggcattggtacggtcctggaccaagcggagacggctggagcgcggcttgtcgtgctcgccactgctacgcctccgggatcgatcactgtgccacatcccaatatcgaggaggtggccttgtccaacactggagagattcctttctatggcaaagccatccccatcgcgaccatcaagggggggaggcatctcatcttttgccattccaagaagaaatgtgacgagctcgccgcaaagttgtcggccctcggactcaacgccgtagcgtactaccggggtcttgatgtgtccgttataccaacaagcggagacgtcgttgtcgtggcaacagacgctctaatgacgggctataccggcgactttgactcagtgatcgactgtaacacatgtgtcacccagacagtcgacttcagcttagaccctactttcaccattgagacgacgaccgtgcctcaagacgcggtgtcgcgttcgcagcggagaggcaggactggtaggggcagggggggcatatataggtttgtgactccaggggaacggccctcgggcatgttcgattcctcggtcctgtgtgagtgctatgacgcgggctgtgcttggtacgagctcacgcccgccgagacctcggtcaggttgcgggcatacctaaacacaccagggttgcccgtctgccaggaccatctggagttctgggagagcgttttcacaggtctcacccacatagatgcccacttcttgtcccaaactaagcaggcaggagacaacttcccttacctggtggcataccaggccacagtgtgcgccagggcccaggctccacctccatcgtgggaccaaatgtggaagtgtctcatacggctaaagcctacactgcacgggccaacacccttgttgtataggctgggagccgtgcaaaacgaggtcaccctcacacaccccataaccaaatacatcatggcatgtatgtcggctgacctagaggtcgtcaccagcacctgggtgctggtgggcggggtccttgcagctctggccgcgtactgcctgacgacgggcagcgtggttatcgtgggcaggatcatcttgtcagggaggccggccgtcattcccgacagggaagttctctaccaagagttcgacgaaatggaggagtgcgcctcacacctcccttacatcgaacagggaatgcagctcgccgagcaattcaagcagaaggcgctcgggttgctgcaaacagccaccaagcaagcggaggctgctgctcccgtggtggagtccaagtggcggacccttgaggcattctgggcgaagcacatgtggaatttcatcagcgggatacagtatttagcaggcttgtccactctgcctgggaaccccgcaatagcatcattgatggcatttacagcctccatcaccagcccgctcaccacccaacacaccctcctatttaacatcttggggggatgggtggctgcccaactcgcccccccaagcgctgcttcagctttcgtgggcgccggcattgctggcgcggctgttggcagcataggtcttgggaaggtacttgtagacatcctggcgggttatggagcaggggtggcgggcgcacttgtggcctttaaggtcatgagtggcgacatgccctccactgaggacctggtcaacttactccctgccatcctctctcctggtgccctggtcgtcggggttgtatgcgcagcaatactgcgtcggcatgtgggcccaggggagggggctgtgcaatggatgaaccggctgatagcgttcgcttcgcggggtaaccacgtctcccccacgcactatgtgcctgagagcgacgcagcagcgcgtgtcacccagatcctctccagcctcaccatcactcagctgttgaaaaggctccaccagtggatcaatgaggactgctccacgccatgttccggctcgtggcttagggatgtatgggactggatatgcacggtgttgactgacttcaaaacctggctccagtccaagctcctgccgcggctaccgggagtccctttcttctcatgccaacgtgggtacaagggagtctggcggggagatggtatcatgcaaaccatctgcccatgtggagcacaaatcgctggacatgtcaaaaatggctccatgaagatcgttgggcctaaaacctgcagcaacacgtggcatggaacattccccatcaacgcatacaccacaggcccttgcacaccctccccggcaccaaattattccagggcgttgtggcgggtggctgctgaggagtacgtggaggtcacgcggatgggggatttccactacgtgacgggcatgaccactgacaacgtaaaatgcccatgccaggttccggcccctgaattcttcacggaagtggatggggtgcggctgcacaggtacgctccggcgtgcaaacctctcctacgggaggaggtcacattccaggtcgggctcaaccaatacccggtggggtcgcagctcccatgcgagcccgaaccggatgtgacagtagtcacttccatgctcaccgacccctcccatattacagcagaaacggctaagcgtaggctggccagagggtctcccccctctttggctagctcttcagctagtcagctgtctgcgccttccttgaaggcgacatgcactacccgtcatgactctccagacgctgacctcatcgaggccaacctcctgtggcggcaggagatgggcggaaacatcacccgcgtggagtcagagaataaggtggtaatcctagactccttcgacccgcttcgagcggaggaaaatgagagggaagtatccgttgcggctgagatcctgcgaaaaaccaggaaatttcccccagcgatacccatatgggcacgcccggattacaacccaccactgatagagtcttggagggacccggactatgtccctccagtggtacacgggtgcccattgccacctaccaaggccccgccaataccacctccacggagaaagaagacggttgttctgacagaatccactgtgtcttctgccttggccgaacttgctgtaaaggctttcggcggatctggatcgtcagccgccgacagcggcacagcgaccgcccctcccggtcagccctccgactgcggagatacaggatccgacgctgagtcgtactcctccatgcccccccttgagggagagccgggggaccccgacttcagcgacgggtcttggtcaaccgtgagtgaggaggctagtgaggacgtcgtctgctgttcgatgtcctacacgtggacaggcgccttaatcacgccatgtgccgcggaggagagcaagctgcccatcaatgcgttgagcaactcgttgctgcgtcaccacaacatggtctatgccacaacatcccgcagcgcaagccaacggcagaaaaaggttacatttgacagactgcaagtcctggacgaccactaccgggacgtactcaaggagatgaaggcgaaggcgtccacagttaaggccaaacttctatctgtagaagaagcctgcaagctgacgcccccacactcggccaaatccaaatttggctatggggcaaaggacgtccggaacctatccagcaaggccgttaaccacatccactccgtgtggaaggacttgctggaagacactcaaacaccaattgatactaccatcatggcaaagaatgaggttttcgttgttcagccagaaaaaggaggccgcaagccggcccgccttatcgtgttcccagacttgggagttcgtgtgtgcgagaaaatggctctctacgacgtagtctccacccttcctcaagccgtgatgggctcctcatacggattccagtactcccctggacaacgggtcgagttcctggtcaatgcctggaagtcaaagaaaaaccctatgggtttcgcatatgacacccgttgttttgactcaacggtcactgagaatgacatccgtgttgaggagtcaatttatcaaagttgtgacttggcccccgaggccagacaggccataaggtcgctcacagaacggctttatattgggggccccctgactaattcaaaggggcagagctgcggttatcgccggtgccgtgctagcggcgtgctgacgaccagctgcggtaacacccttacatgttacctgaaggcctctgcagcctgtcgagctgcaaagctccgggactgcacgatgctcgtgtgcggagacgacctcgtcgttatctgtgagagcgcgggaacccaggaggacgcggcgagcctacgagtcttcacggaggctatgactaggtactctgccccccccggggacccaccccaaccggaatacgacttggagttgataacatcatgctcccccaacgtgtcggtcgcgcacgatgcatctggcaagcgggtgtactatctcacccgtgaccccaccacccccctcgggcgggctgcgtgggagacagctagacacactccaaccaactcctggctaggcaacatcatcatgtatgcgcccaccctatgggcgaggatgattctgatgactcacttcttctccatccttctagctcaggagcagcttgaaaaagccctagattgtcagatctacggggccacttactccattgaaccgcttgacctacctcagatcatccagcgactccatggtcttagcgcattttcactccacagttactctccaggtgaaatcaatagggtggcttcatgcctcaggaaacttggggtaccgcccttacgagtctggagacatcgggccaggagtgtccgcgctaagctactgtcccagggggggagggccgccatttgtggcaaatacctctttaactgggcagtaaggaccaagctcaaactcactccaattccggctgcgtcccagttggatttatccggctggttcgttgccggttacagcgggggagacatatatcacagcctgtctcgcgcccgaccccgctggttcatgtggtgcctactcctactttctgtgggagtaggcatctatttgctccccaaccggtgaacggggagctaaccact

SEQ ID NO: 680 - DNA, 9377 bp, Hepatitis C Virus
  misc_feature 5906: n = A,T,C or G
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggattaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgttaagttcccgggcggcggccagatcgttggtggagtttacctgttgccgcgcaggggccccaggttgggtgtgcgcgcgactaggaagacttccgagcggtcacaacctcgtggaaggcgacaacctatccccaaggctcgccggcccgagggtaggacctgggctcagcccgggtacccttggcccctctatggcaacgagggcatggggtgggcaggatggctcctgtcaccccgcggctcccggcctagttggggccccacggacccccggcgtaggtcgcgtaatttgggtaaggtcatcgataccctcacatgcggcttcgccgacctcatggggtacattccgctcgtcggcgcccccctaggaggcgctgccagggccctggcacatggtgtccgggttctggaggacggcgtgaactatgcaacagggaatttgcccggttgctctttctctatcttcctcttggctctgctgtcttgtttgaccaccccagtttccgcttatgaagtgcgcaacgtgtccggggtataccacgtcacgaacgactgctccaactcaagcattgtgtatgaggcagcggacatgatcatgcatgcccccgggtgcgtgccctgcgttcgggagaacaactcctcccgttgctgggtagcgctcactcccacgctcgcggccaggaacatcagcatccccactacgacaatacgacgtcacgtcgacttgctcgttggggcggccgctttctgctccgctatgtacgtgggggatctctgcggatctgttttccttgtttcccagctgttcaccttctcacctcgccggcatgagacagtacaggactgcaattgctcaatctatcccggccacgttacaggtcaccgcatggcttgggatatgatgatgaactggtcgcccacaacagccctagtggtgtcgcagttgctccggatcccacaagctatcgtggacatggtggcgggggcccactggggagtcctggcgggccttgcctactattccatggtggggaactgggctaaggttttgattgtgatgctgctcttctccggcgttgatggggaaactcacgtgtcaggggggacgcacggccggggcgcccactcgttcacgggactctttacctttggggcttctcagaaaatccagcttgtgaataccaatggcagctggcacatcaacaggactgctctgaactgcaatgactccctccagactgggttcatcgccgcgctgttctacacacacaggttcaactcgtccggatgcccagagcgcatggccagctgccgccccattgacgggttcgctcagggatggggtcccatcacttatgttgagcctgacaacctggaccagaggccttattgctggcactacgcacctcgaccgtgtggtatcgtacccgcgtcgcaggtgtgtggtccagtgtattgcttcaccccaagccctgttgtggtggggacgaccgatcgtttcggtgtccccacgtatagctggggggagaatgagacagacgtgctgctcctcaacaacacgcggcctccgcaaggcaattggttcggctgtacatggatgaatagcactgggttcaccaagacgtgtgggggccccccctgtaacatcggggggattggcaacaacaccttgacctgccccacggactgcttccggaagcaccccgaagccacttacacaaaatgtggctcggggccttggttgacacctaggtgcttagttcactacccatacaggctctggcactacccctgcactgtcaactttaccatctttaaggttaggatgtatgtggggggcgtggagcataggctcgaagctgcatgcaattggactcgaggagagcgttgtgacttggaggacagggatagatcagaactcagcccgctgctgctgtctacaacagagtggcagatactgccctgttccttcaccaccctaccggctctgtccactggtttaatccatctccatcggaacatcgtggacgtgcaatatctgtacggtatagggtcagcggttgtctcctttgcaatcaaatgggaatatatcctgttgcttttcctcctcctggcggacgcacgcgtctgtgcctgcttgtggatgatgctgctgatagcccaggctgaggccgccttagagaacttggtagtcctcaatgcggcgtccgtagccggaacgcatggcattctctccttccttgtgttcttttgtgccgcctggtacattaagggtagactggtccctggggcggcatatgccctctatggcgtatggccgctgctcctgctcctattggcgttaccaccacgagcttacgccatggaccgggagatggctgcatcgtgcggaggcgcggtttttataggtctggcactcttgaccttgtcaccatactacaaagtgttcctcgctaggctcatatggtggttacagtattttatcaccagagccgaggcgcacttgcaagtgtgggtcccccctctcaacgttcggggaggccgcgatgccatcatcatcctcgcgtgcgcggtccacccagggctaatctttgacatcaccaaactcctgctcgccatactcggtccgctcatggtgctccaggctggcataaccagaatgccgtactttgtacgcgctcaagggctcattcgtgcatgcatgttagtgcggaaagccgcggggggtcactatatccaaatggccttcatgaagctggccgcgctgacaggtacgtacatttatgaccatctcgccccactgcagcattgggcccacgcgggcctacgagaccttgcggtggcagtggagcctgtcgttttctctgacatggaaaccaagatcatcacctggggggcagacaccgcggcgtgtggggatatcatcttgggtctgcctgtctccgcccgaagaggaagggaggtactcctggggccagccgatagttttgaagggcaggggtggcgactccttgcgcccatcacggcctactcccaacagacgcgaggcctacttggttgcatcatcactagcctcacaggccgggacaagaaccaggtcgagggggaggttcaagtggtttccaccgcaacacaatctttcctggcgacctgcatcaacggcgtgtgttggaccgtctttcatggcgccggctcaaagactctagccggcccaaaaggtccaatcacccagatgtacaccaatgtggaccaggacctcgtcggctggcaggcgccccccggggcacgttccatgacaccatgcacctgcggcagctcggacctttacttggtcacgaggcatgctgatgtcattccggtgcgccggcgaggcgacagcagggggagcctcctctcccccaggcctgtttcctacttgaagggctcttcgggtggtccattgctctgcccttcgggacacgccgtgggcatcttccgggccgctgtgtgcacccggggggttgcgaaagcggtggatttcgtgcccgttgagtccatggaaactaccatgcggtctccggtcttcacagacaactcatcccccccggccgtaccgcagacattccaagtggcccatctacacgctcccactggcagcggcaagagcactaaagtgccggccgcatatgcagcccaagggtacaaggtactcgtcctgaacccatccgttgctgccaccttgagttttggggcgtatatgtctaaggcatatggcaccgaccccaacatcaggactggggtgaggaccatcaccacgggtgcccctattacgtactccacctatggcaagttccttgccgacggtggttgctccgggggcgcctatgacatcataatatgtgatgagtgccactcaactgactcgactaccgtcttgggtatcggcacagtcctggatcaagcggagacggctggagcgcgactcgtcgtgctcgccaccgctacacctccgggatcggtcaccgtgccacaccccaatatcgaggaggtgggcctgtccaacactggagagatccccttctatggcaaagccatccccatcgaggccatcaaggggggaaggcatctcattttctgccattccaagaaaaagtgtgatgagctcgccgcaaagctgtcaggcctcggactcaacgctgtagcgtattaccggggtcttgatgtgtccgtcataccgactagcggagacgtcgttgtcgtggcaacagacgctctaatgacgggctacaccggcgactttgactcggtgatcgactgtaacacatgtgtcacccagacagtcgactttagtttggatcccaccttcaccattgaaacgacgaccgtgcctcaagatgcggtgtcgcgctcgcagcggcgaggcaagactggcaggggtaggaggggcatctacaggtttgtgactccaggggaacggccctcgggcatgttcgattcctcggtcctgtgtgagtgttatgacgcgggctgtgcttggtacgagctcacgcccgccgagacctcggttaggctgcgggcgtacctgaatacaccagggctgcccgtctgccaggaccatctggagttctgggagagtgtcttcacgggcctcacccacatagatgcccacttcttgtcccagactaagcaggcaggagacaacttcccctacctggtggcataccaggccacagtgtgcgccagggctcaggctccacctccatcgtgggatcaaatgtggaagtgtctcatacggcttaaacctacactgcacgggccaacacccctgctgtataggctaggagccgtccaaaatgaagtcatcctcacacatcccataaccaaatacatcatggcatgcatgtcggctgacctggaggtcgtcactagcacctgggtgctagtaggcggagtccttgcagctctggccgcgtactgcctgacaacaggcagcgtggtcattgtgggtaggatcatcttgtccgggaagccggctgtcattcccgacagggaagttctttaccgggagttcgatgaaatggaagagtgcgcctcgcaccttccttacatcgaacaggggatgcagctcgccgagcaattcaaacagaaggcactgggattactgcaaacggccaccaagcaagcggaggctgctgctcccgtggtggaatccaagtggcgagcccttgagaccttctgggcgaagcacatgtggaatttcatcagcgggatacagtacttagcaggcttatccactctgcctgggaaccccgcgatagcatcactgatggcattcacagcctctatcaccagcccgctcaccacccaaagcaccctcctgtttaacatcttggggggatgggtggctgcccaactcgctccccccagcgctgcttcggcattcgtgggcgccggcatcgccggtgcggctgttggcagcataggtcttgggaaggtgcttgtggacatcctggcaggctatggtgcaggggtngctggcgcactcgtagcttttaagatcatgagcggcgaggcgccctccaccgaggacctggttaacttgctccctgccatcctctctcctggcgccctggtcgtcggggtcgtgtgcgcagcaatactgcgtcggcacgtgggcccgggagagggggctgtgcagtggatgaaccggctgatagcgttcgcttcgcggggtaaccacgtctcccccacgcactatgtgcctgagagcgacgccgcggtgcgtgttactcagatcctctccagccttaccatcactcagctgctgaagaggcttcaccagtggattaatgaggactgctccacgccatgctccggctcgtggttaagggatgtttgggactggatatgcacggtgttgactgacttcaagacctggctcaagtccaaactcgtgccgcagttaccgggagtccctttcttctcatgccaacgcgggtataagggagtctggcggggggacggtatcatgcagaccacctgcccatgtggagcacagatcaccggacatgtcaaaaacggttccatgaggatcgttgggcctaaaacctgcagcaacacgtggcatggaacattccccatcaacgcatacaccacgggcccctgcacaccctccccggcgccaaactattccagggcgctgtggcgagtggctgctgaggagtacgtggaggttacgcgggtgggggatttccactacgtgacgggcatgaccactgacaacgtgaagtgcccatgccaggttccagcccccgaattcttcacagaagtggatggagtacggttgcacaggtacgctccggtgtgcaaacctctcctacgggaggaggtcacattccaggtcgggctcaaccaatacctggtggggtcgcagctcccgtgcgagcccgaaccggatgtagcagtgctcacttccatgctcaccgacccctcccacattacagcagagacggccaagcgtaggctggccagggggtctcctccctccttggccagctcttcagctagccagttgtctgcgccttccctgaaggcgacatgcactacccatcatgactccccggacgctgacctcatcgaggccaacctcttgtggcggcaagagatgggcgggaacatcacccgcgtggagtcagagaataaggtagtaattctggactctttcgacccgcttcacgcggaggaggatgagagggaagtatccgtcgcggcggagatcctgcggaaatccaggaagttccccacagcgctgcccatatgggcacgcccggattacaaccctccactgctagagtcctggaaggacccggaatatgtccctccggtggtccacgggtgcccattgccacctaccaaggcccctccaataccacccccacggaggaagaggacggttgtcttgacagagtccaccgtgtcttctgccttggcggagtttgctactaagacgttcggcagttccgaatcgtcggctgtcgacagcggcacggcgactgcccctcctgaccaggcctccgacgacggcgacaagggatccgacgttgagtcgtattcctccatgcctccccttgagggagagccgggggaccccgatctcagcgacgggtcttggtctaccgtgagcgaggaggctggtgaggacgtcgtctgctgctcaatgtcctacacatggacaggcgccctgatcacgccatgcgctgcggaggaaagcaagctgcccatcaatccgttgagcaactccttgctgcgtcaccacaatatggtttacgccacaacatcccgtagcgcaagcctgcggcagaagaaggtgacctttgacaggctgcaagtcctggacgaccactaccgggacgtgctcaaggagatgaaggcgaaggcgtccacagttaaggctaagcttctatccatagaagaagcctgcaagctgacgcccccacattcggccaaatccaaatatggctatggggcaaaggacgtccggaacctatccagcaaggccattaaccacatccactccgtgtgggaggacttgctggaagacactgagacaccaattgacaccaccatcatggcaaagagtgaggttttctgtgtccaaccagagaaaggaggccgcaagccggctcgccttatcgtattcccagacctgggagttcgtgtatgcgagaagatggccctctacgacgtggtctccacccttcctcaggccgtgatgggctcctcatacggattccaatactctcctaagcagcgggtcgagttcctggtgaacacctggaaatcaaagaaaagccctatgggcttttcatatgacacccgctgttttgactcaacggtcactgagaatgacatccgtgttgaggagtcaatttaccaatgctgtgacttggcccccgaagccaaacgggccataaggtcgctcacagagcggctttatatcgggggccccctgactaattcaaaagggcagaactgcggttatcgccggtgccgcgcgagcggcgtactgacgactagctgcggtaataccctcacatgttacttgaaggcctctgcggcctgtcgagctgcgaagctccaggactgcacgatgctcgtgaacggagacgaccttgtcgttatctgtgaaagcgcgggaacccaagaggatgcggagcgcctacgagccttcacggaggctatgactaggtactctgccccccccggggacccgccccaaccagaatacgacttggagttgataacatcatgttcctccaatgtgtcggtcgcgcacgatgcatctggtaaaagagtgtactacctcacccgtgatcccaccaccccccttgcacgggctgcgtgggagacagctagacacactccagttaactcctggctaggcaatatcatcatgtatgcgcccaccttatgggcgaggatgattctgatgactcacttcttctccatccttctagctcaggagcaacttgaaaaagccctggattgtcagatctacggggcctgttactccattgaaccactcgacctacctcagatcattgagcgactccatggtcttagcgcattttcactccatagttactctccaggtgagatcaatagggtggcttcatgcctcaggaaacttggggttccacccttgcgagtctggagacatcgggccagaagtgtccgcgctaagctactgtcccagggggggagggctgccacttgtggcaagtacctcttcaactgggcagtaaggaccaagcttaaactcactccaatcccggctgcgtcccggttggacttgtccggctggttcgttgctggttacagcgggggagacatatatcacagcctgtctcgtgcccgaccccgttggttcatgttgtgcctactcctactttctgtaggagtaggcatctacctgctccccaaccgatgaacggggagctaacca

SEQ ID NO: 681 - DNA, 9375 bp, Hepatitis C Virus
ttgggggcgacactccaccatagatcactcccctgtgaggaactactgtcttcacgcagaaagcgtctagccatggcgttagtatgagtgttgtgcagcctccaggcccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcatcatgagcacaaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggcagggcctgggctcagcccgggtacccttggcccctctatggtaacgagggtctggggtgggcaggatggctcctgtcaccccgaggctctcggcctagctggggccccacggacccccggcgtaggtcgcgtaatctgggtaaggtcatcgatacccttacgtgcggcttcgccgacctcatggggtacattccgctcgtcggcgctcccctggggggcgccgccagggccctggcacatggtgtccgggttctggaggacagcgtgaactatgcaacagggaatctccccggttgctctttctctatcttcctcttggctttgctgtcttgtttgaccattccagtttccgcttacgaagtgcacaacgtgtccggggtgtaccatgtcacgaacgactgctctaactcaagtattgtgtatgagacagcggacttgatcatgcacgcccccgggtgcgtgccctgcgtccgggaggacaattcttcccgttgctgggtagcgcttacccccacgctcgcggccaggaacaacagcgtccccaccatgacaatacgacgccacgtcgatttgctcgttggggcagctgctttctgctccgctatgtatgtgggggatctctgcggatctgttttcctcgtctcccagctgttcaccttctcacctcgccggcatgagacggtacaagactgcaactgctcaatctatcccggccacgtatcaggtcaccgcatggcttgggatatgatgatgaattggtcacctacagcggccctagtggtatcgcagatactccggatcccacaagccgccatggacatggtggcgggggcccactggggagtcctggcgggccttgcctactattccatggtgggaaactgggctaaggtcttggttgtgatgctactcttcgccggtgtcgacgggaccacccacgtgacgggggcccaggcaggtcaacacctccggcgctttacgtctttcttctcatttggggcgtctcagaaaatccaacttataaacactaacggcagctggcacatcaacaggactgctctgaattgcaatgactctctccaaaccgggttcattgccgcgctgttctacacacacaggttcaacgcgtcgggatgtccagagcgcatggccagctgccgtcccattgacacgtacgctcaggggtggggtcccatcacttatgatgagcaagatgtcctggaccagaggccatattgctggcactatgcacctcggccgtgcggtatcgtacctgcggcgcaggtgtgtggtccagtgtattgcttcaccccaagccccgtcgtggtggggacgactgatcgtttcggcgtccccacgtacaactggggggagaatgagacggacgtgctgctccttaacaacacgcggccaccccacggcaactggttcggctgcacatggatgaatggcaccgggttcaccaagacgtgtgggggccccccgtgtaagatcgggggggtcggcaacaacaccttggtctgccctacagattgcttccggaaacaccccgaagccacttacacaaaatgtggctcaggtccctggttgacacccaggtgcatggttgactatccatacagactttggcactacccctgtactgtcaactttaccatcttcaaggtcaggatgtacgtggggggtgtggagcacaggctcaacgccgcgtgcaattggactcggggagagcgctgtgatttagtggacagggataggtcagagcttagtccgctgctactgtctacaacagagtggcagatactgccctgctccttcaccaccctaccggctttgtccactggtttgatccacctccatcagaacatcgtggacgtgcaatacctgtacggtgtagggtcagcggttgtttccgtcgcaatcagatgggagtacgtcgtgttgctcttccttctcctggcagacgcgcgcttttgcgcctgcttatggatgatgctgctagttgcccaggctgaggccgccttggagaacctggtggtcctcaatgcggcgtccgtggctggagcgcatggcattctctccttccttgtgttcttctgtgctgcctggtacattaagggcaagctggtccccggggcggcatacgctttttatggcgtatggccgctgctcctgctcctgctggcgctaccaccacgagcatacgccatggatcgggagatggctgcatcatgcggaggcgcggttttcataggtctggcactcttgaccttgtcaccacactacaaggtgttcctcgccaggctcatatggtggttgcaatattttatcaccagagccgaagcgcacttgcaagtgtgggtcccccctctcaacgttcgggggggccgcgatgccatcatccttctcatgtgcgcggtccatccagagctaatttttgacatcaccaaaattttgctcgccatattcgggccgcccgtggtgctccaggctggcctaactagagtgccgtacttcgtacgcgctcaagggctcatccgtgcatgcatgttggtgcggaaggtcgctgggggtcattatgtccaaatggccctcatgaagctggctgcactgacaggcacgtacgtttatgaccatcttactccactgcaggactgggcccactcgggcttgcgagaccttgcggtggcagttgagcccgttgttttctctgacatggagaccaagatcatcacctggggggcagacaccgcagcatgtggggacatcatctcgggtttgcccgtctccgctcgaagggggagggagatacttttgggaccggccgatagttttggagagcaggggtggcgtcttcttgctcctatcacggcctattcccaacagacacggggtttgcttggctgtatcatcaccagcctcaccggtcgggacaaaaaccaggtcgagggggaggttcaggtggtctccaccgcaacgcaatccttcctagcgacctgcatcaatggtgtatgttggaccgtttaccatggtgccggctcaaagaccctggccggcccgaagggtccaatcacccaaatgtataccaatgtagaccaggacctcgtcggctggccggcgccccccggggcgcgttccttaacaccatgcacctgcggcagctcggacctttacttggtcacgaggcatgctgatgtcatcccggtgcgccggcggggcgacagcagggggagcctgctttcccccaggcccatctcctacttgaagggctcatcaggtggtccgctgctttgcccctcggggcacgctgtgggcatcttccgggctgctgtgtgcacccggggggttgcgaaggcggtggactttgtacccgttgagtctatggaaactactatgcggtctccggtcttcacggataattcatctcccccggccgtaccgcagacattccaagtggcccatctacatgcccccactggcagcggcaaaagcaccagggtgccggctgcgtatgcagcccaagggtacaaggtactcgtcctgaacccgtccgttgccgctaccttaggttttggggcgtatatgtctaaggcacatggtgtcgaccctaacattagaactgggataaggaccatcactacgggcgctcctattacatactccacctacggcaagttccttgccgacggtggttgctctgggggcgcctatgacatcataatatgcgatgagtgccactcaactgactcgacttccattttgggcattggcacggtcctggaccaagcggaaacggctggggcgcggctggtcgtgctcgccaccgctacgcctccgggatcggtcactgtgccacatcccagtatcgaggaggtggccttgtccaacactggggagattcccttctatggcaaagccatccccattgaggtcatcaagggggggaggcatctcatcttctgccattccaagaagaaatgtgacgagctcgccgcaaagttgtcagccctcgggatcaatgctgtatcgtactaccggggtcttgatgtgtccgtcatacccacaagcggagacgtcgttgtcgtggcaacagacgctctaatgacgggctataccggcgactttgactcagtgatcgactgtaatacatgtgtcacccagacagtcgatttcagcttggaccccactttcaccattgaaacgacgaccgtgccccaagacgcggtgtcgcgctctcagcggcgaggcaggactggtaggggtaggggaggcatatacaggtttgtgactccaggggaacggccctcgggcatgttcgattcttcggtcctgtgtgagtgctatgacgcgggctgcgcttggtatgagctcacgcccgccgagacatcggtcaggttgcgggcttacctaaacacaccagggctgcccgtctgccaggatcatctggagttctgggagagcgtcttcacaggcctcacccacatagatgcccacttcttgtcccagaccaagcaggcaggagacaacttcccctacctggtagcataccaggctacagtgtgcgccagggcccaggctccacccccatcgtgggaccaaatgtggaagtgtctcatacggctaaagcctacgctacacgggccaacacccctgttgtacaggctaggagccgtgcaaaatgagattaccctcacacaccccataaccaaattcatcatggcatgcatgtcggctgacctagaggtcgtcaccagcacctgggtgctggtaggcggggtccttgcggccctggccgcgtactgcctgacaacgggcagcgtggtcattgtgggcagaatcatcttgtcagggaggccggctatcattcccgacagggaagctctctaccaagagttcgatgaaatggaggagtgcgcctcacacctcccttacatcgaacaggggatgcaactcgccgagcagttcaagcagaaggcgttcgggttgttgcaaacagccaccaagcaagcggaggctgctgctcccgtggtggagtccaagtggcggacccttgaggctttctgggcgaagcacatgtggaacttcatcagcgggatacaatatttagcaggcttgtccactctgcctgggaaccccgcgatagcatcgctaatggcattcacagcctccatcaccagcccgctcaccacccaaaataccctcttgtttaacatcttggggggatgggtggccgcccaactcgccccccccagcgctgcctcagctttcgtgggcgccggcatcgcaggcgcggctattggcagcataggccttgggaaggtgcttgtagacatcctggcgggttacggagcaggggtggcaggcgcactcgtggccttcaaggtcatgagtggcgatatgccctccaccgaggacctggtcaacttgctccctgccatcctctctcctggcgccctggtcgtcggggttgtgtgcgcagcaatactgcgtcggcatgtgggcccaggggagggagctgtgcagtggatgaaccggctgatagcgtttgcttcgcggggtaaccatgtctcccccacgcattatgtgcctgaaagcgacgctgcagcgcgtgtcacccagatcctctccagccttaccatcactcagctgttgaagaggcttcaccagtggattaatgaggactgctccacgccgtgctccggctcgtggcttagagacgtatgggactggatatgcacggtgttgactgacttcaagacctggctccagtccaagctcctgccgcggttaccgggagtccctttcctttcatgccaacgtgggtataagggagtctggcggggagacggtgtcatgcaaaccacctgcccatgtggagcacaaatcgctggacatgtcaaaaatggttccatgaggatcgttgggcctaagacctgcagcaacacgtggcatggaacattccccattaacgcatacaccacaggcccctgcacacccaccccggcgccgaattactccagggcgctatggcgggtggctgctgaggagtacgtggaggttacgcgagtgggggatttccactacgtgacgggcatgactgctgacaacataaaatgtccatgccaggttccggcccctgaattcttcacggagttggacggggtgcggctgcacaggtacgctccggcgtgcaagcctctcctacgggaggaggtcacattccaggtcgggctcaaccaatacccggttgggtcacagctcccatgcgagcccgaaccggatgtaacagtggtcacttccatgctcaccgacccctcccacattacagcagaaacggctaagcgtaggctagccagggggtctcccccttccttggccagctcttcagctagccagttatctgcgccttctttgaaggcgacatgcactactcgtcatgactccccagacgttgatctcatcgaggccaacctcctgtggcggcaggagatgggcgggaacatcacccgcgtggagtcagagaacaaggtagtagtcctggactcttttgaaccgctccgagcggaggaggaggagagggaagtgtccgtggcggcggagatcctgcggaaaaccaggaaattccccccggcgctacccatatgggcacgcgcggactacaacccaccactgttagagtcttggagggacccggactacgtccctccggtggtacacgggtgcccattgccacctaccaagactcctccaataccacccccacggagaaagaagacggttgtcctgacggagtccaccgtgtcttctgccttggcggagcttgctacgaagaccttcggcagctccggatcgtcggcctccgatggacgcgcagcgaccactcctcccggtcaggtctctgactgcggaaatacaggatccgatgctgagtcgtactcctccatgcccccccttgagggagagccgggggaccccgacctcagcgacgggtcttggtctactgtgagtggggaggctagtgaggacgtcgtatgctgctcgatgtcctacacatggacaggcgccttaatcacaccatgcgccgcggaggagaacaagctgcccatcaatgcgctgagcaactctttgctgcgtcatcataacatgatctatgccacaacatcccgcagcgcaagccaacggcagaaaaaggtcacctttgacagactgcaagtcctggacgaccactaccgggacgtgctcaaggagatgaaggcgaaggcgtccacagttaaggctaaacttctatccgtagaagaagcctgcaagctgacgcccccacattcagccaaatctaaatttggctatggggcaaaggacgtccggaacctatccagcaaggccgtcaaccacatccactccgtgtggaaggacttgctggaagacaatgtgacaccaattgacactaccatcatggcaaagaatgaggtcttctgtgtccaaccagagaaagggggccgcaagccagctcgccttatcgtgttcccagacttgggagttcgtgtgtgcgagaaaatggccctttacgacgtggtctccactcttcctcaggccgtgatgggcccctcatacgggttccagtactctcctgggcagcgggtcgagttcctggtcaatgcctggaaatcaaagaaaagccccatgggcttcgcatatgacacccgctgttttgactcaacggtcaccgagaatgatatccgtgtcgaggagtcaatttaccaaagctgtgacttggcccccgaggccagacaggccataaggtcgctcacagagcgactttatattgggggccccctgactaattcaaaggggcagaactgcggttaccgccggtgccgcgccagcggcgtgctgacgactagctgcggtaatacccttacatgctacttgaaggcctctgcagcctgtcgagctgcaaagctccaggactgcacgatgctcgtgtgcggagacgatcttgtcgttatctgtgagagcgcgggaacccaggaggacgcggcgagcctacgagtcttcacggaggctatgactaggtactctgccccccccggggacccgccccaaccggaatacgacttggagttgataacatcatgctcctccaacgtgtcggtcgcgcacgatgcatccggcaaacgggtgtactacctcacccgtgaccccaccacccccctcgcgcgggctgcgtgggagacagctagacacactccggtcaactcctggctaggcaacatcatcatgtatgcgcccactttatgggcaaggatgattctgatgactcacttcttctccatccttctggctcaggagcagcttgaaaaagccctggattgtcagatctacggggccatttactccattgaaccacttgatctacctcagatcattcagcgactccatggtcttagcgcgttttcactccatagctactctccaggtgaaatcaatagggtggcttcatgcctcaggaaacttggggtaccacccttgcgagtctggagacatcgggccagaagtgtccgtgctaagctactgtcccagggggggagggctgccacttgtggcaaatacctcttcaactgggcagtaaggaccaagcttaaactcactccaattccggctgcgtcccagttggacttgtccggctggttcgtcgctggttacagcgggggagacatatatcacagcctgtctcgtgcccgaccccgctggttcatgtggtgcctactcctactttccgtaggggtaggcatctatttgctccccaaccggtgaacggggagctaac

SEQ ID NO: 682 - DNA, 9379 bp, Hepatitis C Virus
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccaacccgagggcagggcctgggctcagcccgggtacccttggcccctctatggcaatgagggcatggggtgggcaggatggctcctgtcaccccgtggctcccggcctagttggggccccacggacccccggcgtaggtcgcgtaatttgggtaaggtcatcgatacccttacatgcggcttcgccgatctcatggggtacattccgctcgtcggcgcccccctagggggcgctgccagggccctggcacatggtgtccgggtcctggaagacggcgtgaactatgcaacagggaatttgcccggttgctctttctctatcttcctcttggctctgctgtcctgtctgaccgtcccagcttccgcctatgaagtgcgcaacgtgtccggggcataccatgtcacgaacgactgctccaactcaagcattgtgtatgagacagcggacatgatcatgcatacccccgggtgcgtgccctgtgttcgggaaggcaatcactctcgttgctgggcagcgctcacccccacgctcgcggccaggaatgctagcgtccccaccacgacaatacgacgccacgtcgacttgctcgttggggcggctgctttctgctccgctatgtacgtgggggatctctgcggatctgtcttcctcgtctcccagttgttcaccttctcgcctcgccggcatgagacagtacaggactgcaactgctcgatctatcccggccatgtaacaggtcaccgcatggcttgggatatgatgatgaactggtcgcctacaacagccctagtggtgtcgcagttactccggatcccacaagctgtcgtggacatggtgacgggggcccactggggagtcctggcgggccttgcctactattccatgatagggaactgggctaaggttctgattgtgatgctactcttcgccggcgttgacgggacgggtacccttgtatcaggaggggtgagtggccacaccaccagcggcctcacgtccctctttagagtcggggcgtctcagagaatccagcttgtaaacaccaatggcagctggcacattaacaggactgccctgaactgcaatgactccctccagactgggttccttgccgcgctgttctacacaaacaagttcaactcgtccggatgctcagagcgtctgaacagctgccgccccattgagaacttcactcagggatggggccccatcacttatgatgagggtggcggctcggaccagaggccttattgctggcattacgcgcctcgacagtgtggtatcgtacccgcgtcggaggtgtgtggtccagtgtactgcttcaccccaagccctgttgtggtggggacaaccgatcgtctcggtgttcctacctacagctggggggagaatgtgacagacgtgctgctgctcaacaacacgcggccgccacaaggcaactggttcggctgtacatggatgaacagtactgggttcaccaagacgtgcgggggccccccgtgtaacatcgggggggtcggcaaccgcttggtctgccccacggactgcttccggaagcaccccgaggctacttacacaaaatgtgggtcggggccctggttgacacctaggtgcttagttgactatccatacaggctctggcactacccctgcactgtcaactataccgtctttaaggttaggatgtatgtggggggcgtggagcacaggctcagtgctgcatgcaagtggactcggggagagcgctgtgacttggaggacagggatagatcagagctcagcccactgctgctgtctacgacggagtggcagatactgccctgttctttcaccaccctaccggctctgtccactggtttgatccacctccatcagaacatcgtggacgtgcaatacctgtacggtgtagggtcagcggttgtctcctttgcaatcaaatgggagtatatcctgttgctgttccttctcctggcggacgcgcgcgtctgtgcctgcttgtggatgatgctgctgaaaccccaggctgaggccgccttagagaacctggtggtcctcaatgcggcgtccgtggccggagcgcatggcttcctctccttccttgtgttcttctgcgccgcttggtacattaagggcaggctggcccctggggtggcatatgctttctatggcgtatggccgctgctcctgctcctgttggcgttaccaccacgagcttacgccatggaccgggagatggctgcatcgtgtggaggcgcggtttttgtaggtctagtgttcttgaccttgtcaccacactacaaagtgttcctcactaggatcatatggtggttacaatactttatcaccagagccgaggcgcacttgcaagtgtgggtcccccctctcaacgttcgggggggccgtgatgccatcatcctcctcacgtgcgcagtccacccagagctaatctttgacatcaccaaattcttgctcgccatactcggcccgctcatggtgctccaggccggcataacgagagtgccgtacttcgtgcgcgctcaagggctcattcgtgcatgcatgttagtgcggaaagtcgccgggggtcattatgtccaaatggccctcatgaagctggccgcgctgacaggtacgtacgtttacgaccatcttactccactgcgggattgggctcacacgggcctacgagacctcgcagtggcagtggagcccgtcgtcttctccgacatggagaccaagatcatcacctggggggcagacaccgcggcgtgtggggacatcatctcgggcctacccgtctccgcccgaaggggaagggagatacttctgggaccggccgatagtcttgaagggcaggggtggcgactcctcgcgcccatcacggcctactcccaacagacgcggggcctacttggttgcatcatcactagcctcacaggccgggacaagaaccaggtcgagggggaggttcaagtggtttccaccgcgacacaatctttcctggcgacctgtatcaatggcgtgtgttggactgtctaccatggcgccggctcaaagaccctagccggtccaaaaggtccaatcacccagatgtacaccaatgtagacctggacctcgtcggctggcaggcgccccccggggcgcgttctatgacaccatgcacctgcggcagctcggatctttacttggtcacgagacatgccgatgtcattccggtgcgccggcgaggcgacagcaggggaagtctgctctcccccaggcccgtctcctacctgaagggctcctcgggtggtccactgctctgcccctcggggcacgctgtgggcctcttccgggccgctgtgtgcacccggggggttgcgaaggcggtggacttcatacccgtcgagtctatggagactaccatgcggtctccggtcttcacagacaactcatcccctccggccgtaccgcagacattccaagtggcacatctgcatgctcccactggcagcggcaagagcactaaggtgccggctgcatatgcagcccaagggtacaaggtactcgtcctgaacccgtccgttgccgccaccttaggttttggggcgtatatgtccaaggcacatggtatcgaccctaacatcagaactggggtaaggaccatcaccacgggcggccccatcacgtactccacctatggcaagttccttgccgacggtggctgctctgggggcgcctatgacatcataatatgtgatgagtgccactcaactgactcgactaccatcttgggcatcggcacagtcctggaccaagcggagacggctggagcgcggctcgtcgtgctcgccaccgctacgcctccgggatcggtcaccgtgccgcaccccaatattgaggaagtggctctgtccaacactggagagatccccttctatggcaaagccatccccattgaggtcatcaagggggggaggcatctcattttctgccattccaagaagaagtgtgatgagctcgccgcaaagctgacaggcctcggaatcaatgctgtagcgtattaccggggtcttgatgtgtccgtcataccgaccagcggagacgtcgttgtcgtggcaacggacgctctaatgacgggtttcaccggcgactttgactcagtgatcgactgtaacacgtgtgtcacccagacggtcgatttcagcttggatcccaccttcaccattgacacgacgaccgtgccccaagacgcggtgtcgcgctcgcagcggcgaggtaggactggcaggggtaggggtggcatctacaggtttgtgactccaggagaacggccctcgggcatgttcgattcctcggtcctgtgtgagtgctatgacgcgggttgtgcttggtatgagctcacgcccgctgagacctcggttaggttgcgggcttacctgaatacaccagggttgcccgtctgccaggaccatctggagttctgggagagtgtcttcacaggcctcacccacatagatgctcacttcttgtcccagactaaacaggcaggagacaacttcccctacctggcagcataccaagctacggtgtgcgccagagctcaggctccacctccatcgtgggaccaaatgtggaagtgtctcatacggctgaaacctacactgcacgggcccacacccctgctgtataggctaggagccgtccaaaatgaagtcaccctcacacaccccataaccaaatacatcatggcatgcatgtcggctgacctggaggtcgtcactagcacctgggtgctggtaggcggagtccttgcagctctggccgcatattgcctgacgacaggcagcgtggtcattgtgggcagggtcatcttatccgggaagccagccgtcattcctgacagggaagtcctctaccaggagttcgatgagatggaagagtgtgcctcacacctcccttacatcgagcaggggatgcagcttgccgagcaattcaggcagaaggcgctcgggttgctgcaaacagccaccaagcaagcggaggctgctgctcccgcggtggagtccaagtggcgagcccttgaagccttctgggcgaagcacatgtggaacttcatcagcgggatacagtacctagcaggcttatccactctgcctggaaaccccgcgatagcatcactgatggcattcacagcctccatcaccagcccgctcaccacccaaaataccctcctttttaacatcttggggggatgggtggctgcccaactcgctccccccagcgctgcttcggctttcgtgggcgccggcatcgccggtgcggctgttggcagcataggccttgggaaggtgcttgtggacatcttggcgggctatggggcaggggtggccggcgcgctcgtggcctttaaggtcatgagcggcgaggcgccctccaccgaggacctggtcaatttgctccctgccatcctctctcctggtgccctggtcgtcggggtcgtgtgcgcagcaatactgcgtcggcacgtgggcccgggagagggggctgtgcagtggatgaaccggctgatagcgttcgcttcgcggggtaaccacgtctcccccacgcactatgtgcctgagagcgacgctgcagcgcgtgtcactcagatcctctccagccttaccatcactcaactgctgaagaggcttcaccagtggattaatgaggactgctccacgccatgctccggctcgtggctaagggatgtttgggattggatatgtacggtgctgaccgacttcaagacctggctccagtccaagctcctgccgcggttgccgggagtccccttcctgtcatgccaacgcgggtacaagggagtctggcggggggacggcatcatgcaaaccacctgcccatgtggagcacagatcgccggacatgtcaaaaacggttccatgaggatcacagggcctaaaacctgcagcaacacgtggcatggaacatttcccatcaatgcatacaccacgggtccctgcacaccctccccggcgcctaactattccaaggcgctgtggcgggtggctgctgaggagtacgtggaggttacacgggtgggagatttccattacgtgacgggcatgaccactgacaacgtaaagtgcccatgccaggttccggcccccgaattcttcacggaggtggatggagtgcggttgcacaggtacgccccggcgtgcaaacctctcctacgggaggaggtcgtattccaggtcgggctcaaccaatacctggtcgggtcacagcttccatgcgaacccgagccggatgtggcagtgctcacttccatgcttaccgacccctcccacatcacagcagagacggctaagcgtaggctggccagggggtctcccccctcattagccagttcttcagctagccagttgtctgcgccttccttgaaggcgacatgcactacccaccatgactccccggacgctgacctcatcgaggccaacctcctgtggcggcaggagatgggcggaaacatcacccgcgtggagtcagagaataaggtagtaattctggactctttcgacccgcttcgagcggaggaggatgagagggaagtatccgttgcggcggaaatcctgcggaaatccaggaaatttcccccagcgttgcccatatgggcgcgcccggattacaaccctccactgatagagtcctggaaggacccggactacgtccctccggtggtacacgggtgcccattgccacctaccaaggcccctccaataccacctccacggagaaagaggacggttgttctgacagagtccaccgtgtcttctgccttggcggagctcgctactaagaccttcggcagctccggatcgtcggccgtcgacagcggtacggcgaccgcccctcctgaccaggcctccgactacggcgacaaaggatccgacgttgagtcgtactcctccatgcccccccttgagggagagccgggggaccccgatctcagcgacgggtcttggtctaccgtgagcgaggaggctagtgaggacgtcgtctgctgctcaatgtcctacacgtggacgggtgccctgatcacgccatgtgctgcggaggaaagcaagctgcccatcaacccgttgagcaactctctgctgcgtcaccacaacatggtctacgccacaacatcccgcagcgcaggcctacggcagaagaaggtcacctttgacagactgcaagtcctggacgaccactaccgggacgtactcaaggagatgaaggcgaaggcgtccacagttaaggctaaacttctatctatagaagaagcctgcaagctgacgcccccacattcggccaaatccaaatttggctatggggcaaaggacgtccggaacctatccagcagggccgttaaccacatccgctccgtgtgggaggacttgctggaagacactgaaacaccaattaccaccaccatcatggcaaaaaatgaggttttctgcgtccaaccagagaaaggaggccgcaagccggctcgccttatcgtattcccagacctgggagttcgtgtatgcgagaagatggctctttatgacgtggtctccacccttcctcaggccgtgatgggctcctcatacggattccagtactctcctgggcagcgggtcgagttcctggtgaatgcctggaaatcgaagaaatgccctatgggcttctcatatgacacccgctgttttgactcaacggtcactgagaatgacatccgtgttgaggagtcaatttaccaatgttgtgacttggcccccgaagccagacaggccataaggtcgctcacagagcggctttatatcgggggccccctgactaattcaaaagggcagaactgcggttatcgccggtgccgcgcaagcggtgtgctgacgactagctgcggtaacaccctcacatgttacttgaaggccactgcggcctgtcgagctgcaaagctccaggactgcacgatgctcgtgaacggagacgaccttgtcgttatctgtgaaagcgcgggaacccaagaggatgcggcggccctacgagtcttcacggaggctatgactaggtattccgccccccccggggacctgccccagccagaatacgacttggagctgataacatcatgctcctccaatgtgtcggtcgcgtacgatgcatctggcaaaagggtatactaccttacccgtgaccccaccaccccccttgcgcgggctgcgtgggagacagctagacacactccagtcaactcctggctaggcaacatcatcatgtatgcgcccaccttatgggcaaggatgattctgatgactcacttcttctccatccttctagctcaggaacaacttgaaaaagccctggattgtcagatctacggggcttgctactccattgagccacttgacctacctcagatcattgaacgactccatggacttagcgcattttcactccacatttactctcctcgtgagatcaatagggtggcttcttccctcaggaaacttggggtaccgcccttgcgagtctggagacatcgggccagaagtgtccgcgctaagctgctgtcccggggggggagggcagccacttgtggcaaatacctcttcaactgggcagtgaggaccaagctcaaactcactccaattccggctgcgtcccggctggacttgtccggctggttcgttgctggttacagcgggggagacatatatcacagcctgtctcgtgcccgaccccgctggttcatgttgtgcctactcctactttctgtaggggtaggcatctacttgctccccaaccggtgaacggggagctaaccact

SEQ ID NO: 683 - DNA, 9388 bp, Hepatitis C Virus
ttgggggcgacactccaccatagatcattcccctgtgaggaactactgtcttaacgcagaaagcgtttagccatggcgttagtatgagtgtcgtgcagcttccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcatcatgagcacaaatcctaaacctcagagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacagcctatccccaaggctcgccggcccgagggcaggacctgggctcagcccgggtacccttggcccctctatggcaatgagggcatggggtgggcaggatggctcctgtcaccccgcggctctcggcctagttggggccccacggacccccggcgtaggtcgcgtaatttgggtaaggtcatcgataccctcacatgcggcttcgccgacctcatggggtacattccgctcgtcggcgcccccttagggggcgctgccagggccctggcacatggtgtccgggttctggaggacggcgtgaactatgcaacagggaatttgcctggttgctctttctctatcttcctcttggctttgctgtcctgtctgaccatcccagcttccgcttatgaagtgcacaacgtgtccgggatataccatgtcacgaacgactgctccaactcaagtattgtgtatgaggcagcggacgtgatcttgcatacccccgggtgcgtgccctgcgtccgggaggccaactcctcccgttgctgggtagcgcttacccccacgctagcggccaggaatacaagcgtccccactacgacgatacgacggcatgtcgacttgctcgttgggacggctgctttctgctccgctatgtacgtgggagatctctgcgggtctgttttccttgtctcccaactgttcaccttctcgcctcgccggcacaagacagtacaggactgtaattgttcaatctatcccggccacttgtcaggtcatcgcatggcttgggatatgatgatgaactggtcacctacaacagccctagtggtgtcgcagttgctccggatcccacaagctgtcgtggatatggtggcgggggctcactggggagtcctagcgggccttgcctactattccatggcagggaactgggctaaggttttgattgtgatgctactcttcgctggcgttgacggggatacccatgtgacagggggggcggcagcctacaccgccagcgggtttacgtccctcttcacttttgggccctctcagaaaatccagcttgtgaactccaatggcagctggcacatcaataggactgccctgaactgcaatgactccctcaacaccgggtttcttgccgcgctgttctacgcacacaagttcaacgcatccgggtgcccagaacgcttggccagctgccgctccattgacaagttcgctcaagggtggggccccattacctatactgagcatggcggccaggaccagaagccttattgctggcactacgcacctagacagtgtggtatcgtacccgcgtcgcaggtgtgtggtccggtgtactgcttcaccccgagccccgttgtggtggggacgaccgatcgtttcggtgtccctacgtatagctggggggagaatgagacggacgtgctgctccttaacaacacgcggccgccgcaaggcaactggttcggctgcacatggatgaatagcactgggttcaccaagacgtgtgggggccccccctgtaacatcgggggggtcggcaataacaccttgacctgccccacggactgcttccggaagcaccccgaggccacttacacaaaatgtggttcggggccttggttgacacccaggtgcatagttgactacccatacaggctctggcattacccctgcactgtcaactttaccatcttcaaggttagaatgtatgtggggggtgtggaacacaggctcaatgccgcttgcaattggacccgaggagaacgttgtgacttggaggacagggatagatcggagctcagcccgctgctgctgtctacaacagagtggcagatactgccctgttccttcaccaccctgccggctctgtccactggtttgatccatctccatcagaacatcgtggacgtgcaatacttgtacggtatagggtcggcggttgtctccattgcaatcaagtgggagtatgtcgtgttgcttttcctcctcctggcggatgcgcgcgtctgcgcctgcttgtggatgatgctgctaatagctcaggccgaggccgccttagagaacctggtggtccttaatgcggcgtccctggccggagcgcacggcattctctccttccttgtgttcttctgtgccgcttggtatatcaagggtagactggtccctggggcggcgtatgctctctatggcgtatggccgctgctcctgctcctgctggcactaccaccacgagcttatgctatggaccgggagatggctgcgtcatgcggaggcggggtttttataggcctggcattcttgaccttgtcaccatactataaagtcttccttgccaggatcatctggtggttgcaatacttcatcgccagagccgaggcgcatttgcaagtgtgggttccccccctcaacgttcggggaggccgcgatgccatcatcctcctcgcgtgcgtggtccacccagagctaatctttgatatcaccaaactcctgctcgccgtactcggcccgctcacagtgctccaggctgccatgatccgagtgccgtactttgtgcgcgctcaagggctcatccgtgcatgcatgttagtgcggaaagctgctgggggtcattatgtccaaatggccttcatgaagctggctgcactgacaggtacgtacgtttatgaccatcttaccccactgcaggattgggcccatgtgggcctacgagaccttgcggtggcggtggagcctgttgtcttctctgacatggagaccaagatcatcacctggggggcagacaccgcggcgtgtggggacatcatcttgggcctacccgtctccgcccgaaagggaagggagatacttctgggaccggccgatagtcatgaaggccaggggtggcgactccttgcgcccattacagcctactcccaacagacgcggggcctacttggttgcatcattaccagcctcacaggccgggacaggaaccaggtcgaaggggaggttcaagtggtttccaccgcaacacaatctttcctggcgacctgcattaacggcgtgtgttggactgttttccatggcgccggctcaaaaaccttagctggcccgaagggtccaatcacccagatgtataccaatgtagaccaggacctcgtcggctggcaggcgccccccggggcgcgctccttgacgccatgcacctgcggcagctccgacctttacttggtcacgagacatgctgatgtcattccggtgcaccggcgaggcgatagtagagggagcctactctctcccaggcctgtctcctacttgaagggctcttcgggtggcccattgctttgcccttcggggcatgctgtgggtatcttccgggctgccgtgtgcacccggggggttgcgaaggcggtggacttcatacccgttgagtctatggaaactactatgcggtctccggtgttcacagacaactcatcccccccggccgtaccgcagacattccaagtggcccacctacacgcccccactggcagcggtaagagcactaaagtgccggctgcatatgcagcccaagggtacaaggtactcgtcttgaacccgtctgtcgctgccactttgggttttggggcgtatatgtctaaagcacatggcaccgaccccaacataagaaccggggtaaggaccatcaccacaggcgcccctatcacatactccacctatggcaagttccttgctgacggtggttgttccgggggcgcctatgacatcataatatgtgatgagtgccactcaactgactcgactaccgtcttgggcattggcacggtcctggaccaagcggagacggctggagcgcgactcgtcgtgctcgccaccgctacacccccgggatcggtcaccgtgccacaccccaacattgaggaggtggctctgtccaatactggcgaagtccccttctacggcaaagccatccccattgaggtcatcaaggggggaagacatctcattttctgccactccaagaagaagtgtgacgagctcgccgcaaagctgtcatccctcgggctcaacgctgtagcgtattaccggggtcttgatgtgtccgtcataccgaccagcggagacgtcgttgtcgtggcgacagacgctctaatgacgggcttcaccggcgactttgactcagtgatcgactgtaacacgtgcgtcacccagacagtcgacttcagcttggatcccaccttcaccattgagacgacgaccgtgccccaagatgcggtgtcgcgctcgcagcggcggggcaggactggcaggggtaggagaggcatctacaggtttgtgactccaggagaacggccctcgggcatgttcgattcctcggtcctgtgtgactgctatgacgcgggctgtgcttggtacgagctcacgcctgctgagacctcagttaggctgcgggcctacctgaatacaccagggttgcccgtctgccaggaccatctggagttctgggagggcgtcttcacaggcctcacccacatagatgcccacttcctgtcccagactaagcaggcaggagagaacttcccctatctggtagcataccaagccacggtgtgtgccagagctcaggccccgcccccatcgtgggatcagatgtggaagtgtctcatacggcttaaacctacgctgcacgggccaacgcccttgctgtataggctaggagccgtccaaaatgaggtcaccctcacacaccccgtgaccaaattcatcatggcatgcatgtcggctgacctggaggtcgtcactagcacctgggtgctggtaggcggagtccttgcagctctagccgcatattgcttgacaacaggcagcgtggtcattgtgggcaggatcatcttgtccgggagaccggctgttattcccgatagagaagttctctaccgggagttcgatgaaatggaagagtgtgcttcacatctcccttacatcgaacagggaatgcagctcgctgagcagttcaaacagaaggcgctcgggttgctgcagacagccactaagcaagcggaggctgctgcccccgtggtggaatccaagtggcgagccctcgaaactttctgggcgaagcacatgtggaatttcatcagcgggatacagtacttggcaggcttatccactctgcctggaaaccccgctatagcatcactaatggcattcacagcctccattaccagcccgctcaccacccaaaatactctcctatttaacatcttggggggatgggtggctgcccaactcgccccccccagcgctgcttcggctttcgtaggcgccggcatcgtcggtgcggccgttggcagcgtaggccttgggaaggtgcttgtggacatcctggcgggctatggagcaggggtggctggcgcactcgtagcctttaaaatcatgagcggcgaggcgccctccaccgaggacctggttaatttgctccctgccatcctctctcccggcgccctggttgtcggggtcgtgtgcgcagcaatactgcgtcggcatgtgggcccgggagagggggctgtgcaatggatgaaccggctgatagcgttcgcttcgcggggtaaccatgtttcccccacgcactacgtgcctgagagcgacgccgcagcgcgtgttactcagatcctctccggccttaccatcacccagctgctgaagaggttacaccagtggattaatgaggactgctccacgccatgctccggctcgtggctaagggatgtttgggactggatatgtacggtgttgactgacttcaagacctggctccagtccaagcttctgccgcagttgccgggagtccccttcttttcatgccaacgcgggtacaagggagtctggaggggggacggcatcatgcacaccaactgcccgtgtggagcacagatcaccggacatgtcaaaaatggttccatgaggatcgttgggcctaaaacctgcagcaacacgtggcatggaacattccccatcaacgcatacaccacgggcccctgcgtaccctccccagcgcccaattattccaaggcgctgtggcgggtggccgctgaggagtacgtggaggttacgcgggtgggggatttccattacgtgacgggcatgaccactgacaacgtaaagtgcccttgccaggttccggcccccgaattcttcacggaagtggatggggtgcggttgcacaggtacgctccggcgtgcaaacctctcctacgggaggaggtgacattccaggtcgggctcaaccaatacctggttgggtcacagctcccatgtgagcccgagccggatgtagcagtgctcacttccatgctcaccgacccctcccacattacagcagagacggctgggcgtaggctggccagggggtcccccccctcgctggccagctcttcagctagccagttgtctgcgccttccctgaaggcgacatgcacttcccaccattcttggaatgactccccggacgttgacctcatcgaggccaacctcctgtggcggcaggagatgggcggggacatcacccgcgtggagtcagagaataaggtagtaattctggactctttcgatccgcttcgagcggaggagggtgagagggaactctccgttgaggcggagatccttcgaaaacccaagaagttccccccagcgttgcccatatgggcgcgcccggactataaccctccattgctagagtcctggaaagacccggactacgtccctccggtggtgcacgggtgcccattgccacctaccaaggcccctccaataccgcccccacggagaaagaggacggttgtcctgacagagtccaccgtatcttctgccttggcggagcttgccactaagacctttggcagctccgagtcgtcggttgtcgccagcggcacggcgattgcttctcccgaccaggtctccgacgacggcgacaaagaatccgacgttgagtcgtactcctccatgcctccccttgaaggagagccgggggaccccgatctcagcgacgggtcttggtctaccgtaagtgaggaggccggtgagaatgtcgtctgctgctcaatgtcctacacatggacaggcgccctgatcacgccatgcgctgcggaggaaagcaagttgcccatcaacccgttgagcaactctttgttgcgtcaccataacatggtctatgccacaacatcccgcagcgcaggcctacggcagaagaaggtcacctttgacagactgcaagtcctggacgaccactaccgggacgtgctcaaggagatgaaggcgaaggcgtccacagttaaagccaagcttctatctatagaagaagcctgcaaactgacgcccccacattcagccaaatccaaatttggctacggggcgaaggacgttcggaacctatccagcaaggccgtcaaccacatccgctccgtgtggaaggacttgctggaagacactgagacaccaattgacaccaccatcatggcaaaaaatgaggtattctgtgtccaaccagagaaaggaggccgcaagccagctcgccttatcgtgttcccggacctgggagttcgtgtatgcgagaagatggccctttatgacgtggtctccacccttcctcaggccgtgatgggctcctcatacggattccaatactcccctggacagcgggtcgaattcctggtgaacgcttggaaatcaaagaaaagccctatgggcttctcatatgacacccgctgttttgactcaacggtcactgagaatgacatccgtactgaggagtcaatttaccaatgttgtgacttggcccccgaagccagacaggccataaagtcgctcacagagcggctctatattgggggccccctgactaattcaaaggggcagaactgcggctatcgccggtgccgcgcgagcggtgtgctgacaactagctgcggtaataccctcacatgttacttgaaggcctctgcagcctgtcgagctgcaaagctccgggactgcacgatgctcgtgaatggagacgaccttgtcgttatctgtgagagcgcgggaacccaagaggatgcggcgagtctacgagtcttcacggaggctatgactaggtactctgccccccccggggacccgccccaaccagaatacgacctggagttgataacatcatgttcctccaatgtgtcagtcgcgcacgatgcatctggcaaaagagtgtactacctcacccgtgatcccaccacccctcttgcacgggctgcgtgggagacagctagacacactccagttaactcctggctaggcaacatcatcatgtatgcgcccaccttatgggcaaggatggttctgatgactcactttttctccatccttctagcccaggagcaacttgacaaagccctggattgtcagatctacggggcctgttactccattgagccacttgacctacctcagatcatcgagcgactccatggtcttggcgcattttcactccatagttactctccaggtgagatcaatagggtggctgcatgcctcagaaaacttggggtaccacctttgcgagtctggagacatcgggccagaagtgtccgcgccaagctactgtcccagggggggagggccgccacttgtggtaagtacctcttcaactgggcagtaaaaaccaagctcaaactcactccaatcccggctgcgtcccggctggacttgtccggctggttcgtcgctggttacagcgggggagacatatatcacagcttgtctcgtgcccgaccccgctggtttatgttgtgcctactcctactttccgtaggggtaggcatctacctgctccccaagcgatgaacggggagctaaccact

SEQ ID NO: 684 - DNA, 9379 bp, Hepatitis C Virus
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggccagatcgttggtggagtttacctgttgccgcgcaggggccccaggttgggtgtgcgcgcgactaggaagacttccgagcggtcgcaacctcgtggaaggcgacaacctatccccaaggttcgccggcccgagggcaggacctgggctcagcccgggtacccttggcccctctacggcaatgagggcttggggtgggcaggatggctcctgtcaccccgcggctctcggcccagttggggccccacggacccccggcgtaggtcgcgtaacctgggtaaggtcatcgataccctcacatgcggcgtcgccgatctcatggggtacattccgctcgtcggcgcccccttagggggcgttgccagggccctggcgcatggcgtccgggttctggaggacagcgtgaactatgcaacagggaatctgcccggttgctctttctctatcttcctcctggctttgctgtcctgcttgaccaccccagcctccgcttacgaggtgcgcaacacgtccggggcgtaccatgttacgaacgactgctccaacgcaagtattgtgtatgaggcggcggacatcatcatgcatgcccccgggtgtgtgccctgcgttcgggagaacaactcctcccgctgctgggtagcgctcactcccacgctcgcggccaggaacgctagcatcccaactgcgacaatacgacgccacgtcgacttgctcgttggggcggctgctttctgctccgctatgtacgtgggggatctctgcgggtctgttttcctcgtctcccagctgttcaccttctcgccccgccggtattggacggaacaggactgtaattgttcaatctaccccggccacatatcaggtcaccgtatggcttgggatatgatgatgaactggtcgcctacaacagccctagtggtatcgcagttgctccggatcccacaagccgtcgtggacatggtggcgggggcccactggggagtcctggcgggccttgcctactattccatggtggggaactgggctaaggtcttgattgtgatgctactctttgccggcgttgacgggaacaccaggacaatgggggggtcggcaggccacaccatcaataggatgacgtccctattttctgccgggccgtctcagaacatccagcttataaacaccaacggtagctggcacatcaacaggactgctctgaactgcaatgattccctccagactgggttcatctccgcgctgttctacacacacaagttcaacgcgtccgggtgcccagagcgcatggccagctgccgccccattgcaacgttcagtcaggggtggggtcccatcacttacgctgagccggccagcttggaccagaggccctattgttggcactacgcacctcaaccgtgcggtattgtgcccgcgtcggaggtgtgtggcccagtctactgcttcaccccaagccctgttgtggtggggacgaccgatcgttccggcgtccctacgtataggtggggggagaatgagacggacgtgctgcttctcaacaacacgcggccgccgcaaggcaactggtttggctgttcatggatgaatagcactgggttcaccaagacgtgtgggggccccccgtgtaacatcgggggggtcggcaataacactttgacttgccccacggactgcttccggaagcaccccgaggccacttacacaaaatgtggctcggggccttggttgacacctaggtgcatagtgcactatccatacaggctttggcactacccctgcactgtcaactttaccatcttcaaggttaggatgtatgtggggggcgtggagcacaggctcgatgccgcgtgcaattggactcgaggggagcgttgcgacttggaggacagggatagatcagagcttagcccgctgctgctgtctaccacagagtggcagatattgccctgctccttcaccaccttaccggctctgtccactggtttgatccatctccatcagaacatcgtggacgtgcaatacctgtacggcatagggtcggtggttgtctcctttgtgatcaaatgggagtatatcgtgttgctcttccttctcctggcggacgcgcgcgtctgtgcttgcctatggatgatgatgttaatagctcaggctgaggccgccctagagaacttggtggtcctcaatgcggcatccgtggctggagcgcatggcttcctctccttccttgtattcttctgtgctgcctggtacatcaagggcaggctggtccctggggcggcatacgccttctatggcgtatggccgctattcctgctcctgctggcgttaccaccacgagcatacgccatggaccgggaaatggccgcgtcgtgcggaggcgcggttttcataggtttggcactcttgaccctgtcaccacactataaagtgttcctcgcgcggctcatatggtggttacaatattttatcaccagagttgaggcgcatttgcatgtgtgggtcccccccctcaacgttcgggggggccgcgatgccatcatcctcctcacgtgcgcagtccacccagagctaatcttttccatcaccaagattttgctcgccatattcggcccgctaatggtgctccaggctggcataacccgagtaccgtactttgtgcgtgctcaagggctcattcgtgcgtgcttgttggcgcggaaagttgctgggggtcattacgtccaaatggctttcatgaagctggccgcgctgacgggtacgtacgtctatgaccaccttactccactgcaggactgggcccatgcaggcctacgggaccttgcggtagcagttgagcccgttgtcttctctgacatggagaccaagatcatcacctggggggcagacaccgcggcgtgcggggacattatcttgggtctgcccgtctccgcccggagggggaaggagatttttctggggccggccgacaatcttgaagggcagggatggcgactccttgcacctatcacggcctactcccaacagacacggggcctacttggctgcatcatcactagcctcacaggccgggacaggaaccaggtcgagggggaggttcaagtggtctccaccgcaacacaatctttcctggcgacctgcgtcaacggcgtgtgttggactgtctaccatggtgccggcgcgaagaccttagccggtcctaagggtccgatcacccaaatgtacaccaatgtagaccaggacctcgtcggctggcaatcgccccctggggcgcgttccttgacaccgtgcacctgcggcagctcggacctttacttggtcacgaggcatgctgatgtcattccggtgcgccggcggggcgacagcagggggagcctactctcccccaggcccatctcctacttaaagggctcttcgggtgggccactgctctgcccctcgggacacgctgtgggcatcttccgggctgccgtgtgcacccggggggttgcaaaggcggtggattttgtacccgttgagtctatggaaactactatgcggtctccggtcttcacggacaactcgtcccccccggccgtaccgcagacattccaagtggcccatctacacgctcccactggcagcggcaagagtaccaaggtgccggctgcgtacgcagcccaggggtacaaggtacttgtcctgaacccgtccgttgctgctaccttaggttttggggcgtacatgtccaaagcacatggtatcgaacctagcatcagaactggggtgaggactatcaccacaggcgcccctatcacgtactccacctatggcaagttccttgctgacggtgggtgctctggaggcgcctacgacatcataatatgtgatgaatgccactcaactgactcgactaccatcttgggcgttggcacagtcctggaccaagcggagacggctggagcgcggcttgtcgtgctcgccaccgctacgcctccgggatcggtcaccgtgccacatcccaacatcgaggaggtggccctgtccaacgctggagagatacccttctacggtaaagccatccctatcgaggccatcaagggggggaggcatctcattttctgccattccaagaagaaatgtgacgaactcgccgcaaagctgtcgggcctcggactcaacgctgtggcgtactaccggggtcttgatgtgtccgtcattccggccagcggagacgtcgttgtcgtagcaacagacgctctaatgacgggctttaccggcgattttgactcagtgatcgactgtaatacatgtgtcacccagacagtcgatttcagcttggaccctaccttcaccattgagacgacgaccgtgccccaagacgcggtgtcgcgctcgcaacggcgaggcaggactggtaggggcagggcaggcatctacaggtttgtgactccaggagaacggccctcgggcatgttcgattcttcggtcctgtgcgagtgctatgacgcaggctgtgcttggtacgagctcacgcccgccgagacctcggttaggttgcgggcttacctaaacacaccagggttgcccgtgtgccaggaccatctggagttctgggagagcgtcttcacaggcctcacccatatagatgcccacttcttgtcccagactaagcaggcaggagacaacttcccctacctggtagcataccaagctacggtgtgcgccagggctcaggctccacctccatcgtgggaccaaatgtggaagtgtctcatacggctaaagcctacgctgcacgggccaacacccctgctgtataggctaggagccctccaaaacgaggtcactctcacacaccccataaccaaatacatcatggcatgcatgtcggctgacctggaggtcgtcacgagcacctgggtgctagtaggtggcgtcctcgcagctttggccgcgtattgcctgacaacaggcagcgtggtcattgtaggcaggatcatcttgtctggaaagccggccatcattcccgacagagaagttctttaccaggaattcgatgaaatggaagagtgcgcatcacaccttccttacatcgagcaggggatgcagctcgccgagcaattcaagcagaaggcgctcgggttgctgcaaacggccaccaagcaagcggaggctgctgctcccgtggtggagtccaagtggcgagcccttgagaccttttgggcgaagcacatgtggaatttcatcagcgggatacaatacttagcaggcttgtccaccctgcctgggaaccccgcgatagcatcattaatggcatttacagcttccatcaccagcccgctcaccacccaacacaccctcctgtttaacatcttggggggatgggtggccgcccagctcgctccccccagtgctgcttcggctttcgtgggcgccggcatcgccggcgcagctgttggcagcataggccttgggaaggtgcttgtggacatcctggcgggttatggagcaggagtggcaggcgcactcgtagcctttaaggtcatgagtggcgagatgccctccaccgaggacctggtcaacttgctccctgccattctctcccctggtgccctggtcgtcggggtcgtgtgcgcagcaatactgcgtcgacatgtgggcccgggagagggggctgtgcagtggatgaaccggctgatagcgttcgcttcgcggggtaaccatgtctcccccacgcactatgtgcctgaaagcgacgccgcagcgcgtgtcactcagatcctctccagccttaccatcactcaattgttgaagaggctccaccagtggatcaacgaggactgctccacgccgtgttccggctcgtggctaagggatgtttgggactggatatgcacggtgctggctgatttcaagacctggctccagtccaaggtcctgccacggttgccgggagttccatttctctcatgccaacgtgggtacaagggaatctggcgaggagacggcattatgcaaaccatctgcccatgtggagcacatatcgccggacatgtcaaaaacggttccatgaggatcgttgggcctaaaacctgcagcaacacgtggcatggaacattccccatcaacgcgtacaccacgggcccctgcacaccctccccggcgccaaactattccagggcgctgtggcgggtggctgctgaggagtacgtggaaattacgcgagtgggggattcccactacgtgacgggcatgaccactgacaacataaagtgcccatgccaagtcccggccccagaattcttcacagaactggatggggtgcggttgcacaggtacgccccggcgtgcaaacctctcctacgggaggaggtcacgttccaggtcgggctcaaccaatacgcggttgggtcacaactcccatgcgagcccgaaccggacgtaacagtgctcacttccatgctcaccgacccctcccacattacagcagaggcggctaagcgtaggctggccagggggtcccccccctccttggccagctcttcggctagccagttgtctgcgccttctctgaaggcgacatgcactacccgtcatgactccccagacgctgacctcattgaggccaatctcctgtggcggcaggagatgggcgggaacatcacccgcgtggagtcagagaataaggtggtaattttggactctttcgagccgcttcgggcggaggaggatgagggggaaatatccgtcccagcggagatcctgcggaaatccaggagattcccccgggcaatgcccgtatgggcacgcccggattacaaccctccactgatagagtcctggaaggacccggactacgtccctccagtggtgcacgggtgcccattgccacctaccaaggcgcccccagtgccacctccacggaggaagaggacgttcgtcctgacagagtccagtgtttcttctgccttggcggagctcgccacaaagacctttggtagctcggagtcgtcggccgtcgacagcggaacagcgaccgcccctcctgaccagccctcagacgacggcgacgcgggatccgacgttgagtcgtactcctccatgcccccccttgagggggagccgggggaccccgatctcagcgacgggtcttggtctaccgtcagcgaggaggttgacgaggatgtcgtctgctgctcaatgtcctacacatggacaggcgccctgatcacgccatgcgccgcggaagagagcaagctgcccatcaacgcgctgaacaactctttgctgcgccaccataacatggtctacgccacaacatcccgcagcgcaagccaacggcagaagaaggtcacctttgacagactgcaagtcctggacgaccactaccgggacgtgctcaaggagatgaaggcgaaggcgtccacagttaaggccaaactcctatccgtagaagaggcctgtaggctgacgcccccacactcagccagatccaaatttggctatggggcgaaggacgtccggagcctatccagtagggccatcaaccacatccactccgtgtggaaggacctgctggaagacactgagacaccaattcaaaccaccatcatggcaaaaaatgaggttttctgtgtccaaccagagaaaggaggtcgcaagccagctcgccttatcgtgttcccagatttgggggtccgtgtgtgcgagaaaatggccctttacgacgtggtctccactcttcctcaggccgtgatgggcgcctcatacggattccagtactctcctggacagcgggtcgagttcctggtgaatgcctggaagtcaaagaagtgccctatgggcttttcatatgacacccgctgtttcgactcaacggtcactgagaatgacatccgtactgaggagtcaatataccaatgttgtgacttggcccccgacgccagacaggctataaggtcgctcacagagcggctttatatcgggggtcccctgatcaattcaaaagggcagaactgcggttatcgccggtgccgcgcgagcggcgtgctgacgaccagctgcggtaataccctcacatgttacttgaaggccactgcggcctgtcgagctgcgaagctccaggactgcacgatgctcgtgtgcggagacgaccttatcgttatctgtgaaagcgcgggaacccaggaggacgcggcaaacctacgagtcttcacggaggctatgactaggtactctgccccccccggggacccgccccaaccagaatacgacttggagttgataacatcatgctcctccaatgtgtcggtcgcgcacgatgcatctggtaaaagggtgtactatctcacccgtgaccccaccacccctcttgcaagggctgcgtgggagacagctagacacactccagtcaactcctggctaggcaacatcatcatgtatgcgcccactctatgggctaggatgattctgatgactcacttcttctccatcctactagctcaggagcaacttgaaaaggccctggattgtcagatctacggggcctgctactccattgaaccacttgacctacctcagatcatccaacgactccatggtcttagcgcattctcacttcatagttactctccaggtgagatcaatagggtggcttcatgcctcaggaaacttggggtaccgcccttgcgagtctggagacatcgggccagaagtgtccgcgctaagctactgtcccagggggggagggccgccacttgtggcaagtacctcttcaactgggcagtgaagaccaagcttaaactcactccaattcccgcagcgtaccagctagacttgtccggctggttcgttgctggttacagcgggggagacatatatcacagcgtgtctcgtgcccggccccgctggtttatgtggtgcctactcctactgtctgtaggggtaggcatctacttgctccccaaccgatgaacggggagctaaccact

SEQ ID NO: 685 - DNA, 9379 bp, Hepatitis C Virus
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgcggaaggcgacaacctatccccaaggctcgccagcccgagggcagggcctgggctcagcccgggtacccatggcccctctatggcaatgagggcatggggtgggcaggatggctcctgtcaccccgtggctctcggcctagttggggccccacggacccccggcgtaggtcgcgtaatttgggtaaggtcatcgataccctcacatgcggcttcgccgacctcatggggtacattccgctcgtcggcgcccccctagggggcgctgccagggccctggcgcatggcgtccgggttctggaggacggcgtgaactatgcaacagggaatctgcccggttgctctttctctatcttcctcttggctttgctgtcctgcttgaccattccagcttccgcgtatgaagtgcgcaacgtgtccggagtgtatcaggtcacgaacgactgctccaacgcaagcattgtgtatgaggcagcggacatgatcatgcacacccccgggtgcgtgccctgtgttcgggagaataactcctcccgctgctgggtagcgctcactcccacgctcgcggccaggaacgctagcatccccaccacgacagtgcgacgtcacgtcgatctgctcgttggggcggctgctttctgctccgctatgtacgtgggggatctttgcggatctgtcttcctcgtctcccagctgttcaccttctcgcctcgccgacacgagacagtacaggactgcaattgctcgatctatcccggccacgtaacaggtcaccgcatggcttgggatatgatgatgaactggtcacctacagcagccctagtggtatcgcagctactccggatcccacaagctgtcgtggacatggtggcgggggcccactggggaatcctggcgggccttgcctactattccatggtggggaactgggctaaggtcttgcttgtgatgctactctttgccggcgttgacggggacaccaacgcggcgggggggtcggcagccagcaccacccacggggttgtgtctctcttcagccgtggggcgaaccagaaaatccagcttatcaacaccaacggcagctggcatatcaacagaactgccctgaactgcaacgagtctatcaacactgggtggcttgccgcgctgttctacacacacaagttcaacgcgtccggatgcccagagcgcctggctcactgccgctccattgatcagttcgcccaggggtggggtcccatcactcacactgtgccggccagctcggaccagaggccttactgttggcactacgcacctcgaccgtgcggcattgtacccgcgtcgcaggtgtgtggtccagtgtactgcttcaccccaagccctgttgtggtggggacgaccgaccgtttcggcgtccctacgtataggtggggggagaatgagacggacgtgctgcttctcaacaactcgcggccgccgctgggcaactggttcggctgtacatggatgaatagcaccgggttcaccaagacgtgtgggggccccccgtgtaacatcgggggggttggtaacaacaccttgacctgccccacggattgcttccgaaagcaccctgaggccacttacacaaaatgtggctcggggccttggctgacacctaggtgcatggttcactacccatacaggctctggcactacccctgcactgtcaactttaccatcttcaaggttaggatgtatgtggggggcgtggagcacaggctcaacgccgcatgcaattggactcgaggggagcgctgtgacttggaggatagggatagatcagagctcagtccgctgctgctgtctacaacagagtggcaggtattgccctgttccttcaccaccctgccggctttgtccactggtttaatccatctccatcagaacatcgtggacgtgcaatacctgtacggcatagggtcagtggttgtctcctttgcaatcaaatgggagtacatcatattgctcttccttctcctggcggacgcgcgcgtctgcgcttgcttgtggatgatgctgctgatagctcaggctgaggccgccttggagaacttggtggtccttaatgcggcttccgtggccggagcgcatggcaccctctccttccttgtgttcttctgtgctgcctggtacatcaagggcaggctggtcccgggagcggcatatgctttctatggcgtatggccgctgctcttgctcctgctggcgttaccaccacgagcgtacgccatggaccgggaaatggccggatcatgcggaggcgcggttttcataggtctggcactcttgaccttgtcaccacactataaagtgttcctcgccaggctcatatggtggctgcaatatttcagcaccagagccgaggcgctcttgcaagtgtggattccccccctcaacgttcgggggggccgcgatgccatcatcctcctcacgtgcgtgatccacccagagctaattttcaccatcaccaaaatcttgctcgccgtgctcggtccgcttatgatgctccaggctggcataaccaaggtgccgtacttcgtacgcgctcatgggctcattcgtgcgtgtatgctggtgcggaaggtcgctggaggtcattatctccaaatggctttcatgaagctggctgcactgacaggcacgtacgtttatgaccatcttactccactgcgggactgggcccacgcgggcctgcgggaccttgcggtggcagtcgagcctgttgtcttctctgacatggagactaaaatcatcacctggggggcagacaccgcggcgtgtggagacatcatttccggcctgcccgtctccgcccgaagggggagggagatacttctgggaccggcggatagtcttgagggccaggggtggcggcttcttgcgcctatcacggcctacgcccaacagacgcgaggtctacttggctgcatcatcaccagcctcacaggccgggacaagaaccaagtcgagggggaggttcaagtggtttccaccgcaacacaatccttcctggcaacctgtgtcaacggcgtgtgttggactgtctatcatggtgccggctcaaaagccctagccggccaaaaggggccagtcacccaaatgtacaccaatgtggaccaggacctcgttggctggcaagcgccccccggggcgcgctccttgacaccgtgcacctgcggcagctcggacctttacttggtcacgaggcatgctgatgtcattccggtgcgccggcggggcgacagcagggggagcctactctcccccaggcccgtctcctacctaaagggctcctcgggtggtccactgctctgcccctcggggcacgctgtgggcatcttccgggctgctgtgtgcacccggggggttgcgaaggcggtggactttgtaccggttgagtctatggaaactaccatgcggtccccggtctttacggacaattcgtcccccccggccgtaccgcagacattccaagtggcccatctgcacgcccccactggcagcggcaagagcactaaggtaccggccgcgtacgcgtcccaagggtacaaggtgctcgtcctgaacccgtccgttgccgccaccttagggttcggggcgtatatgtctaaggcacatggtgtcgaccctaacatcagaaccggggtaaggaccatcaccacgggcgcccccatcacgtactccacctacggcaagttccttgccgacggtggttgttctgggggggcctatgacatcataatatgtgatgagtgccactcaactgactcgactaccatcctgggcatcggcacagtcctggaccaagcggagacggctggagcgcgactcgtcgtgctcgccaccgctacgcctccgggatcagtcaccgtgccacatcccaacatcgaggaggtggccctctccaacactggagagatccccttctatggcaaagccatccccatcgagaccatcaagggggggaggcacctcatcttctgccattccaagaagaaatgtgatgagctcgccgcaaagctgtcggccctcggactcaatgcagtagcatattaccggggtcttgatgtgtccgtcataccgactagcggagacgtcgttgtcgtggcaacagacgctctaatgacgggctttaccggcgattttgactcagtgatcgactgtaatacatgtgtcacccagacagtcgatttcagcttggaccctaccttcaccattgagacgacaaccgtgccccaagacgcagtatcgcgctcgcagcggcgaggcaggactggtaggggcaggatgggcatctataggtttgtgactccaggggaacggccttcgggcatgttcgactcctcagtcctgtgcgagtgctatgacgcgggctgtgcttggtacgagctcacgcccgccgagacctcggttaggttacgggcttacctaaatacaccagggttgcccgtctgtcaggaccatctggagttctgggagagcgtcttcacaggcctcacccacatagatgcccatttcttgtcccagactaagcaggcaggagataatttcccctacctgacagcataccaggctacagtgtgcgccagggctcaggctccacctccatcgtgggatcaaatgtggaaatgtctcatacggctgaaacctacgctgcatgggccaacgcccctgctgtataggctaggagccgtccaaaacgaggtcaccctcacacaccccataaccaagtacatcatggcatgcatgtcggctgacctggaggtcgtcacgagcacctgggtgctggtgggcggagtccttgcagctctggccgcgtactgcttgacaacaggctgcgtggtcattgtgggcaggatcatcttgtccggaaagccggcagttattcccgacagggatgttctctaccaagagttcgacgagatggaagagtgcgcctcgcacctcccttacatcgaacagggaatgcagctcgccgaacaattcaagcagaaggcactcgggttgctgcagacagccaccaagcaagcggaggctgctgctcccgtggtggagtccaagtggcgagcccttgagaccttctgggcgaagcacatgtggaatttcatcagcgggatacagtacttagcaggtttgtccaccctacctggaaaccccgcaatagcatcactgatggcattcacagcctctatcactagcccgctcaccacccaacacaccctcctgtttaacatcttggggggatgggtggctgcccaactcgctcctcccagcgccgcttctgctttcgtaggcgccggcatcgccggtgcggctgttggcagcataggccttgggaaggtacttgtggacatcctggcgggttatggggcaggggtagcgggcgcacttgtggccttcaaagtcatgagcggcgagatgccctccaccgaggacttagtcaacttgctccctgccattctctcccctggtgccctggtcgtcggggtcgtatgcgcagcaatactgcgtcgacatgtgggcccgggggagggggctgtgcagtggatgaaccggctgatagcgttcgcctcgcggggtaaccatgtctcccccacgcactatgtgcccgagagcgacgccgcagcacgtgtcactcagatcctctccagccttaccatcactcagctgttgaagaggctccaccagtggattaacgaggactgctccacgccatgctccggctcgtggctgagggatgtttgggactgggtatgcgcggtgctgactgatttcaagacctggctccagtccaagctcctgccgcggttaccaggagtccccttcttctcatgtcaacgtgggtataaggggatctggcggggagacggcatcatgcacaccacttgcccatgtggagcacaaatcaccggacatgtcaaaaacggttccatgaggatcgttgggcctaaaacctgcagcaacacgtggcatggaacattccccatcaacgcatacaccaccggcccctgcacaccctctccggcgccaaactattccagggcgctgtggcgggtggctgctgaggagtacgtggaggttacgcgggtgggggacttccactacgtgacgggcatgaccactgacaacgtaaaatgcccatgccaggttccggcccctgagttcttcacagaagtggatgggatacggctgcacaggtacgccccggcgtgcaaacctctcctacgggaggaggtcacattccaggtcgggctcaaccaatacctggttggatcacagcttccatgcgagcccgaaccggatgtagcagtgctcacttccatgctcaccgacccctcccacattacagcagagacggctaagcgtaggctggccagggggtctcccccctccctggccagctcttcagctagccagttgtctgcgccttctttgaaggcgacatgcactacccgtcatgactccccggacgctgacctcatcgaggccaacctcctgtggcggcaggagatgggcgggaacatcacccgtgtggagtcagagaacaaagtagtgattttggactctttcgagccgcttcaagcggaggaggatgaaagggaaatatccgtcgcagcggagatcctgcggaaatccaggaaatttccccgggcgatgcccgtgtgggcacgcccagattacaaccctccattgctagagtcctggaaggacccggactacgtccctccggtggtacatggatgcccattgccacctaccaaggcacctccaataccacctccacggaggaagaggacggttgtcctgacggagtccaccgtgtcttctgccctggcggagcttgctacaaagaccttcggcagctctgaatcgtcggccgtcgacagcggcacggcgactgcccctcctgaccaggcctccggcgacggtggcgcaggatccgacgtcgagtcgtactcctccatgcctccccttgagggagagccgggggaccccgatcttagcgacgggtcctggtctaccgtgagcgaggaggctagtgaggacgtcgtctgctgttcgatgtcctacacatggaccggcgctctaattacaccatgcgccgcggaggaaagcaagctgcccatcaatgcgctgagcaactctctacttcgtcaccacaacatggtgtatgccacaacatcccgcagcgcaagccagcggcagaagaaggtcacttttgacagaatgcaagtcctggacgaccactaccgggacgtgctcaaggagatgaaggcgaaggcgtccacagttaaggccaaacttctatccgtagaggaagcctgtaagctgacgcccccacattcggccagatccaagtttggctatggggcaaaggacgtccggaacctatccagcaaggccactaaccacatccgctccgtgtggaaggacttgctggaagactctgagacaccaattgacactaccgtcatggcaaaaaatgaggttttctgcgtccaaccagagaaaggaggccgcaagccagctcgccttatcgtgttcccagacttgggggttcgtgtgtgcgagaagatggctctttacgacgtggtctccacccttcctcaggccgtgatgggcccctcatacggattccagtactctcctgggcagcgggtcgagttcctggtgaatgcctggaaatcaaagaagaaccctatggggttcgcatatgacacccgctgctttgactcaacggtcactgagaatgatatccgtgttgaggagtcaatctaccaatgttgtgacttggcccccgaggccagacaggccataaggtcgctcacagagcggctttatatcgggggtcctctgactaattcaaaaggccagaactgcggttatcgccggtgccgcgcaagcggtgtgctgacgactagctgcggtaataccatcacatgttacttgaaggcctccgcagcctgtcgagctgcgaagctccaggactgcacaatgctcgtgtgcggagacgaccttgtcgttatctgtgagagcgcgggaacccaggaggacgcggcgagcctacgagtcttcacggaggctatgactaggtattccgccccccccggggacccgcctcaaccagaatacgacttggagttgataacatcatgctcctccaatgtgtcagtcgcgcacgatgcatctgggaaaagggtgtactacctcacccgtgaccccaccaccccccttgcacgggcagcgtgggagacagctagacacactccagtcaactcctggctaggcaacatcatcatgtatgcgcccaccttatgggcaaggatgattctgatgactcactttttctctatccttctagcccaggagcaacttgaaaaagccctggattgtcagatctacggggcctgttactccattgagccacttgacctacctcagatcattcaacgactccacggtcttagcgcattttcactccatagttactctccaggtgagatcaatagggtggcttcatgcctcaggaaacttggggtgccgcccttgcgagtctggagacatcgggccagaagtgttcgcgctaagttgctgtcccagggggggagggctgccacttgtggcaagtacctcttcaactgggcagtaagaaccaagcttaaactcactccaattccggctgcgtcccacctggacttgtccggctggttcgttgctggttacagcgggggagacatatatcacagcctgtctcgtgcccgaccccgctggttaatgtggtgcctactcctactttctgtgggagtaggcatttacctgctccccaaccgatgaacggggagctaaccact

SEQ ID NO: 686 - DNA, 9379 bp, Hepatitis C Virus
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggatgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcatcatgagcacgaatcctaaaccccaaagaaaaaccaaacgtaacaccaaccgccgcccacaggacgtcaagttcccgggcggtggtcagatcgttggtggagtttacctgttgccgcgcaggggccccaggttgggtgtgcgcgcgcctaggaagacttccgagcggtctcaacctcgtggaaggcgacaacctatccccaaggctcgccagcccgagggtaggacctgggctcagcccgggtacccatggcccctctacggcaacgagggcatggggtgggcaggatggctcctgtccccccgtggctcccggcctagctggggccccacggacccccggcgtaggtcgcgtaatttgggtaaggtcatcgataccctcacatgcggcttcgccgacctcatggggtacattccgctcgtcggcgcccccctagggggcgttgccagagccctggcacatggtgttcgggttctggaggacggcgtgaactacgcaaccgggaatctgcccggttgctctttttctatcttcctcttggctttgctgtcctgtttgaccaccccagcttccgcttatgaagtgcgcaacgcgtccgggatataccatgtcacgaacgactgctccaactcaagcatcgtgtatgaggcagcggacttgatcatgcatacccccgggtgcgtgccctgcgttcgggagggtaactcctcccgttgctgggtggcgcttgctcccacgctagcggccaggaatgccagcgttcccactacaacaatacgacgtcatgtcgatgtgcttgttggggcggctgtcctctgctccgctatgtatgtgggggatctctgcggatctgttttccttgtctcccagttgttcaccttctcgcctcgccggcacgagacggtacaggactgcaattgctcaatctatcccggccacgtgtcaggccatcgcatggcttgggatatgatgatgaactggtcgcccacaacagccttagtggtgtcgcagttactccggatcccacaagctgtcatggatatggtggcgggggctcactggggagtcctagcgggccttgcctactattccatggtggggaactgggctaaggtgttgattgtgatgctactttttgccggcgttgacgggaagacccgcgtgacaggggggacggcagcctacaccaccaactcgctcacgaacctcttcacccgtggggcgtctcaggaaatccagcttatatacaccaacggcagctggcacatcaacaggactgccttgaattgcaatgacaccctccggactggattccttgccgcgctgttctacacacacaagttcaacgcgtccggatgtccggagcgcatggccagctgccgccccattgacaagttcgctcaggggtggggtcccatcacttatgctgagcagagcggccaggaccagaggccttactgctggcactatgcacccaaaccgtgtggtattgtacccgcgtcgcaggtgtgtggtccagtgtactgtttcaccccaagcccggttgtggtggggaccaccgatcgttccggtgtccctacgtatagctggggggggaatgagacagacgtgctgctccttaacaacacgcggccgccgcaaggcaactggttcggttgtacgtggatgaacagcactgggttcaccaagacgtgcggaggccccccgtgcaacatcggaggggtcggcaatgacaccttgatctgccctacggactgcttccggaagcaccccgaagctacttacacaaaatgtggctcggggccttggctgacacccaggtgcctagttgactacccatacaggctctggcactacccctgcactgtcaacttcaccgtcttcaaggttaggatgtatgtagggggcgtggagcacaggcttgatgctgcatgcaactggacccgaggagaacgttgtgatttggaggacagggatagatcggagctcagcccgctgctgctgtctacaacagagtggcagatactgccctgttcctacaccaccctaccggctctgtccactggtttaatccatctccatcagaacatcgtggacgtacaatacctgtacggtatagggtcggcggttgtctcctttgtggttaaatgggagtatgtcgtgttgctcttccttctcctggcggacgcacgcgtctgtgcctgcttgtggatgatgttgctgatagcccaagccgaggccgccttagagaacttggtggtcctcaatgcggcgtccgtggccggaacgcatggcattctctccttccttgtgttcttctgtgctgcctggtacatcaagggcaggctggtccctggggcggtgtacgctatctatggcgtatggccgctgctcctgctcctgctggcgttaccaccacgagcttacgccatggagcgggagatggctgcgtcgtgtggaggcggggttttcgtaggtctggtgctcttgaccttgtcaccatactataaagtgttcctcgctaggctcctatggtggttacaatacttcatcaccagagccgaggcgcacttgcaagtgtgggtcccccccctcaacatccgggggggccgcgatgccatcatcctcctcgcgtgtgtggtccacccagagctaatctttgacatcaccaaactcctgctcgccatagtcgggccgctcatggtgctccaggccagcttaattaaagtgccgtacttcgtacgcgcacaagggctcattcgtgcatgcatgttggtgcggaaagcggctgggggtcattatatccaaatggccctcatgaagctcgccgcactgacaggcacgtacgtttatgaccatctcactccactgcaggactgggcccacgcgggcttgcgagacctcgcggtggcagtagagcccgtcgtcttttctgacatggagaccaagatcatcacctggggggcagacaccgcggcatgcggggacatcatcttggggttgcctgtctccgcccgaaggggaaaggagatatttctggggccggccgacagtcttgaaggacaggggtggcggctccttgctcccatcacggcttactcccaacagacacggggcctacttggttgcatcatcactagcctcacaggccgggacaagaaccaagtcgagggggaggttcaagtggtttctaccgcgacacaatccttcctggcgacctgcgtcaacggcgtgtgttggactgtctatcatggcgccggctcaaagaccctagccggcccaaaaggcccaatcactcaaatgtacaccaatgtggacctggacctcgtcggctggccggcgccccccggggcgcgttccttgacaccatgtacctgcggtagctcggacctttacttggtcacgagacatgctgatgtcattccagtgcgccggcggggcgacagcagggggagcctactctcccctaggcctgtctcctacttgaagggctcttcgggtggtccgctgctctgtccttcggggcacattgtgggcatcttccgggctgctgtgtgcacccggggggttgcgaaagcggtggacttcatacccgttgagtctatggaaactaccatacggtctccggtcttcacggataactcatcccccccggccgtaccgcagaccttccaagtggcccatctacatgcccccactggcagcggtaaaagcactaaggtgccggctgcatatgcagcccaagggtacaaggtactcgtcctgaacccgtccgtcgctgccaccttgggttttggggcgtatatgtccaaagcacatggtatcgaccccaacatcagaaccggggtacgggccatcaccacgggcgcccctatcacatactccacctatggcaagttccttgccgacggtggttgttcagggggcgcctatgacatcataatatgtgatgagtgccactcaactgactcaactaccatcttaggcattggcacagtcctggaccaggcggagacggctggagcgcggctcgtcgtgctcgccaccgctacgcctccgggatcggtcaccgtgccacaccccaacatcgaggaggtggccctgtccaacactggagagatccccttctacggcaaagccatccccattgaggtcattaaggggggaagacatctcattttctgccattccaagaagaaatgtgacgagctcgccgcaaagctgtcaagcctcggactcaatgccgtagcgtattatcgaggtcttgatgtgtccgtcataccgaccagcggagacgtcattgtcgtggcgacagacgctctaatgacgggctttaccggcgactttgactcagtgatcgactgtaacacatgtgtcacccagacagtcgactttagcttggatcccaccttcaccattgagacgacgactgtgccccaggacgcagtgtcgcgctcacaacggcgcggtaggactggcaggggtaggatgggcgtctacaggtttgtgactccaggggaacggccttcgggtatgttcgattcctcggtcctgtgtgagtgctatgacgcgggctgtgcttggtacgagctcacgcctgccgagacttcagttaggttgcgggcttacctgaatacaccagggttgcccgtctgccaggaccatctggagttctgggagggtgtctttacaggcctcacccacatagacgcccacttcctgtcccagactaagcaagcaggagacaacttcccctacctggtagcataccaagccacagtgtgtgccagagcccaagctccacctccatcatgggatcaaatgtggaaatgcctcatacggctcaaacctacgctgcacggtccaacacccctgctgtataggctaggagccgttcaaaatgaggttaccctcacacaccccataaccaaatacatcatgacatgcatgtcggctgacctggaggtcgtcactagtacctgggtgctagtaggcggagtcctcgcagccctggccgcatattgcctgacaacaggcagcgtggtcattgtgggcaggatcatcttgtccgggaggccggctgttgttcccgacagggaagtcctctatcagcagttcgatgagatggaagagtgtgcctcgcacctcccttacatcgagcagggaatgcagctcgccgagcaattcaaacagaaagcgctcgggttgctgcaaacagccaccaagcaagcggaggctgctgctcccgtggtggaatccaagtggcgagcccttgagaccttctgggcaaagcacatgtggaatttcatcagcgggatacagtacttagcaggcttatccactctgcctggaaaccccgcgatagcatcattgatggcattcacagcctctattaccagcccgctcaccacccaaagtaccctcctatttaacatcttgggaggatgggtggctgcccaactcgccccccccagtgctgcttcggctttcgtcggcgccggcatcgccggtgcggctgtcggtagcataggcctcgggaaggtgcttgtggacattctggcaggatatggggcgggggtggctggcgcactcgtagcctttaagatcatgagtggcgaggcgccctccaccgaggatctggttaatttactccctgccatcctctctcccggcgccctggtcgtcggggttgtgtgcgcggcaatactacgtcggcacgtggggccgggagaaggggctgtgcagtggatgaaccggctgatagcgttcgcctcgcggggtaaccacgtctcccccacgcactatgtgcctgagagcgacgctgcagtgcgtgtcactcagatcctctccagccttaccgtcactcagctgctgaagaggcttcaccggtggattaatgaggactgctccacgccgtgctccggttcgtggctgagggatgtttgggactggatatgcacagtgttgagtgacttcaaaacctggctccagtccaagctcttgccgcggttacctggagtcccctttctctcgtgccaacgcgggtacaagggggtctggcggggggacggcatcatgcacaccacctgcccgtgtggagcacaaatcgccggacatgtcaagaacggttccatgaggatcgttgggcctaaaacctgcagcaacacgtggcatggaacattccccatcaacgcatacaccacgggctctagcacacccaccccggcgccaaactattccaaggcgttgtggcgggtggctgctgaggagtacgtggaggtcacgcgggtaggggatttccactacgtgacgggcatgaccactgacaacgtgaaatgcccgtgccaggttccggcccccgaattcttcacggagttggatggggtacggctgcataggtacgctccggcgtgcaagcctctcctacgggaggaggtcacataccaggtcgggctcaaccaatacttggttggatcacaactcccatgcgagcccgaaccggatgtagcggtgctcacttccatgctcaccgatccctcccacatcacagcagagacggcaaggcgtagactggccagggggtcccccccctccttggccagctcctcagctagccagttgtctgcgccttccttgaaggcaacatgcactacccatcgtgactccccggacgttgacctcatcgaggccaacctcctgtggcgacaggagatgggcgggaacatcacccgcgtggagtcagagaataaggtagtaattctggactctttcgagccgcttcgagcggaggaggacgagagggaaccatccgttccggcggagatcttgcggaaatccaagaggttccccgcagcgctgcccgtatgggcacgcccggattacaaccctccattgctagagtcctggaaggacccggactacgtccctccagtggtacacgggtgccctttgccacctaccaaggcccttccagtgccaccaccacggagaaaaaggacggttgtcctgacagagtccactgtgtcttctgccttggcggagttcgccactaagacctttggcagctccggatcgtcggctgtagacagcggcacggcgaccgctcctcccgaccaagcctccaacgacggcgacaaagaatccgacgttgagtcgtactcctccatgccccctcttgagggagagccgggggaccccgatcttagcgacgggtcttggtctaccgtgagcgaggaggctagtgaggacgtcgtctgctgctcaatgtcctacacatggacgggcgccctgatcacgccatgcgctgcggaggaaagcaagctgccaatcaacccgttgagcaactctttgctgcgtaaccacaatatggtctacgctacaacatcccgcagcgcaagcctacggcagaagaaggtcacctttgacagactgcaagtcctggacgaccactaccgggacgtgctcaaggagatgaaggtgaaggcgtccacagtcaaggctaaacttctatctatagaggaagcctgcaaactgacgcccccacattcggccaaatcccaatttggctatggggcgaaggacgtccggaacctatccagcaaggccgttaaccacatccgctccgtgtgggaggacttgctggacgacactgagacaccgattaacaccaccatcatggcaaaaagtgaggtattctgcgtccaaccagagaagggaggccgcaagccagctcgccttatcgtattcccagacctgggggttcgtgtatgcgagaagatggccctttatgacgtggtctccacccttcctcaggccgtgatgggctcctcatacgggttccaatactcccctggacagcgggtcgagttcctggtgaacgcctggaaatcaaagaaaagccctatgggcttctcatatgacacccgctgctttgactcaacggtcactgagagtgatatccgtgttgaggagtcaatttaccaatgttgtgacttggcccccgaagccagacaggctataaagtcgctcacagagcggctctatatcgggggtcccctgaccaattcaaaagggcagaactgcggttatcgccggtgccgcgcgagcggcgtgctgacgactagctgcggtaataccctcacatgttacctgaaggcctctgcagcctgtcgagctgcaaagctccgggactgcacgatgctcgtgaacggagacgaccttgtcgttatctgtgaaagcgcgggaacccaagaggatgaggcgaacctacgagtcttcacggaggctatgactaggtactctgccccccctggggacccgccccgaccgacatatgatttggagttgatatcatcatgttcctccaatgtgtcggtggcgcacgatgcatctggcaaaagggtgtactacctcacccgtgaccccaccacccccttcgcacgggctgcgtgggagacagcaagacacactccagtcaactcctggctaggcaacatcatcatgtatgcgcccactttatgggcaaggatggttttgatgactcacttcttttccatccttatggcccaggagcagcttgaaaaagccctagattgtcaaatctacggggcctgttactccattgagccacttgacctacctcagatcattgaacgactccatgggcttagcgcattttcactccatagttactctccaggtgagatcaatagggtggcttcatgcctcaggaaacttggggtaccacccttgcgagtctggagacatcgggccagaagtgtccgcgctaagctactgtcccggggggggagggccgctacttgtggcaagtacctcttcaactgggcggtaaggaccaaactcaaactcactccaattccggctgcgtcccagttggacttgtccaattggttcgttgctggttacagcgggggagacatatatcacagcctgtctcgtgcccgaccccgttggttcatgtggtgcctactcctactttctgtaggggtaggcatctacctactccccaatcggtgaacggggagctaaccact

SEQ ID NO: 687 - DNA, 9377 bp, Hepatitis C Virus
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccagcccgagggcagggcctgggctcagcccgggtacccttggcccctctatggcaacgagggcatggggtgggcaggatggctcctgtcaccccgcggctcccggcctagttggggccccaacgacccccggcgtaggtcgcgtaatttgggtaaggtcatcgataccctcacatgcggcttcgccgacctcatggggtacattccgcttgtcggcgcccctctaggcggcgctgccagggctctggcacacggtgtccgggttctggaggacggcgtgaactatgcaacagggaatttgcccggttgctctttctctatcttcctcttggctctgctgtctggtttgaccaccccagcttccgcttacgaagtgcgcaacgtgtccgggatataccatgtcacgaacgactgctccaacacaagtattgtgtatgaggcagcggacgtcatcatgcatattcccgggtgcgtaccctgcgttcgggaaaacaacatctcccgttgctgggtagcgctcgctcccacgctcgcagctaggaacatcagcgtccccactacgacaatgcgacgccatgtcgacttgctcgttggggcggccgccttctgctccgctatgtacgtgggggatctctgcggatctgtcttcctcatctcccaattgttcaccttctcacctcgccggcatgagacagtgcaggactgcaactgctcactctatcctggccatgtatcaggtcaccgcatggcttgggatatgatgatgaactggtcacctacaacggccctagtgctgtcgcagctactccggatcccacaagctgtcgtggatatggtggcgggggcccactggggagtcctggcgggccttgcctactattccatggtagggaactgggctaaggttttgattgtgatgctgctttttgccggcgttgacgcggacacccacgtgacagggggggtgtatgcccacaccacccaagggtttgcgtccctctttgcacctggggcttctcagaacatccagctcataaacaccaatggcagctggcacatcaacaggactgccctgaactgcaatgattccctcaagactgggttccttgccgcgctgttctacacacacgagttcaacgcgtccggatgcccagaacgtatggccagctgccgtcccatcgaccagttcgatcagggatggggtcccatcacctatactgagcctaacagtccggaccagaggccttattgctggcactacgcacctcgaccgtgtggtatcgtacccgcgtcgggggtgtgtggtccggtgtattgcttcaccccaagccctgttgtggtggggacgaccgatcgttccggtgtccctacgtatagctggggggagaatgagacggacgtgctgctcctcaacaacacgcggcctccgcaaggcaactggttcggctgtacatggatgaacagcactgggttcactaagacgtgtgggggccccccgtgtaacatcgggggggccggcaacaacaccttgatctgccccacggattgcttcaggaagcaccccgaggccacttacacaaaatgtggctcggggccttggttgacacccaggtgcttagtcgactacccatacaggctctggcattacccctgcaccgtcaactttaccatcttcaaggttaggatgtatgtggggggcgtggagcacaggctcaacgctgcttgcaattggacccgaggagagcgctgtgacttggaggacagggacagatcagaactcagcccgctgctgctgtctacaacagagtggcagatactgccctgctctttcaccaccctaccggctctgtccactggtttgatccacctccatcggaacatcgtggacgtgcaatacctgtacggcatagggtcggcggttgtctcctttgcaatcaaatgggagtatgtcgtgctgctcttccttctcctggcagacgcgcgcgtctgtgcctgcttgtggatgatgctgctgatagcccaggctgaggccgccttagagaacttggtggtcctcaatgcggcgtccgtggccggagcgcatggcaccctctccttccttgtgttcttctgtgccgcctggtacattaagggcaggctggtccccggggcggcatacgctttctatggcgtgtggccgctactcctgctcctgttggcgttgccgccacgagcttacgccatggaccgggagatggctgcatcgtgtgggggtgcggtttttgtaggtctggcactcttgaccttgtcaccatactacaaagtgttcctcgctaggctcatatggtggttacaatacttcatcaccagagccgaggcgcacttgcaagtgtggatcccccccctcaacgtccggggaggccgcgacgccatcatcctcctcacgtgcgcggtccacccagagctaatctttgacatcaccaaactcctgctcgccatactcggtccgctcatggtgctccaggctgccataactaagatgccgtacttcgtacgcgctcaagggcttattcgtgcatgcatgttagtgcggaaagccgctgggggtcattatgttcaaatggccctcgtaaagctggccgcgctgacaggtacgtacgtttatgaccatctcaccccactgcagcattgggcccacgcgggcctacgagaccttacggtggcagtagagcccgtcgtcttctctgacatggagaccaagatcatcacttggggggcagacaccgcggcgtgcggggacatcatcttgggtctgcccgtctccgcccgaaggggaagggagatactcctgggaccagccgatagccttgaagggcaggggtggcgactcctcgcacccatcacggcctactcccaacagacgcggggcttacttggttgcatcatcactagcctcacaggccgggacaagaaccaggtcgagggggaggttcaagtggtttcgaccgcaacacaatctttcttggcgacctgcgtcaacggcgtgtgttggaccgtctatcacggcgccggctcaaagactctggccggcccaaaaggcccaatcactcaaatgtacaccaatgtagaccaggacctcgtcggctggcaagcgccccccggggcgcgctccatgacaccatgcacctgtggcagctcggacctttacttggtcacgagacatgccgatgtcatcccggtgcgccggcggggcgacggcagggggagccttctctcccccaggcccgtctcctacttgaagggttcttcgggtggtccgctgctctgccccttggggcatgtcgtgggcatcttccgggccgctgtgtgcacccggggggttgcgaaggcggtggactttgtgcccgtcgagtccatggaaactaccatgcggtctccggtcttcacagacaactcatccccaccggccgtaccgcagacattccaagtggcccatctacacgcccccactggcagcggcaagagcaccaaagtgccggctgcatatgcagcccaagggtacaaggtacttgtcttgaacccgtccgttgccgccaccttgggttttggggcgtacatgtctaaggcatatggcactgaccctaacatcagaactgggataaggaccatcaccacgggcgcccccattacgtactccacctatggcaagttccttgccgacggtgggtgctccgggggtgcctatgacatcataatatgtgatgagtgccactcaactgactcgactaccattctgggcatcggcacagtcctggatcaagcggagacggctggagcgcggctcgtcgtgctcgccaccgctacacctccgggatcagtcaccgtgccacaccccaacatcgaggaggtggccctgtccaccactggagagatccccttctatggcaaagccatccccatcgaggtcatcaaggggggaaggcatctcattttctgccattccaagaaaaagtgcgacgagctcgccgcgaagctgtcagccctcggactcaatgctgtagcgtattaccggggtcttgatgtgtccgtcataccgactagcggagatgtcgttgtcgtggcaacagacgctctaatgacgggctatactggcaactttgattcagtgattgactgcaacacatgcgtcacccagacagtcgactttagcttggaccccaccttcaccatcgaaacgacgaccgtgcctcaagacgcggtgtcgcgctcgcagcggcgaggtaggactggcaggggtaggggaggcatctacaggtttgtgactccaggagaacggccctcgggcatgttcgattcttcggtcctgtgtgagtgctatgacgcgggttgtgcgtggtacgagctcacgcccgctgagaccacagttaggttgcgggcatacctaaatacaccagggttgcccgtctgccaggaccatctggagttctgggagggcgtcttcacaggcctcacccatatagatgctcatttcttgtcccagactaagcaggcaggagacaacttcccctacctggtggcataccaggctacagtgtgcgccagggctcaggctccacctccatcgtgggaccaaatgtggaagtgtctcatacggctaaaacctacactgcacgggccaacacccctgttgtataggctaggagccgtccaaaatgaggtcaccctcacacaccccataaccaaatacatcatgacatgcatggcagctgacctggaggtcgtcaccagcacctgggtgctggtaggcggggtccttgcagctctggccgcgtattgcctgacaacaggcagcgtggtcattgtgggcaggatcatcttgtccgggaaaccggctgtcatccccgacagggaagttctttaccgagagttcgatgagatggaggagtgcgcttcacacctcccttatatcgaacagggaatgcagctcgccgagcaattcaaacagaaggcgctcgggttgctgcaaacagccaccaagcaagcggaggctgctgctcccgtggtggagtccaagtggcgagcccttgagaccttctgggcgaagcacatgtggaatttcatcagcgggatacagtacttagcaggcttatccactctgcctgggaaccccgcgatagcatcactgatggcattcacagcctctgtcaccagcccgctcaccacccaaagtaccctcctgtttaacatcctggggggatgggtggctgcccaactcgctcctcccagcgctgcttcggctttcgtaggcgccggcatcgccggtgcggctgttggcagcataggccttgggaaagtgcttgtggacatcctggcgggctatggggcaggggtggctggcgcacttgtagcttttaagatcatgagcggcgaggcgccctccaccgaggacctggttaacttgctccctgccatcctctctcctggcgccctagtcgtcggggtcgtgtgcgcagcaatactgcgtcggcacgtgggcccgggggagggggctgtgcagtggatgaaccggctgatagcgttcgcttcgcggggcaaccacgtctcccccacgcactatgtgcctgaaagcgacgctgcagcgcgtgttactcagatcctctccagccttaccatcactcagctgctgaagaggctccaccaatggatcaatgaggactgctccacgccatgctccggctcatggctaagggatgtttgggactggatatgcacggtattgagtgactttaagacctggctccagtccaaactcatgccgcggctgccgggagtccccttcttctcatgccaacgcgggtacaagggagtctggcggggggatggcatcatgcaaaccacctgcccatgtggagcacaaatcaccggacatgtcaaaaacggttccatgaggatcgttgggcctaaaacctgcagcaacacgtggcacggaacattccccatcaacgcatacaccacgggcccctgcacaccctccccagcgccgaactattccaaggcgttgtggcgggtggctgctgaggagtacgtggaggttacgcgggtgggggatttccactacgtgacgggcatgaccactgacaacgtaaaatgcccttgccaggtcccggcccccgaattcttcacggagttggatggggtgcggctgcacaggtatgctccggtgtgcaaacctctcctacgggaggaggtcacattccaggtcgggctcaaccaattcccggtcgggtcacaactcccatgcgagcccgaaccggatgtagcagtgctcacttccatgctcaccgacccctcccacattacagcagagacggctaagcgtaggctggccagggggtctcccccctccttggccagctcttcagctagccagttgtctgcgccttccttgaaggcgacatgcactacccatcatgactccccggacgctgacctcatcgaggccaacctcctgtggcggcaagagatgggcgggaacatcacccgcgtggagtcagagaacaaggtagtaattttggactctttcgacccgcttcgagcggaggaggatgagagggaggtgtccgttgaggcggagatcctgcggaaatccaggaagttccctcgagcgctgcccgtatgggcacgcccagattacaaccctccactgctagagtcctggaaagacccggactacgtccctccggtggtacatgggtgcccattgccacctaccaaggcccccccaataccacctccacggagaaagaggacggttgtcttgacagaatctaccgtgtcttctgccttggcggagctcgccaccaagaccttcggcagctccgaatcgtcggccgtcgatagcggcacggcgactgcccctcccgaccaagcctccgacgacggcgacaaggaatccgacgttgagtcatactcctccatgcctccccttgagggagagccaggggaccccgatctcagcgacgggtcttggtctaccgtgagcgaggaagccagtgaggacgtcgtctgctgctccatgtcatacacatggacaggcgccctgatcacgccatgcgctgcggaggagagcaagttgcccatcaacgcgttgagcaactccttgctgcgtcaccataatatggtctactccacaacatcccgtagcgcgggcctgcggcagaagaaggtcacctttgacagactgcaagtcctggacgaccactaccgggacgtgctcaaggagatgaaggcgaaggcgtccacagttaaggctaaacttctatctatagaagaagcctgcaaactgacgcccccacattcggccagatccaaatttggctatggggcaaaggacgtccggagcctgtccagcagggccgtcaaccacatccgctccgtgtgggaggacttgctggaagacactgacacaccaattcccaccaccgtcatggcaaaaaatgaggttttctgcgtccaaccagagaaaggaggccgcaagccagctcgccttatcgtattcccagacctgggagttcgtgtgtgcgagaagatggctctctacgacgtggtctccacccttcctcaggccgtgatgggctcctcatacggattccagtactctcctaagcaacgggtcgagttcctggtgaacacctggaaatcgaagaagtgccctatgggcttctcgtatgacacccgctgctttgactcaacggtcactgagaatgacatccgtgttgaggagtcaatttaccaatgctgtgacttggcccccgaagccaaattggccataaagtcgctcacagagcggctctatatcgggggtcccatgaccaactcaaaagggcagaactgcggttatcgccggtgccgcgcgagcggcgtgctgacgactagctgcggtaataccctcacatgctacttgaaagcctctgcggcctgtcgagctgcaaagctccgggactgcacgatgctcgtgaatggagacgaccttgtcgttatctgtgaaagcgcggggacccaagaggacgcggcaagcctacgagtcttcacggaggctatgactaggtactctgccccccccggggacccgcctcaaccagaatacgacttggagttgataacatcatgctcctccaatgtgtcggtcgcacacgatgcatctggcaaaagggtgtactacctcacccgtgaccccgccaccccctttgcacgggctgcgtgggagacagctagacacactccagttaactcctggctaggcaacatcatcatgtatgcgcccactttatgggcaaggatggttttgatgactcatttcttctccatccttatagctcaggaacaacttgaaaaagccctggattgccagatctacggggcctgttactccattgagccacttgacctacctcagatcattgaacgactccatggtcttagcgcattttcactccatagttactctccaggtgagatcaatagggtggcttcatgcctcaggaagcttggggttccacccttgcgagtctggagacatcgggccagaagtgtccgcgctaagctactgtcccagggggggagggctgccacttgtggcaagtacctcttcaactgggcagtaaggaccaagcttaaactcactccaatcccggctgcgtcccggctggacttgtccggctggttcgtcgctggttacagcgggggagacatttatcacagcgtgtctcgtgcccgaccccgctggttcatgtggtgcctactcctactctccgtaggggtaggcatctacctgctccccaaccgttgaacggggagctaacca

SEQ ID NO: 688 - DNA, 9368 bp, Hepatitis C Virus
ttgggggcgacactccaccatagatcactcccctgtgaggaactactgtcttcacgcagaaagcgtctagccatggcgttagtatgagtgtcgtgcagcctccaggtccccccctcccgggagagccatagtggtctgcggaaccggtgagtacaccggaattgccaggacgaccgggtcctttcttggatcaacccgctcaatgcctggagatttgggcgtgcccccgcgagaccgctagccgagtagtgttgggtcgcgaaaggccttgtggtactgcctgatagggtgcttgcgagtgccccgggaggtctcgtagaccgtgcatcatgagcacaaatcctaaacctcaaagaaaaaccaaacgtaacaccaaccgccgcccacaggacgtcaagttcccgggcggtggtcagatcgtcggtggagtttacctgttgccgcgcaggggccccaggttgggtgtgcgcgcgactaggaagacttccgagcggtcgcaacctcgtggaaggcgacaacctatccccaaggctcgccagcccgagggtagggcctgggctcagcccgggtacccatggcccctctatggcaatgagggtctggggtgggcaggatggctcctgtcaccccgtggatcccggcctagttggggccccacggacccccggcgtaggtcgcgcaatttgggtaaggtcatcgataccctcacatgcggcttcgccgacctcatggggtacattccgctcgtcggcgcccccctaggaggcgctgccagggccttggcacacggtgttcgggttctggaggacggcgtgaactacgcaacagggaatctgcctggttgctctttctctatcttcctcttagctttgctgtcctgtctgaccatcccagcttccgcttacgaagtgcgcaacgcatccgggatgtaccatgtcacgaacgactgctccaactcaagtattgtgtatgaggcagcggacatgatcatgcacacccctgggtgcgtgccctgcgtccgggagagcaatttctcccgctgctgggtagcgctcactcccacgctcgcggctaggaacagcagcgtgcccactgcgacaatacgacgtcacgtcgatttgctcgttggggcggccgctctctgctccgccatgtacgtgggggatctctgcggatctgttttcctcgtctcccagctgttcaccttttcacctcgccggtatgagacggtacaagactgcaattgctcactctatcctggccacgtgacaggtcatcgcatggcttgggatatgatgatgaactggtcacctacaacagccttagtggtatcgcagttgctccggatcccacaagccgtcgtggacatggtggcgggggcccactggggagtcctggcgggccttgcctactattccatggtggggaactgggctaaggtcttgattgtgatgctactcttcgccggcgttgacggtcaaacccgcgtgacagggggggagcaagctcgcaccactctccgctttgcatccctcttctcgttagggccgtctcagaaaatccaacttgtgaattccaacggcagctggcacatcaacaggactgccctgaattgtaatgactccctcaacaccgggttcattgccgcgctgttctacacacacaagttcaactcgtccggatgcccagagcgcatggccagctgccgccccctcgacaagttcgctcaggggtggggccccatcaagtatgctgagtctcgaccatcggaccagaggccctattgctggcactacgcaccccaaccgtgtggtattgtacccgcgagacaagtgtgtggtccagtatattgcttcaccccaagccctgttgtagtggggacgaccgatcgtttcggcgcccccacgtataaatggggggagaatgagacggacgtgctgattctcaacaacacgcggccaccacaaggcaactggttcggctgtacgtggatgaatagcaccgggttcaccaagacgtgcgggggccccccgtgtaacatcgggggggtcggcaacaacaccttgacctgccccacggactgcttccggaagcaccccgaagccacttacacaaaatgtggctcggggccttggctgacacctaggtgcatggttgactacccatataggctttggcactacccctgcactgtcaactttaccgtcttcaaggtcaggatgtatgtggggggcgtggaacacaggctcaacgccgcgtgcaattggactcgaggagaacgttgtgacttggaggacagggacagatcagagcttagcccgctgctgctgtccacaacagagtggcagatactgccctgttccttcaccaccctaccggctctgtccactggtttgatccacctccatcagaacatcgtggacatacaatacctgtatggtgtagggtcagcggttgtttccattgcagtcaaatgggagtatgttgtgctgctcttccttctcctggcggacgcacgcgtctgtgcctgcttgtggatgatgctgctgatagcccaagctgaggccgccttagagaacctggtggtcctcaatgcggcgtctgtggccggagcgcatggcgttctctccttccttgtgttcttctgtgctgcctggtacatcaagggcaagctggtccctggggcggcatacgctttctatggcgtatggccgctactcctgctcctgcttgcgctaccaccacgagcgtacgccatggaccgagagatggccgcatcgtgcggaggcacggttctcataggtctgatacttctgaccttgtcaccacactataaagtgttcctcgccaggctcatatggtggttacaatatcttatcaccagggccgaggcgcatttgcacgtgtgggtccctcccctcaacgttcgggggggccgcgatgccatcatcctcatcacgtgtgcggtccactcagagctaatttttgatatcaccaaaatcttgctcgccatactgggtccgctcatggtgctccaggttggcctaaacagagtgccgtacttcgtgcgtgctcaagggctcatccgtgcgtgcatgttggtgcggaaagtcgctgggggccattatgtccaaatggccctcatgaagctggccgcactgacgggtacgtacgtttatgaccatctcactccgctgcgggactgggcccacgtgagcttgcgagaccttgcggtggcagtcgagcccgtcatcttctctgacatggagaccaagatcatcacctggggggcagataccgcagcgtgtggggacatcatctcgggtctacctgtctccgcccgaagggggagggagatacttctgggcccggccgatagttttggagagcaggggtggagactccttgcgcccatcacggcctactcccaacagacgcgaggcctgtttggctgcatcatcactagcctcacaggccgggacaagaaccaggttgagggagaggttcaggtggtttccaccgcaacgcaatcctttctggcgacctgcatcaacggcgtgtgttggactgtctaccacggcgccggctcgaagaccttagccggcccgaaaggcccagttatccaaatgtacaccaatgtagaccaggacctcgtcggctggccagcgccccctggggcgcgttccttgacgccgtgcacctgcggcagctcggacctttatctggtcacgaggcatgctgatgtcattccggtgcgccggcggggcgacagcagggggagcctgctatcccccaggcccatctcctacttgaaaggctcctcaggtggtccactgctctgcccctcggggcacgctgtgggcatctttcgggccgctgtatgcacccggggggttgcaaaggcggtggactttatacctgttgagtctatggaaactactatgcggtctccggtcttcacagacaactcatctcctccggccgtaccgcagacattccaagtggcccatctacacgctcccactggcagcggcaaaagcactaaagtgccagccgcatacgcagcccaagggtacaaggtactcgtcctgaacccgtccgttgccgccaccctaggttttggagcgtacatgtccaaggcatatggtgtcgaccccaacatcaggactggggtaaggaccatcaccacgggcgcttccatcacgtactccacctatggcaagttccttgccgacggtggttgctccgggggcgcctatgacatcataatgtgtgatgagtgccactcaactgactcgacttccatcttgggcatcggcacagtcctggaccaagcggagacggctggagcgcggctcgtcgtgctcgccaccgctacgcctccgggatcggtcactgtaccacatcccaatatcgaggaggtggccttgtccaacactggagagattcccttctacggcaaggccatccccatcgagaccatcaagggggggaggcatctcatcttctgccattccaagaagaaatgtgacgagctcgccgcaaagctatcggccctcggagtcaacgctgtggcgtactatcggggtcttgatgtgtccgtcataccgacaagtggagatgtcgttgtcgtggcaacagacgctctaatgacgggctataccggtgactttgactcggtgatcgactgtaatacgtgtgtcacccagacagtcgacttcagcttggaccctaccttcaccattgagacgacgaccgtgccccaagacgcggtgtcgcgctcgcaacggcgaggcaggaccggtaggggtagaaggggcatatacaggtttgtgactccaggggaacgaccctcgggcatgttcgattcttcggtcctgtgtgagtgctatgacgcgggctgtgcttggtacgagctcacgcccgctgagacctcggttaggttgcgggcttacctaaacacaccagggttgcccgtctgccaggaccacctggagttctgggagagcgtcttcacaggcctcacccacatagatgcccacttcttgtcccagactaaacaggcaggagacaacttcccctacctggtagcataccaggctacggtgtgcgccagggcccaggctccacctccatcgtgggatctaatgtggaagtgtctcacacggctaaagcctacactacacgggccaacacccctgttgtacaggctaggagccgttcaaaatgaagtcaccctcacacaccccataaccaaatacatcatggcatgcatgtcggctgacctagaggtcgtcacgagcacctgggtgctggtgggcggggtcctcgcggccctggccgcgtactgcctgacaacgggcagcgtggtcattgtgggcaggatcatcttgtccggaaagccggctattattcccgacagggaagttctctaccgggagttcgatgaaatggaagagtgcgcctcacacctcccttacatcgaacagggaatgcagctcgccgagcaattcaagcagaaggcgctcgggctgctgcaaacagccaccaagcaagcggaggccgctgctcccgtggtggagtccaagtggaaagcccttgagaccttctgggcgaagcacatgtggaacttcatcagcgggatacagtatttagctggcctgtccactctgcctggaaaccctgctatagcatcactgatggcattcacagcctctatcaccagcccgctcaccacccaacataccctcctgtttaacatcttggggggatgggtggctgcccaactcgccccccccagcgctgcttccgctttcgtgggcgccggcatcgctggcgcggccgttggcagcataggccttgggaaggtgttggtggacatcttggcgggttatggagcgggggtggcaggcgcactcgttgcctttaaggtcatgagcggcgagatgccctccaccgaggatttggtcaatttgctccctgccatcctctctcctggtgccctggttgtcggggtcgtgtgcgcagcaatactgcgtcggcatgtgggcccaggggagggggctgtgcagtggatgaaccggctgatagcgttcgcttcgcggggtaaccacgtctcccccacgcattatgtgcctgagagcgacgctgctgcgcgtgtcacccagatcctctccagcctcaccatcactcagctactgaagaggctccatcagtggattaatgaagactgctccacgccgtgctccggttcgtggctaagggatgtttgggactggatatgcacggtgttgactgacttcaagacctggctccagtccaagctcctgccgcggttacctggagtccctttcttctcatgccagcgcgggtacaggggagtctggcgtggggacggcatcatgcacaccacctgcccatgtggagcacagatcaccggacatgtcaagaacggttccatgaggatcgttgggcccaagacctgcagcaacacgtggcatggaacattccccatcaacgcatacaccacgggcccctgcacaccctccccagcgccgaactattccaaggcgttgtggcgggtggctgccgaggagtacgtggaggttacgcgggtgggggatttccactacgtgacgggcatgaccactgacaacgtaaaatgcccttgccaggtcccggcccccgaattcttcacggagttggatggggtgcggctgcacaggtatgctccggtgtgcaaacctctcctacgggaggaggtcacataccaggtcgggctcaaccaatacttggttgggtcacagctcccatgcgagcccgaaccggatgtagcagtgctcacttccatgctcaccgatccctcccacatcacagcagagacggctaggcgtaggctggccagagggtctcccccctccttggccagctcttcagctagtcagttgtctgcgccttccttgaaggcaacatgcactacccatcatgactccccagacgctgacctcatcgaggcgaacctcctgtggcgacaggagatgggcgggaacatcacccgtgtggagtcagagaataaggtagtaattctggactcttttgacccactccgagcagaggaggatgagagggaggtatccgttgaggcggagatcctacggaaaaataggaaattccccccagccatacccatatgggcacgcccggactacaacccaccactgctggagagttggaaggacccaaactacgtccctccagtggtacacgggtgcccattgccacctaccaaggcccctccaataccacctccacggaggaaaaggacaattgttctgacagaatccaccgtgtcttctgccttggcggagcttgcgacgaagaccttcggcagttccggatcgtcggccgtcgacagcggcacggcgaccgcccctcccaatcagctctccgacgaaggagacacaggatccgacgttgggtcgtactcctccatgccccctcttgagggagagccgggggaccccgatctcagcgatgggtcttggtctactgtgagcgaggaggccggtgaggatgttgtctgctgctcgatgtcctacacatggacaggcgccttaatcaccccatgcgccgcggaggagagcaagctgcccatcaatgcgctgagcaactctttgctgcgtcaccataacatggtctacgccacaacatcccgcagcgcaagtcagcggcagaagaaggtcacctttgacagactgcaagtcctggacgaccactaccgggacgtgctcaaggagatgaaggcgaaggcgtccacagttaaggctaaactcctatccatagaagaggcctgcaaactgacgcccccacattcagccaaatccaaatttggctatggggcaaaggatgtccggaacctatccagtaaggccgttaaccacatccactccgtgtggaaggacttgctggaagacactgaaacaccaattgacaccaccatcatggcaaaaaacgaggtcttctgtgttcaaccagagaaaggaggtcgcaagccagctcgccttatcgtattcccagacttgggggtccgtgtgtgcgagaaaatggccctttacgacgtagtctccactcttcctcaggccgtgatgggctcctcatacggattccagtattctcctgggcagcgggtcgagttcctggtgaacgcctggaaatcaaagaaaaaccctatgggctttgcatatgacacccgctgttttgactcaacggtcactgaaaatgacatccgtgtcgaggagtcaatctaccaatgttgtgaattggcccccgaggccagacaggtgataaggtcgctcacagagcggctttatatcgggggccccctgactaattcaaaagggcagaactgcggttatcgccggtgccgcgctagcggcgtgctgacgaccagctgcggcaacacccttacatgttacttgaaggcctctgcagcctgtcgagctgcgaagctccgggactgcacgatgctcgtgtgtggagacgaccttgtcgttatctgtgaaagcgcgggaaccgaggaggacgcggcgagcctacgagtcttcacggaggctatgactaggtactctgccccccccggggacccgccccgaccggaatacgacttggagttgataacatcatgctcctccaacgtgtcggtcgcacacgacgcctctggcaaacgggtgtattacctcacccgtgaccccaccaccccccttgcgcgggctgcgtgggagacagctagacacactccaatcaactcctggctaggcaacatcatcatgtatgctcccaccttatgggcaaggatgattctgatgactcacttctcctccatcctcctacctcaggagcagcttgaaaaagccctggattgtcagatctacggggcctgttactccattgaaccacttgacctacctcagatcattcagcgactccatggtcttagcgcattctcactccatagttactctccaggtgagatcaatagggtggcttcatgcctcaggaaacttggggtaccgcccttgcgagtctggagacatcgggccagaagtgtccgcgctaagctactgtcccagggggggagggctgccacttgtggcaagtatctcttcaactgggcagtaaggaccaagcttaaactcactccaatcccggccgcatcccagttggacttgtccggctggttcattgctggctacagcgggggagacatatatcacagcctgtctcgtgcccgaccccgctggtttatgtggtgcctactcctactttctgtaggggtaggcatctacctgctccccaatcggtgaacgggg

SEQ ID NO: 689 - DNA, 9379 bp, Hepatitis C Virus
ttgggggcgacactccaccatagatcactcccctgtgaggaactactgtcttcacgcagaaagcgtctagccatggcgttagtatgagtgtcgtgcagcctccaggatcccccctcccgggagagccatagtggtctgcggaaccggtgagtacaccggaattgccaggatgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcatcatgagcacaaatcctaaacctcaaagaaaaaccaaacgtaacaccaaccgtcgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccagcccgagggcaggacctgggctcagcccgggtacccatggcccctctatggcaacgagggcatggggtgggcaggatggctcctgtccccccgtggctctcggcctaattggggccccacggacccccggcgtaggtcgcgtaatttgggtaaggtcatcgataccctcacatgcggcttcgccgacctcatggggtacattccgctcgtcggcgcccccctggggggcgttgccagagccctggcacatggtgttcgggttctggaggacggcgtgaactacgcaacagggaatttgcccggttgctctttctctatcttcctcttggctttgctgtcctgtttgaccaccccagcttccgcttatgaagtgcgcaacgcgtccgggatataccatgtcacgaacgactgctccaactcaagcatcgtgtatgaggcagcggacatgatcatgcatatccccgggtgcgtgccctgcgttcgggagggcaactcctcccgttgctgggtggcgcttgctcccacgctagcggccaggaatgccagcgttcccactacaacaatacgacgccatgtcgatttgcttgttggggcggctgctttctgctccgctatgtacgtgggggatctctgcggatctgttttccttgtctcccagctgttcaccttctcgcctcgccggcatgagacagtacaggactgcaattgctcaatctatcccggccatttgtcaggccatcgtatggcttgggatatgatgatgaactggtcacctacaacaggcctagtggtgtcgcagttactccggatcccacaagctgccgtggacgtggtggcgggagctcactggggagtcctagcgggccttgcctactattccatggtgggaaactgggctaaggtattgattgtgatgctactttttgccggcgttgacggggagacccacgtgacaggaggggcggcaggccgcaccaccagctcgttcgcgggcttcttcacgcttgggccagctcagaagatccagcttgtgaactccaacggcagctggcatatcaacaggactgccctgaactgcaatgataccctccagactggatttcttgccgcgctgttctacacacacaggttcaacgcgtccggatgtccagagcgcatggccagctgccgccccattgacaagttcgctcaggggtggggtcccatcacttatgctgaacagggcggccaggaccagaggccttattgctggcactatgcacccaaaccgtgtggtatcgtacccgcgtcgcaggtgtgtggtccagtgtattgtttcaccccaagcccagttgtggtggggaccaccgatcgcttcggtgtccctacttatagctggggggagaatgagacagacgtgctgctccttaacaacacgcggccgccgcaaggcaactggttcggctgtacatggatgaacagcactgggttcaccaagacatgcgggggccccccgtgtaacatcgggggggccggcaatgacaccttgatctgccctacggactgcttccggaagcaccccgaagctacttacacaaaatgtggctccgggccttggttgacacccaggtgcttagttgactatccatacagactctggcactacccctgcactgtcaactttaccatcttcaaggttaggatgtatgtagggggcgtggagcacaggcttaatgctgcatgcaattggacccgaggagagcgttgtgacttagaggacagggatagatcagagctcagcccgctgctgctgtctacaacagagtggcagatactgccctgttcctacaccaccctgccggctctgtccactggcttaatccatctccatcagaacatcgtggacgtccaatacctgtacggtatagggtcggcggttgtctcctttgtgatcaaatgggagtatgtcgtgttgctcttccttctcttggcggacgcacgcgtctgtgcctgcctgtggatgatgttgctggtagcccaggccgaggccgccttagagaacctggtggtcctcaatgcggcgtccgtggccggaacgcatggcattctctccttccttgtgttcttctgtgctgcctggtacatcaagggcaggctggtccccggggcggcatatgctatctatggcgtatggccgctgctcctgctcctgctggcgttgccaccacgagcttacgccatggagcgggggatggctgcgtcatgcggcggaggggttttcataggtctggtgctcttgaccttgtcaccatactataaagtgttcctcgctaggctcatatggtggttacaatatcttatcaccagggccgaggcacacttgcatgtgtgggtcccccccctcaacatccgggggggccgtgatgccatcatcctcctcgcgtgtgtggtccacccagagctaatctttgacatcaccaaactcctgctcgccatactcggtccactcatggtgctccaggccagcataattaaggtgccgtacttcgtacgtgcacaagggctcattcgtgcatgcatgttggtgcggaaagcagctgggggtcattacatccaaatggccctcatgaggctcgccgcgctgacaggtacgtacgtttatgaccatctcactccactgcgggactgggcccacgcgggcttgcgagacctcgcggtggcagtagagccagttgtcttctctgacatggagaccaagatcatcacctggggggcagacaccgcggcgtgtggggacatcatcttgggtttacctgtctccgcccgaaggggaaatgagatcttcctggggccggccgacagtcttgaaggacaagggtggcggctccttgctcccatcacggcttacgcccaacagacgcggggcctacttggttgcatcatcactagccttacaggccgggacaagaaccaagttgagggagaggttcaagtggtttctaccgcgacacaatctttcctggcgacctgcatcaatggcgcgtgttggactgtctaccatggcgccggctcaaagaccctagccggcccgaaaggccctatcattcaaatgtacaccaatgtagacctagacctcgtcggctggcaggtgcccccgggggcgcgttccttgacaccatgcacctgcggcagctcggacctttatttggtcacgagacatgccgatgtcattccggtgcgccggcggggcgatagtagggggagcctactctctcccaggcctgtctcctacttgaagggctcttcgggtggtccactgctctgccctttggggcacgctgtgggcatcttccgggctgctgtatgcacccggggggttgcgaaagcggtggacttcatacccgttgagtctatggaaactaccatgcggtctccggtctacacggacaattcatctcccccggccgtaccgcagaccttccaagtggcccatctacacgcccccaccggcagcggcaaaagcactaaggtgccggctgcatatgcagcccaggggtacaaggtactcgtcctgaacccgtccgttgccgccaccttgggttttggggcgtatatgtctaaggcacatggtatcgaccccaacatcagaactggggtacgggccatcaccacaggcgctcccatcacatactccacctatggcaagttccttgccgacggtggttgctccgggggcgcctatgatatcataatatgtgatgagtgccactcaactgactcaactaccatcttgggcattggcacagtcctggaccaagcggagacggctggagcgcggctcgtcgtgctcgccaccgctacgcctccgggatcggtcaccgtgccacaccccaacatcgaggaggtggccctgtccaacactggagagatccccttctacggcaaagccatccccattgaggtcatcaagggaggaagacatctcattttctgccattccaagaagaagtgtgacgaactcgccgcaaagttgtcaggcctcggactcaatgccgtagcatattatcggggtcttgatgtgtccgtcataccgaccagcggagacgtcgttgtcgtagcgacagacgctctaatgacgggctttaccggcgactttgactcagtgatcgactgtaacacatgtgtcacccagacagtcgactttagcttggatcccaccttcaccattgagacgacgactgtgcctcaagacgcggtgtcgcgctcgcagcggcgaggtaggactggcaggggtaggcggggcatctacaggtttgtgactccaggagaacggccctcgggtatgttcgattcctcggtcctgtgtgagtgctatgacgcgggctgtgcttggtatgagctcacgcctgctgagactacagttaggttgcgggcttacctgaatacaccagggttgcccgtctgccaggaccatctggagttttgggagggtgtcttcacaggcctcacccacatagatgcccacttcctgtcccagactaagcaagcaggagacaacttcccctacctagtggcataccaagccacagtgtgtgccagatctcaagctccacctccatcatgggatcaaatgtggaagtgtctcttacggctcaaacctacactgcacgggccaacacccctgctgtataggctaggagccgttcaaaatgaggttaccctcacacatcccataaccaaatacatcatgacatgcatgtcggctgacctggaggtcgtcactagtacctgggtgctagtaggcggagtccttgcagccctggccgcatactgcttgacaacaggcagcgtggtcattgtgggcaggatcatcttgtccgggagaccggctgttattcccgacagggaagtcctctaccgggagttcgatgaaatggaagagtgcgcctcacacctcccttacatcgaacagggaatgcaactcgccgagcaattcaaacaaaaagcgctcgggttgctgcaaacagccaccaagcaagcggaggctgctgctcccgtggtggagtccaagtggcgagcccttgagactttctgggcaaagcacatgtggaatttcatcagcgggatacagtacttagcaggcttatccactctgcctgggaaccccgcgatagcatcattgatggcattcacagcctctatcaccagcccgctcaccacccaaagtaccctcctatttaacatcttgggaggatgggtggctgcccaactcgccccccccagtgctgcttcggctttcgttggcgccggcatcgccggtgcggctgttggcagcataggccttgggaaggtgcttgtggacatcctggcaggatatggggcgggggtggctggcgcactcgtagcatttaagatcatgagcggcgaggcgccctccaccgaggacctggtcaatttactccctgccatcctctctcctggcgccctggtcgtcggggtcgtgtgcgcggcaatactacgtcggcacgtgggcccgggagaaggggctgtgcagtggatgaaccggctgatagcgttcgcttcgcggggtaaccacgtctcccccacgcactatgtgcctgagagcgacgctgcagtgcgtgttactcagatcctttccagccttaccatcacccagctgctgaagaggcttcaccagtggatcaatgaggactgctccacgccatgctccggttcgtggctacgggatgtctgggactggatatgcacggtgctgactgacttcaagacctggatccagtccaaactcctgccgcggttaccgggggtccctttcttctcatgccaacgtgggtacaagggagtctggcggggggacggcatcatgcaaaccacctgcccgtgcggaggacagatcaccggacatgtcaaaaacggttccatgaggatcgttgggcctaaaacctgcagcaacacgtggcatggaacattccccatcaatgcgtacaccacgggcccctgcgtgccctccccagcgccaaactactctaaggcgctgtggcgggtagccgctgaggagtacgtggaggttacgcgggtgggggatttccactacgtgacgggcatgaccactgacaacataaagtgcccgtgccaggttccggcccccgaattcttcacggaggtggatggagtacggctgcacaggtacgctccggcgtgcaaacctctcctacgggaggacgtcacattccaggtcgggctcaaccaatacttggttgggtcacagctcccatgcgagcccgaaccggatgtagcagtgctcacttccatgctcaccgacccctcccacatcacagcagagacggctaagcgtaggctggccagggggtctcccccctccttggccagctcttcagctagccagttgtctgcgccttctttgaaggcgacatgcactacccatcatgactccccggacgctgacctcatcgaggcgaacctcctgtggcgacaggagatgggcgggaacatcacccgcgtggagtcagagaataaggtagtaattctggactcttttgacccgcttcgagcggaggaggatgagagggaaccatccgttgcggcggagatcctgcggaaatccaagaggttcccctcagcgctgcccgtgtgggcacgcccggattacaaccctccattgctagagtcctggaaggacccggactacgtccctcccctggtacacgggtgcccattgccacctgtcaaggcccctccaataccaccaccacggaggaagaggacggtggtcctaacagagtccaccgtgtcttctgccttggcggagctcgccactaagaccttcggcagctccggatcgtccgccgtcgacagcggcacggcgacggctcctcccgatcaggcctccgacgacggcgacagagaatcagacgttgagtcgtactcctccatgccccctcttgagggagagccaggggaccccgatctcagcgacgggtcttggtctaccgtgaacgaggaggctggtgaggacgtcgtctgctgctcaatgtcctacacatggacaggggccctgatcacgccatgcgctgcggaggaaagcgagctgcccatcaacccgttgagcaactctttgctgcgtcaccacaacatggtctacgctacaacatcccgcagcgcaggcctacggcagaagaaggtcacctttgacagactgcaagtcctggacgaccactaccgggacgtgctcaaggagatgaaggcgaaggcgtccacagtcaaggctaaacttctatctgtagaagaagcctgcaaactgacgcccccacattcggccaaatccaaatttggctatggggcgaaggacgtccggaacctatccagcaaggccgttaaccacatccactccgtgtggaaggacttgctggaagacactgagacaccaatcaataccaccatcatggcaaaaagtgaggttttctgcgtccaaccagagaaaggaggccgcaagccagctcgccttatcgtattcccagacctgggggttcgtgtatgcgagaaaatggctctttatgatgtggtctccacccttcctcgagccgtgatgggctcctcatacgggtgtcagtactcccctggacagcgggtcgagttcctggtgaaagcatggaaatcaaagaaaagccctatgggcttctcatatgacacccgctgttttgactcaacggtcactgaaagtgatatccgtgttgaggagtcaatttaccaatgttgtgacttggcccccgatgccagacaggccataaagtcgctcacagagcggctctatatcgggggtcccctgaccaattcaaaagggcagaactgcggttatcgccggtgccgcgcgagcggcgtgctgacgaccagctgcggtaataccctcacatgttacttgaaggcctctgcagcctgtcgagctgcaaagctccaggactgcacgatgctcgtgaacggagacgaccttgtcgttatctgtgaaagcgcggggacccaagaggatgaggcgaacctacgagtcttcacggaggctatgactaggtattctgccccccccggggacccgccccggccagaatacgacttggagctgataacatcatgttcctccaatgtgtcggtcgcgcacgatgcatctggcaaaagggtgtactatctcacccgtgaccccaccacccccctcgcacgggctgcgtgggagacagcaagacacactccagtcaactcctggctaggcaatatcatcatgtatgcgcccaccttatgggcaaggatggttctgatgactcacttcttctccatcctcctagctcaggagcaacttgaaaaagccctggattgtcatatctacagggcctgttactccattgagccacttgacctacctcagatcattgaacgactccatggtcttagcgcattttcactccatagttactctccaggtgagatcaatagggtggcttcatgcctcaggaaacttggggtaccacccttgcgagtctggagacatcgggccagaagtgtccgcgctaagctactgtcccagggggggagggctgccacttgtggcaagtacctcttcaactgggcagtaaagaccaagctcaaactcactccaattccggccgcgtcccagttggacttgtccaactggttcgttgctggttacaacgggggagacatatatcacagcctgtctcgtgcccgaccccgttggttcatgttgtgcctactcctactttctgtaggggtaggcatctacctgctccccaatcgatgaacggggagctaaccact

SEQ ID NO: 690 - DNA, 9379 bp, Hepatitis C Virus
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggcaggacctgggctcagcccgggtatccttggcccctctatggcaatgagggcatggggtgggcaggatggctcctgtcgccccgtggctcccggcctagttggggccccacggacccccggcgtaggtcgcgtaatttgggtaaggtcatcgataccctcacatgcggcttcgccgacctcatggggtacattccgctcgtcggcgcccccttaggaggcgctgccagggccctggcgcatggcgtccgggtcctggaggacggcgtgaactatgcaacagggaacttgcccggttgctctttctctatcttcctcttggctctgctgtcctgtttgaccatcccagcttccgcttatgaggtgcgcaacgcgtccggggtgtaccatgtcacgaacgactgctccaactcaagcattgtgtatgaggcagcggacatgatcatgcacacccccgggtgcgtgccctgcgttcgggagaacaactcctcccgttgctgggtggcgctcactcccacgctcgcggccaggaacgccagcgtccccactaagacaatacgacgtcacgtcgatttgcttgttggggcggctgctttctgttccgctatgtacgtgggggacctctgcggatctgttttcctcgtctcccagctgttcaccttctcgcctcgccggcatgagacggtacaggactgcaattgctcaatctatcccggccacttatcaggtcaccgcatggcttgggatatgatgatgaactggtcacctacagcagccctggtggtatcgcagttactccggatcccacaagccgtcatggacatggtggcgggggcccactggggagtcctggcgggccttgcctactattccatggtggggaactgggctaaggtcttgattgtgatgctactcttcgccggcgttgacgggagcacccgcgtgtcgggggggacggcaggccgcaccaccgtcggcctggcacgcttctttacatctgggccgtctcagaacatccagcttgtaaacacgaatggcagctggcacattaacaggactgccctgaactgcaacgactccctccagactgggttcatcgccgcgctgttctacacacacaagttcaacgactccggatgcccagagcgcatggccagctgccgctctattgacaagtttgagcaggggtggggtcccatcacctacgccggggaccacagcttggaccagaggccttattgctggcactacgcacctcaaccatgtggtattgtacccgcggcgcaggtgtgtggtccagtgtattgcttcaccccaagccctgttgtggtggggacgagtgatcgctccggcgtccctacgtataactggggggtgaatgagtcggacgtgctgctcctcaacaacacgcggccgccgcagggcaactggttcggctgtacatggatgaatagcaccgggttcaccaagacgtgcgggggccccccgtgcaatatcgggggggtcggcaacaacaccctgatctgccccacggactgcttccggaagcaccccgaggccacctacacaaaatgtggctcggggccttggttgacacccaggtgcttggttgactatccatacaggctttggcactacccctgcactgtcaattttaccatcctcaaggtcaggatgtatgtggggggcgtggagcataggctcaacgctgcatgcaattggactcgaggagagcgttgcaacttggaggacagggacaggtcagagctcagcccgctgctgctgtctacaacggagtggcagatactgccgtgttccttcaccaccctaccggctctgtccactggcttgatccatctccatcagaacgtcgtggacgtgcaatacctgtacggtatagggtcagcggttgtctccttcgtgatcaaatgggagtacgtcctgttgctcttccttctcctggcggacgcgcgcgtctgtgcctgcctgtggatgatgctgctgatagcccaggctgaggccgccttagagaaactggtggtcctcaatgcagcgtccgtggccggagcgcacggcatcctctccttccttgtgttcttctgcgcggcctggtacatcaaaggcaagctggtccctggggcggcatatgccctctacggcgtgtggccgttgctcctgctcctgctggcgctaccgccactagcgtacgccatggaccgggagatggctgcatcgtgcggaggcgcggtttttgtgggtctggtactcttgaccttgtcaccacactacaaagtgtttctcgctaggctcatatggtggttgcaatatctcatcaccagagccgaggcgctgttgcaagtgtgggttccccccctcaacattcgggggggccgcgacgccatcatcctcctcacgtgtgcggcccacccagagctaatctttgacatcagcaaaatcttgctcgccatactcggtccgctcacagtgctccaggctggcataactagagtgccgtactttgtgcgcgctcaagggctcattcgtgtgtgcatgttggtgcggaaagtcgctgggggccattatgtccaaatggctctcatgaaactggccgcgctgacaggtacgtacgtatatgaccatctcactccactgcgggactgggcccacgcgggcctacgagacctcgcggtggcagttgagcccgtcatcttctctgacatggagaccaaggtcatcacctggggggcagacaccgcggcgtgtgtgaacatcatctctggcctacccgtctccgcccgaagggggaaggagatactcctaggaccggccgacagtcatgaaggccgagggtggcgactccttgcgcctatcacggcctactgtcaacagacgcggggcctgcttggttgcatcatcaccagccttacgggccgagacaagaaccaggtcgagggagaggtgcaagtggtttccaccgcaacgcagtctttcctagcgacctgtgttaacggtgtgtgctggactgtctaccacggcgccggctcaaagactctagccggcccgaagggtccaattacccaaatgtacaccaatgtagaccaggacctcgtcggctggctggcgccccccggggcgcgttccttgacaccatgcacctgcggcagctcggacctttacttggtcacgagacatgctgacgtcatcccggtgcgccggcggggtgacagcagggggagcttactctcccccaggcccgtctcctacctgaagggctcttcgggcggtccactgctctgtccctcggggcacgtcgtgggcatcttccgagccgctgtgtgcacccgaggggttgcgaaggcggtggacttcgtacccgttgagtctatggaaactactacgcggtctccggtcttcacggacaactcgtcccctccggccgtaccgcagacattccaagtggcccatctacacgctcccactggcagcggtaagagcactaaggtgccggctgcgtatgcagcccaagggtacaaagtactcgtcctgaatccgtccgttgccgccaccctaggtttcggggcgtatatgtccaaggcacatggtgtcgaccctaacattagaactggggtaaggaccatcaccacgggcgctcccatcacgtattccacctatggcaagttccttgccgacggtgggtgctcagggggcgcctatgacatcataatgtgtgatgagtgccactcaactgactcgacctccatcctgggcatcggcacagtcctggaccaagcggagacggctggagcgcggctcgtcgtgctcgccaccgctacgcctccgggatcggttaccgtgccacatcccaatattgaggagatagccctgtccaacaccggagagatccctttctatggcaaagccatccccattgaggccatcaagggggggagacacctcatcttctgccattccaagaagaaatgtgacgagctcgccgcaaagctgtcaggcctcggactcaacgctgtagcgtattaccggggtctcgatgtgtccgtcataccggttagcggggacgtcgttgtcgtggcaacggacgctctaatgacgggctttaccggcgacttagactcggtgatcgactgtaatacctgtgtcacccagacagtcgacttcagcttggaccctaccttcaccattgagacgacgaccgtgccccaagacgcggtgtcgcgctcgcaacggcgaggtaggactggtaggggcaggagaggcatctataggtttgtaactccaggagaacggccctcaggcatgttcgattcctcagtcctgtgcgagtgctatgacgcgggctgtgcttggtacgagctcacgcccgccgagacctcggtcagattgcgggcttacctaaatacaccagggttgcccgtttgccaggaccacctggagttttgggagagcgtcttcacaggcctcacccacatagatgcccacttcttgtcccagaccaagcaggcaggagacaaccttccttacctggtagcataccaagccacagtgtgcgccagggcccaggctccacctccatcgtgggatcaaatgtggaagtgtctcatacggctgaagcctacgctacacgggccaacacccctgttgtataggctaggggccgtccaaaacgaggtcatcctcacacaccccataaccaaatacatcatggcatgcatgtcggctgacctggaagtcgtcacgagcacctgggtgctagtgggcggagtccttgcagctctggccgcgtactgcctgacaacaggcagcgtggtcattgtgggcaggatcatcttgtccgggaggccggctgttgttcccgacagggaagttctctaccgggagttcgatgagatggaagagtgcgcctcgcacctcccctacatcgaacagggaatgcagctcgccgagcaattcaagcagaaggcgctcgggttgctgcaaacagcttccaagcaagcggaggctgctgcccccgtggtggagtcaaagtggcgagcccttgaggccttctgggcgaagcacatgtggaatttcatcagcgggatacagtacttagcaggcttgtccactctgcctgggaaccccgcaatagcatcactgatggcattcacagcctccattaccagcccgctcaccacccaaagcaccctcctgtttaacatcttgggagggtgggtggctgcccaactcgctccccccagcgctgcttcggcttttgtaggcgccggcatcgctggcgcggctgttggcagcataggccttgggaaggtgcttgtggacattctggcgggctatggagcaggggtggcgggcgcactcgtggcctttaaggtcatgagcggcgaaatgccctccaccgaggacctggttaacctgctccctgccatcctctctcctggcgccctggtcgtcggggtcgtgtgcgcagcaatactgcgtcggcacgtgggcccgggagagggggccgtgcagtggatgaaccggctgatagcgttcgcttcgcggggtaaccacgtctcccccacacactatgtgcctgagagcgacgccgcggtgcgcgtcactcaaatcctctccagccttaccatcactcagctgttgaagaggcttcaccagtggattaatgaggactgctccacgccatgctccggctcgtggttgagggatgtttgggactggatatgcacggtgttgactgacttcaagacctggctccagtccaagctcctgccgcggttgccgggagtccctttcctctcatgtcaacgtgggtacaagggagtctggcggggagacggcatcatgcataccacctgcccatgcggagcacagatcaccggacatgtcaagaacggttccatgaggatcgttgggcctaggacctgcagcaacacgtggcatggaacattccccgtcaacgcatacaccacgggcccctgcacgccctccccggcgccaaattattctaaagcgctatggcgggtggccgctgaggagtacgtggaggttacgcgggtgggggatttccactacgtgacgggcatgaccactgacaacgtaaaatgcccatgccaggttccggcccccgaattcttcacggaggtggatggggtacggctgcacaggtacgctccggcgtgcaaacctctcctacgggaggaggtcacattccaggtcgggctcaaccagtacctagttgggtcacagctcccatgcgaacccgaaccggatgtagcggtgctcacttccatgctcaccgacccctcccacatcacagcagaaacggctaagcgtaggctggccagggggtctcccccctccttggccagttcctcggctagccagttgtctgcgccttctttgaaggcgacatgcactacccgtcatgactccccggacgctgacctcattgaggccaacctcctgtggcggcaggagatgggcgggaacatcacccgcgtggagtcagagaataaggtagtgattctggactctttcgaaccgcttcgagcggaggaggatgagagggaggtctccgttgcggcggaggtcctgcggaaatccaggaaattccccccagcgttgcccatatgggcacgcccggattacaaccctccactattagagtcctggaaggacccggactacatccctccggtggtacacgggtgcccattgccacctaccaaggcccctccaataccacctccacggaggaagaggacggttgtcctgacagagtccactgtgtcttctgccttggcagagcttgctacaaagaccttcggcagctctgaatcgtcggccgtcgacagcggcgtggcgaccgcccctcccgaccagcccttcgacgccggtgatgcaggatctgacgttgagtcgtactcctccatgcccccccttgagggggagccgggggatcccgatctcagcgacgggtcctggtctaccgtgagcgaggaggctagtgaggacgtcgtctgttgctcgatgtcctacacatggacgggcgctctgatcacgccatgcgccgcggaggaaagcaagctgcccatcaacgcgttgagcaactctttgttgcgtcaccacaacatggtttacgccacaacatcccgcagcgcaagccagcggcagaaaaaggtcacctttgacagactgcaagtcctggacgaccactaccggggcgtgcttaaggagataaaggcgaaggcgtccacagttaaggctaaacttctatccgtagaggaagcctgtaagctgacgcccccacattcggccaggtccaaatttggctatggggcaaaggacgtccggaacctatccggcaaggccgtcaaccacatccgctccgtgtggaaggacttgctggaagacactgagacaccaattgacaccaccatcatggcaaaaaatgaggttttctgcgtccaaccagagaaaggaggccgcaagccagctcgccttatcgtgttcccagacttgggggttcgtgtgtgcgagaaaatggccctttacgatgtggtctccacccttcctcaggccgtgatgggctcctcatacggattccagtactctcctgggcagcgggtcgagttcctggtgaatgcctggaaatcaaagagatgccccatgggcttctcatatgacacccgctgctttgactcaacggtcaccgagaatgacatccgtactgaggagtcaatttaccaatgttgtgacttggcccccgaagccaggcaggccataaggtcgctcacagagcggctttatgtcgggggtcccctgactaattcaaaggggcagaactgcggctatcgccggtgccgcgcaagcggcgtgctgacgaccagctgcggcaataccctcacatgttacttgaaagcctctgcggcctgtcgagctgcaaagctccaggactgcacgatgctcgtgtgcggagacgaccttgtcgttatctgtgaaagcgcgggaacccaggaggatgcggcgagcctacgagtcttcacggaggctatgactaggtactctgccccccccggggacccgccccaaccagaatacgacttggagctgataacatcgtgctcctccaatgtgtcagtcgcacacgacgcatctggcaaaagggtgtattacctcacccgtgaccccaccaccccccttgcgcgggctgcgtgggaaacagctagaagcactccagtcaactcctggctaggcaacatcatcatgtatgcgcccactttatgggcaaggatgattctgatgactcacttcttctccatcctcctagcccaggagcagcttgaaaaagccctagattgtcagatctacggggcctgttactccattgagccacttgacctacctcagatcattcaacgactccatggtcttagcgcattttcactccacagttactctccaggtgagatcaatagggtggcttcatgcctcaggaaacttggggtaccacctttgagagtctggagacttcgggccagaagtgtccgcgccaagctactgtcccagggggggagggccgccacttgtggcaagtacctcttcaactgggcagtaaagaccaaactcaaactcactccaatcccggctgcgtcccagttggacttgtccaactggttcgttgctggttacagcgggggagacatatatcacagcttgtctcgtgcccgaccccgctggttcatgttgtgcctactcctactttctgtgggggtaggcatctacctgctccccaatcggtgaacggggagctaaccact

SEQ ID NO: 691 - DNA, 9379 bp, Hepatitis C Virus
  misc_feature 7196: n = A,T,C or G
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggcattgtggtactgcctgatagggtgcttgcgagggccccgggaggtctcgtagatcgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccagcccgagggcaggacctgggctcagcccgggtacccttggcccctctatggcaacgagggcatggggtgggcaggatggctcctgtcaccccgtggctcccggcctagttggggccccacggacccccggcgtaggtcgcgtaatttgggtaaggtcatcgataccctcacatgcggcttcgccgacctcatggggtacattccgctcgtcggcgcccccctagggggcgctgccagggccctggcacatggtgtccgggttctggaggacagcgtgaactatgcaacagggaatttgcccggttgctctttctctatcttcctcttggctctgctgtcttgtttgaccaccccagcttccgcttatgaagtgcgcaacgtgtccgggatataccatgtcacgaatgactgctccaactcaagcatcgtgtatgaggcagcagatatcatcatgcatgcccccggatgcacaccctgcgttcgggagggcaaatcctcccgttgctgggtagcgctcacccccacactcgcagccaggaacatcagcgtccccactacgacaatacgacgccacgtcgacttgctcgttggggcggctgctttctgctccgctatgtacgtgggggatctctgcggatctgttttcctcgtcggccagctgttcaccttgtcgcctcgccggcatcagacggtacaggactgcaattgctcgatctatcctggccacgtatcaggtcaccgcatggcttgggatatgatgatgaactggtcacctacagcagccctggtggtgtcgcagttgctccggatcccacaagccatcatggacatggtggtgggggcccactggggagtcctggcgggccttgcctactattccatggtggggaactgggctaaggttctgattgtgatgctgcttttcgccggcgttgacggggacacccgcgtgacagggggggcgtcagcccacaacacccgcacgttcacgtccttctttacatctgggccttcccagaaaatccagcttgtgaataccaacggtagctggcacatcaacaggactgccctgaactgcaatgactccctccagactgggttccttgccgcgctgttctacacacacaggttcaacgcgtctggatgcccggaacgcatggccagctgccgtcccatcgataacttcgatcagggatggggtcccatcacttatgctgagcctaacagcccggaccagaggccttattgttggcactacgcacttcgaccgtgtggtaccacacccgcgtcgggggtgtgtggtccagtgtattgcttcaccccaagccctgttgtggtggggaccaccgatcgtttcggcgcccccacgtataattggggggagaatgagacggacgtgttgctcctaaacaacacgcggcttccgcaaggcaattggttcggctgtacatggatgaatagcactgggttcaccaagacgtgtgggggccccccgtgtaacatcgggggggccggcaacaacaccttgatttgccccacggattgcttccggaagcaccccgaggctacttacacaaaatgtggctcggggccttggctgacacctaggtgcttagttgactacccatacaggctctggcactacccctgcactgtcaattttaccatcttcaaggttaggatgtatgtggggggcgtggagcacaggctcagtgctgcatgcaattggactcgaggagagcgttgtggcttggaggacagggatagatcagaactcagcccgctgctgctctcaacaacagagtggcagatactgccctgttccttcaccaccttaccggccctgtccactggtctaatccatctccatcggaacatcgtggacgtgcaatatctgtacggtatagggtcagcggttgtctcctttgcaatcaaatgggaatatgtcgtgttgctcttccttctcctggcagacgcgcgtgtatgtgcctgcttgtggatgatgctgctggtagcccaggccgaggccgccttagaaaacctggtggtcctcaatgcggcgtccgtggccggagcgcatggcattctctccttccttgtgttcttctgtgccgcctggtatatcaagggcaggctggtccctggggcggcatatgctctctacggcgtatggccgctactcctgctcctgttggcgttaccgccacgagcttacgccttggaccgggagatggctgcatcatgtggaggcggggtttttgtaggtctggcactcttgaccttgtcaccatactataaagtgttcctcgctaggctcatatggtggttgcagtatttcatcaccagagccgaggcgcacttgcaagtgtggatcccccctctcaacgtccggggaggccgtgatgccatcatcctcctcgtgtgcgcggtccatccagagctgatctttgacatcaccaagctcctgctcgccatattcggtccgctcatggtgctccaggccagcataactagagtgccgtacttcgtacgcgctcaagggctcattcgtgcatgcatgttagtgcggaaagtcgccgggggtcattatgtccaaatggccctcgtgaagctggccgcgctgacaggtacgtacgtttatgaccatctcgccccactgcagcattgggcccacgcgggcctacgagaccttgcggtcgcagtagagcccgtcgtcttctctgacatggaaaccaagatcatcacctggggggcagacaccgcggcgtgtggggacatcatcttgggtctgcccgtctccgcccgaaggggcagggagatactcctgggaccagccgatagctttgaggggcaggggtggcgactcctcgcgcccatcacggcttactcccaacagacgcggggcttacttggttgtatcatcaccagcctcacaggccgggacaagaaccaggtcgagggggaggttcaagtggtctccaccgcaacacaatctttcttggcgacctgtgtcaacggcgtgtgttggactgtctttcacggcgccggctcaaagactctagccggcccaaagggcccaattacccaaatgtacaccaatgtagaccaggacctcgtcggctggcaggcgccccctggggcacgttccatgacaccatgcacctgcggcagctcggacctttacttggtcacgagacatgctgatgtcatcccggtgcgccggcggggcgacagcagggggagccttctctcccccaggcccatctcctacttgaagggctcttcgggtggtccgctgctctgccctctggggcatgtcgtaggcatcttccgggccgctgtgtgcacccggggggttgcgaaggcggtggactttgtacccgtcgagtccatggaaaccactatgcggtctccggtcttcacagacaactcatcccccccggctgtaccgcagacattccaagtggcccatctacacgctcccactggcagcggcaagagcactaaggtgccggctgcatatgcagcccaggggtacaaggtactcgtcttgaacccgtccgttgccgctaccctaggttttggggcgtatatgtctaaggcatatggtaccgaccctaacatcagaactgggataaggaccatcaccacaggcgcccccattacgtactccacctatggcaagttccttgccgacggtggttgctccgggggcgcctatgacatcataatatgtgatgagtgccactcaactgactcgactaccatcttgggcatcggcacggtcctggatcaagcggagacggctggagcgcggcttgtcgtgctcgccaccgctacgcctccgggatcggtcaccgtgccacaccccaatattgaggaggtggccctgtctaacactggagagatccccttctatggcaaggccatccccctcgaggtcatcaaggggggaagacatctcatcttctgccactccaagaagaagtgcgacgagctcgccgcaaagctgtcagccctcggactcaatgctgtagcgtattaccggggtcttgatgtgtccgtcataccgaccagcggagacgtcgttgtcgtggcaacggacgccctaatgacgggctataccggcgactttgactcagtgatcgactgtaacacatgtgtcacccagacagtcgatttcagcttggatcccactttcaccattgaaacgacgaccgtgccccaagacgcggtgtcgcgctcgcagcggcgaggtaggactggcaggggtaggataggcatctataggtttgtgactccaggagaacggccctcgggcatgttcgattcctcggtcctgtgtgagtgctatgacgcgggctgtgcttggtacgagctcacgccctctgagaccacagtcaggttgcgggcgtacctaaatacaccagggttgcccgtctgccaggaccatctggagttctgggagagcgtctttacaggcctcacccacatagacgcccacttcttgtcccagactaagcaggcaggagacaacttcccctacctggtggcataccaggctacagtgtgcgccagggcccaggctccacccccatcatgggatcaaatgtggaagtgtctcatacggctaaaacctacactgcacgggccaacgcccttgctgtataggctaggagccgtccagaatgaggtcaccctcacacaccccataaccaaattcatcatgacatgtatggcggctgacctggaggtcgtcaccagcacctgggtgctggtaggcggagtccttgcagctctggccgcgtattgcctgacaacaggcagcgtggtcattgtgggcaggatcatcttgtccgggaagccggccgtcattcctgacagggaagttctttaccgagagttcgatgagatggaagagtgcgcatcacacctcccttacatcgaacagggaatgcagctcgccgagcaattcaaacagaaggcgctcgggttgctacaaacagccaccaagcaagcggaggctgctgctcccgcggtggagtccaagtggcgagcccttgaggccttctgggcgaagcacatgtggaacttcatcagcgggatacagtacttagcaggcttatccactctgcctgggaaccccgcgatagcatcactgatggcattcacagcctctatcaccagcccgctcaccacccaaaataccctcctgtttaacatcttggggggatgggtggctgcccaactcgcgccccccagcgctgcttcggctttcgtgggcgccggcattgccggtgcggctgttggcagcataggccttgggaaggtgcttgtagacatcctggcgggctatggggcaggggtggctggcgcactcgtagcttttaagatcatgagcggcgagatgccttccaccgaggacctggttaacttgctccctgccatcctctctcctggcgccctggttgtcggggtcgtgtgcgcagcaatactgcgtcggcacgtgggcccgggagagggggctgtacagtggatgaaccggctgatagcgttcgcttcgcggggtaaccatgtttcccccacgcactacgtgcctgagagcgacgcagcagcgcgtgttactcagatcctctccagccttaccatcactcagctgctgaagaggcttcaccaatggattaatgaggactgctccacgccatgctccggctcgtggctaagggatgtttgggactggatatgcacggtgttgaccgacttcaagacctggctccagtccaagctcatgccgcggttgccgggagtccctttcttctcgtgccaacgcgggtacaagggagtctggcggggggacggtatcatgcagaccacctgcccatgtggagcacagatcaccggacatgtcaagaacggttccatgaggatcgttgggcctaaaacctgcagcaacacgtggcatggaacattccccatcaacgcatacaccacgggcccctgcacaccctccccggcgccaaactattccagggcgctgtggcgagtggccgctgaggagtacgtggaggttacgcgggtgggggatttccactacgtgacgggcatgaccactgacaacgtgaagtgcccatgccaggttccggcccccgaattcttcacggaggtggacggagtacggttgcacaggtacgctccggcgtgcaaacctctcctacgggaggaggtcacattccaggtcgggctcaaccagtacgtggttggatcacagctcccatgcgagcccgaaccggatgtagcagtgctcacttccatgctcaccgacccctcccacattacagcagagacggctaagcgtaggctggccagggggtctcccccctccttggccagctcgtcagctagccagttgtctgcgccttctttgaaggcgacatgcactacccatcatgactccccggacgctgacctcatcgaggccaacctcttgtggcggcaagagatgggcgggaacatcacccgcgtggagtcagagaacaaggtagtaattctggactctttcgacccgcttcgagcggaagaggatgagagggaagtatccgttgcggcggagatcctgcggaaaaccaggaagttccctgcagcgatgcccgtatgggcncgcccggattacaaccctccactgctagagtcctggaaggacccggactacgtccctccggtggtgcacgggtgcccattgccacctaccaaggcccccccaataccacctccacggagaaagaggacggttgtcttgacagaatccaccgtgtcttctgccttggcggagctcggtactaagaccttcggcagctccgaatcgtcggccgtcgacagcggcacggcgactgcccctcctgaccaggcctccgacgacggcgacaagggatccgacgctgagtcgtattcctccatgcccccccttgagggggagccgggggaccccgatctcagcgacgggtcttggtccaccgtgagcgaggaggctagtgaggacgtcgtctgctgctcaatgtcatacacgtggacaggcgccctgatcacgccatgcgctgcggaggaaagcaagttgcccatcattccgttgagctactccttgctgcgtcaccacaacatggtctacgccacaacatcccgtagcgcaagcctgcggcagaagaaggtcacctttgacagactgcaagtcctggacgaccactaccgggacgtgctcaaggagatgaaggcgaaggcgtccacagttaaggctaaacttctatccgtagaagaagcctgcaagctgacgcccccacactcggccaaatccaaatatggctatggggcaaaggacgtccggaacctatccagcaaggccgtcaaccacatccgctccgtgtgggaggacttgctggaagacactgagacaccaataaataccaccatcatggcaaaaagtgaggttttctgcgtccaaccagagaaaggaggccgcaagccagctcgccttatcgtattcccagacctgggagttcgtgtatgcgagaaaatggccctctacgacgtggtctcaacccttcctcaggccgtgatgggctcctcatacggattccagtactctcctaagcagcgggttgagttcctggtgaacacctggaaatcaaagaaatgccctatgggcttctcatatgacacccgctgttttgactcaacggtcaccgagagtgacatccgtactgaggagtcaatttaccaatgttgtgacttggcccccgaagccagactggccataaggtcgctcacagagcggctctatgtcgggggccccctgactaattcaaaagggcagaactgcggttatcgccggtgccgcgcgagcggcgtgctgacgactagctgcggtaataccctcacatgttacttgaaagccactgcggcctgtcgagctgcgaagctccaggactgcacgatgctcgtgaatggagacgaccttgtcgttatctgtgaaagcgcgggaaccgaagaggatgcggcgagcctacgagtcttcacggaggctatgactaggtactctgccccccccggggacccgcctcaaccagaatacgacttggagttgataacatcatgctcctccaacgtgtcggtcgcacacgatgcatctggcaaaagggtgtactacctcacccgcgaccccactaccccccttgcacgggctgcgtgggagacagctagacacactccagttaactcctggctaggcaacatcatcatgtatgcgcccaccttatgggcaaggatgattctgatgactcacttcttctccatccttctagcccaggagcaacttgaaaaggcccaggattgtcagatctacggggcctgttactccattgagccacttgacctacctcagatcattgaacgactccatggtcttagcgcattttcactccatagttactctccaggtgagatcaatagggtggcttcatgcctcaggaaacttggggttccacccttgcgagtctggagacatcgggccagaagtgtccgcgctaagctactgtcccagggggggagggctgccacttgtggcaagtacctcttcaactgggcagtaaggaccaagctcaaactcactccaatcccggctgcgtcccggctggacttgtccggctggttcgtcgctggttacagcgggggagacatatatcacagcctgtctcgtgcccgaccccgctggttcatgtggtgcctactcctactttccgtaggggtaggcatctacctgctccccaaccgatgaacggggagctaaccact

SEQ ID NO: 692 - DNA, 9379 bp, Hepatitis C Virus
ttgggggcgacactccaccatagatcactcccctgtgaggaactactgtcttcacgcagaaagcgtctagccatggcgttagtatgagtgtcgtgcagcctccaggcccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagcgttgggtcgcgaaaggccttgtggtactgcctgatagggtgcttgcgagtgccccgggaggtctcgtagatcgtgcatcatgagcacaaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttctgagcggtcgcaacctcgtggaaggcgacaacctatccccaaggctcgccggcccgagggcagggcctgggctcagcccgggtacccttggcccctctatggcaacgagggtctggggtgggcaggatggctcctgtcaccccgtggctcccggcctagttggggccccacagacccccggcgtaggtcgcgtaatttgggtaaggtcatcgataccctcacatgcggcttcgccgacctcatggggtacatcccgctcgtcggcgcccccctaggaggcgctgccagggccctggcgcatggcgtccgggttctggaggacggcgtgaactatgcaacagggaatctgcccggttgctctttctctatcttcctcttggctttgctgtcttgtttgaccatcccagcttccgcctatgaagtgcgcaacgtgtccggggtgtaccacgtcacgaacgactgctccaactcaagcattgtgtatgaggcagcggacatgatcatgcacacccccgggtgcgtgccctgcgtccgggagggcaattcctcccgctgctgggtagcgctcactcccacgctcgcggccaggaatcgcagcatccccgttacgacaatacgacgccatgtcgatttgctcgttggggcagctgctttctgctccgctatgtacgtgggggatctctgcggatctgttttcctcgtctcccagctgttcaccttctcacctcgccggtatgagacggtgcaagactgcaactgctcactctatctcggccacgtaacaggtcaccgcatggcttgggatatgatgatgaactggtcgcctacaacagccctagtggtatcgcagttgctccggatcccacaagccgtcatggacatggtggcgggggcccactggggagtcctggcgggccttgcctactattccatggtggggaactgggctaaggtcttgattgtgatgctgctctttgccggcgttgacgggaggacccgtgtgatgggggggcaggcggctcaacacaccagggggtttgcgtccttcttttcacctggggcagctcagaagatccaacttataaagaccaacggcagttggcacatcaacaggactgccctgaactgcaatgactccctcaacaccgggttccttgccgcgctgttctacgcacacaagttcaacgggtccggatgcccagagcgtatggccagctgccgccgcattgacaagttcgctcaggggtggggtcccatcactcatgttgtgcctaacatctcggatcagaggccttattgttggcactacgcaccccaaccgtgcggtattgtacccgcggcggaagtgtgtggcccagtctattgtttcaccccgagccctgttgtagtggggacgaccgatcgttctggcgcccccacgtataattggggggagaatgagacggacgtgctagtccttaacaacactcggcctccgctgggcaactggtttggctgtacatggatgaactctactggattcaccaagacatgcggggcccccccgtgtaacatcgggggggtcggcaacaacaccttgatctgccctacggactgtttccggaagcaccccgaggccacttacacaaaatgtggctcggggccttggttgacacctagatgcatggttgactacccatacaggctttggcactacccctgtactgttaactttaccgtcttccaggttaggatgtacgtggggggtgtggagcacaggctcaaagccgcgtgcaattggacttggggagagcgttgtgacttggaggacagagacagatcagaacttagcccgctgctgctgtctacaacagagtggcagatactgccctgctccttcaccaccctaccggctctgtccactggtttgattcacctccatcagaacatcgtggacgtgcaatacctgtacggtgtagggtcagcggttgtctccgttgtcatcagatgggagtatgtcctgctgctcttcctcctcctggcggacgcgcgcgtctgcgcctgcttatggatgatgctgctgatagcccaagctgaagccgccttagagaacctggtggtcctcaatgcggcgtccgtggccggagcgcatggcattctctccttccttgtgttcttctgtgctgcctggtacatcaagggcaagctggtccctggggcggcatacgctctctatggcgtatggccgctgctcttgctcctactggcgttaccaccacgggcatacgccatggaccgggagatggctgcatcatgcggaggtgtggttttcataggtctggcactcttgaccttgtcaccacactacaaagtgttcctcgctaagctcatatggtggttacaatattttatcaccagggctgaggcgcacttgcaagtgtgggtcccccctctcaacgttcgggggggtcgtgatgccatcatcctcctcacatgtgcggcccactcggagctagtcttcgacatcaccaaaatcttgctcgccatattgggtccgctcatggtgctccaggctggcttaactagagtgccgtacttcgtgcgcgctcaagggcttatccgtgtgtgcatgttggtgcggaaagttgctgggggtcattatgtccaaatggctctcatgaagctggccgcactgacgggcacgtacgtctatgaccatcttactccgctgcggcactgggcccacgcgggcctgagagaccttgcagtggcagttgagcccgtcgtcttttctgacatggagaccaagatcatcacctggggggcggacaccgcggcgtgtggggacatcatcttgggactgcccgtctccgctcgaagggggagggagatactcctgggaccggccgataggtttggagagcaaggatggcgactcctcgcgcctatcacggcctactcccaacagacacggggtctaattggctgcatcatcaccagcctcacaggccgggacaagaaccaggtcgagggggaagttcaggtggtttccaccgcgacgcagtctttcctggcgacctgtgtcaacggtgtgtgttggactgtctttcatggtgctggcacaaagaccctagctggcccgaaaggtccaatcacccaaatgtacaccaatgtagaccaagacctcgtcggctggcaggcgccccccggggcgcgttccatgacaccgtgtacctgcggcagctcggacctttacttggtcacgaggcatgctgacgtcattccggtgcgccggcggggcgacagcagagggagcctactctcccctaggcctatctcctacctcaagggctcttcgggtggcccgctgctttgcccctcggggcacgtcgtgggcatctttcgggccgctgtgtgcacccggggggttgcaaaggcggtggacttcgtacccgttgagtctatggaaactactatgcggtctccggtcttcacggacaactcatctcccccggccgtaccgcagacattccaagtggcccacctgcacgctcccaccggcagtggcaagagcactaaggtaccggctgcatatgcagcccaagggtacaaggtactcgtcctgaacccatccgttgctgccaccttaggttttggggcgtatatgtccaaggcacatggcgttgaccctaacatcagaactggggtaaggaccatcaccacgggcgctcccatcacgtactccacctacggcaagttccttgccgacggtggttgctccgggggtgcctacgacatcataatgtgtgatgagtgccactcaaccgactcaacctccatcttgggtattggcacagtcctggaccaagcggagacggctggagcgcggctggtcgtgctcgctaccgctacgcccccgggatcggtcaccgtgccacaccccaacatcgaggaggtggccttgtccaacaccggagagattcccttctacggcaaagccatccccatcgagaccatcaaggggggaaggcaccttattttctgccattccaagaagaaatgtgacgagcttgccgcaaagctgtcggccctcggaatcaatgctgtggcgtactaccggggccttgatgtgtccgtcataccgacaagcggaaacgtcgttgtcgtggcaacagacgctctgatgacgggctataccggtgactttgactcagtgatcgactgtaacacatgtgtcacccagacagtcgacttcagcttggaccctactttcaccattgagacgacgaccgtgccccaagacgcggtgtcgcgctcgcagcggcgaggcaggactggtaggggcagaaggggcatatacaggtttgtgactccaggggaacggccctcgggcatgttcgattcttcggtcctgtgtgaatgttatgacgcaggctgcgcttggtacgagctcacgcccgccgagacctcagttagattgcgggcttacttgaatacaccagggctgcccgtctgccaggatcatctggagttttgggagagcgtcttcacgggcctcacccacatagatgcccacttcttgtcccagactaagcaagcaggggacaacttcccctacctggtggcataccaggctacagtgtgcgccagggcccaggctctacctccatcgtgggatcaaatgtggaagtgtctcacacggctaaagcctacgctgcacgggccaacgcccctgttgtacaggctaggagccgtccaaaatgagatcaccctcacacaccccataaccaaatacatcatgacatgcatggcggctgacttagaggtcgtcacgagcacctgggtgctagtgggcggggtccttgcagctctggccgcgtactgcctgacaacgggcagcgtggtcattgtgggcaggatcatcttgtccgggaagccagctgttattcccgacagggaggttctctaccgggagtttgatgaaatggaagagtgcgcctcacatctcccttacatcgaacagggaatgcagctcgccgagcaattcaagcagaaggcactcgggttgctgcaaacagccaccaagcaagcggaggctgctgcccccgtggtggagtccaagtggcgagcccttgagggcttctgggcgaagcacatgtggaacttcatcagcgggatacagtacttggcaggcttgtccactctgcccgggaaccccgcaatagcatcactgatggcgttcacagcctctattaccagcccgctcaccacccaacataccctcttgtttaacatcttggggggatgggtggccgcccaactcgcccctcctagcgctgcctcagctttcgtgggcgccggcattgccggcgcggccgttggcagcataggtcttgggaaggtgcttgtggacatcctggcaggctatggagcaggggtggcaggcgcactcgtggcctttaaagtcatgagcggcgagataccctccgccgaggacatggtcaacttactccctgccatcctctctcctggtgccctggtcgtcggggtcgtgtgcgcagcaatacttcgtcggcacgtgggcccaggggagggggctgtgcagtggatgaaccggctgatagcgttcgcctcgcggggtaaccacgtttcccccacgcactatgtgccagagaacgacgccgcagcgcgtgtcacccagatcctctctagccttaccatcactcagctgttgaagaggctccaccagtggattaatgaggactgctccacgccatgctccggctcgtggctcagggacgtttgggactggatatgtacggtgttgaccgacttcaagacctggctccagtctaagctcctaccgcggttaccgggagtccctttcttctcatgccaacgtgggtataagggggtctggcggggagatggcgtcatgcaaaccacctgcccctgtggagcgcaaatcactggacatgtcaaaaatggttccatgaggatcgttgggcctaaagcctgcagcaacacgtggcatggaacattccccatcaacgcgtacaccacgggcccctgcacaccctccccggcgccaaactattccagggcgttgtggcgggtggctgctgaggaatacgtggaggtcacgcgggtgggggatttccactacgtgacgggcatgaccactgacaacgtaaaatgcccatgccaggttccggcccccgaattcttcacggaactcgatggggtgcggttgcacaggtacgctccggcgtgcagacctctcctacgggaggaggtcacattccaggtcgggctcaaccagtacccggttggatcacagctcccatgtgagcccgaaccggatgtaacagtgctcacttccatgctcaccgaccccccccacattacagcagaggcggctaggcgcaggctggccagggggtctcccccctccttggccagctcttcggctagtcagctgtctgcgccttctctgaaggcgacatgcactacctgccatgactccccagatgctgacctcatcgaggccaacctcctgtggcgacaggagatgggcggaaacatcactcgcgtagagtcagagaataaggtggtaatcctagactcttttgacccgctccgagcggaggaggatgagagggaagtatccgttgcggcggagatcctgcggaaatccaggagattccctccagcgttgcccatatgggcacgcccggattacaacccaccactgctagagtcttggaagggcccggactacccccctccggtagtgcacgggtgcccattgccacctaccaaggcccctccaataccacctccacggaggaagaggacggttgttctgacagaatccaccgtatcttctgccttggcggagcttgctacaaagaccttcggcagttctggatcgtcggctgccgacagcggcacagcgactgctcctcctgatcagcccctcgacgacgatggcacaggatccgacgttgagtcgtactcctcgatgcccccccttgagggggagccgggggaccccgatctcagcgacgggtcttggtccactgtgagcgaggaggctggtgaggacgtcgtctgctgctcgatgtcctacacatggacaggcgccttaattacgccatgcgccgcagaggagagcaagctgcccattaacgcgctgagcaattctttgctgcgtcatcacaacatggtctatgccacaacatcccgcagcgcaagccaacggcagaagaaggttacctttgacagactgcaagtcctggacgaccactaccgggacgtgctcaaggagatgaaggcgaaggcgtccacagtcaaggctaagcttctatccatagaggaagcctgcaggctgacgcccccacattcagccaaatccaagtttggctacggggcaaaggacgtccggagcctatccagcaaggccgttaaccacatccactccgtgtggaaggacttgttggaagacactgaaacaccaattgacaccaccatcatggcgaaaaatgaggtcttctgtgtccaaccagagaagggaggccgcaaggcagctcgccttatcgtgttcccagacttgggggttcgtgtgtgcgagaaaatggccctttacgacgtggtctccactcttccccaggccgtgatgggcccctcatacggattccagtactcccctgggcaccgggttgaattcctggtgaatgcttggaaatcaaagaaaaaccctatgggcttcgcatatgatacccgctgttttgactcaacggtcactgagagtgacatccgtgttgaggagtcaatttaccaatgttgtgacttagcccccgaggccagacaggtcataaggtcgctcacagagcggctttacgttgggggccccctgactaattcaaaagggcagaactgcggctatcgccggtgccgcgccagcggcgtactgacgaccagctgcggtaatacccttacatgttacttgaaggcttctgcggcctgtcgagctgcgaagctccaggactgcacgatgctcgtgtgcggagacgaccttgtcgttatctgtgaaagcgcgggaacccaggaggatgaggcgagcctacgagtcttcacggaggctatgactaggtattctgccccccccggggacccgccccgaccagaatacgacctggagctgataacatcatgctcctccaacgtgtcggtcgcgcacgacgcatctggcaaacgggtgtactacctcacccgagaccccaccaccccccttgcgcgggctgcgtgggagacagccagacacactccagttaactcctggctaggcaacatcatcatgtacgcgcccactttgtgggcaaggatgattctgatgacccacttcttctccatccttctagctcaggagcaacttgaaaaagccctagattgtcagatctatggggctacttactccattgaaccacttgacctacctcaaatcattcagcgactccatggtcttagcgcgttttcactccatagttactctccgggtgagatcaatagggtggcttcatgcctcaggaaacttggggtaccacccttgcgagtctggagacatcgggccagaagtgtccgtgctaagctactgtcccagggggggagggccgccacttgcggcaaatacctcttcaattgggcagtaaggaccaagcttaaactcactccgatcccggctgcgtcccagttggacttgtccggctggttcgttgccggttacagcgggggagacatatatcacagcctgtctcacgcccgaccccgctggttcctgtggtgcctactcctactctctgtaggggtaggcatctatctgctccccaaccggtgaacggggagctaaccact

SEQ ID NO: 693 - DNA, 9379 bp, Hepatitis C Virus
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgttaagttcccgggcggtggtcagatcgttggtggagtttacctgttgccgcgcaggggccccaagttgggtgtgcgcgcgactaggaagacttccgagcggtcgcaacctcgtgggaggcgacaacctatccccaaggctcgccaacccgagggtaggtcctgggctcagcccgggtacccttggcccctctatggcaacgagggcctggggtgggcaggatggctcctgtcaccccgcggctcccggcctagttggggcccctcagacccccggcgtaggtcacgcaatttgggtaaggtcatcgataccctcacgtgtggcttcgccgacctcatggggtacattccgctcgtcggcgctcccttagggggcgttgccagggccctggcacatggtgtccgggctgtggaggacggcgtgaattatgcaacagggaatttgcccggttgctctttctctatcttcctcttggccctactgtcctgcttgaccatcccagcttccgcttatgaaatgcgcaacgtgtccggggtgtaccatgtcacgaacgactgctccaactcaagcattgtgtatgaggcagcggacatgatcatgcattcccccgggtgcgtgccctgcgttcgggaagctaatctctcccgttgctggatagcgctcacccccacgctagcggccaggaacgccagcgtccccaccacgacaatacgacgccatgtcgatttgcttgtcgggacggctgctttctgctccgctatgtacgtgggggatctctgcggatctgttttcctcgtctcccagctgttcaccttctcgcctcgccagcatgagacagtacaggactgcaattgctcaatctacgtcggccacatatcaggtcaccgcatggcttgggacatgatgatgaactggtcgcctacaacagccctggtggtgtcgcagttactccggatcccacaagctatcgtggacatggtggcgggggcccactggggagtcctggcgggccttgcctactattccatggtggggaactgggctaaggtttttattgtgatgctactctttgccggcgttgacgggcggaccatcacggtagggggagcgacggcccgtaccaccagcgggtttacgtccctctttacacctggggcgtctcagagaatccagcttataaactccaatggcagttggcacatcaacaggactgctctgaattgtaatgactccctcaacacggggttccttgccgcgctgttctacacacacaggtttaactcgtccggatgtccggagcgcttagccagctgccgctccattgacacgttcgaccagggatggggtcccatcacctatgccaaatctggcagtccggaccagaggccttactgctggcactacgcgcctcggccgtgtggtgtcgtgcccgcgtcggaggtgtgtggcccagtgtattgcttcaccccaagccctgtcgtggtggggacgaccgatcggttcggtgctcctacatataactggggggagaatgagacggatgtgctgatcctcaacaacacgcggccaccgcaaggcaattggttcggctgtacgtggatgaatggcactgggttcaccaagacatgcgggggccccccgtgtaacatcgggggggccggcaacaacaccttgacctgccccacggactgcttccggaagcatcctgaggccacttacacaaaatgtggctcggggccttggttgacgcctagatgcttggttgactacccatacaggctctggcactacccctgcaccgtcaactttaccacctttaaggttagaatgtatgtggggggcgtggagcataggctcgttgctgcatgcaactggacgcgaggggagcgctgcaacttggaggatagggataggtcagagctcagcccgctgctgctgtctacaacagagtggcagatattgccctgttccttcaccaccctaccggctttgtccacaggattaatccacctccatcaaaacatcgtggacgtgcaatacctgtacggtatcgggtcagcggtggttccctttgcaattaaatgggagtatgtcctgttgttcttcctcctcctggcggacgcgcgcgtctgcgcctgcctgtggatgatgctgctgataacccaggttgaggccgccatggaaaacttggtaatcctcaatgcggcgtccgtggccggagcgcatggcattctctccttccttgtgttcttctgtgccgcctggtacatcaagggcaggctggttcccggggcggcatatgttctttacggcgtatggccgctgctcctgctcctgctggcgttaccacctcgagcttacgccatggatcgggagatggctgcgtcgtgcgggggcgcagttttcctgggtctggcattcttgaccttgtcaccatactataaggtgttcctcgctaggctcatatggtggttacaatatcttatcaccagagctgaggcgcacttacaagtgtgggttcccccccttaacgtcaggggaggtcgtgatgccattatcctcctcacgtgcgcggtccaccccgagctaatctttgacatcaccaagctcctgctcgccatactcggtccgctcatggtactccaggccggcttgattagagtgccgtacttcgtgcgcgctcaagggctcatccgtgcgtgtatgctggtgcggaaagttgccgggggccattacatccaaatggccttcgtgaaactggctgcactaacaggtacgtacgtgtatgaccatcttactccactgcgagattgggcccactcaggcctacgggacctcgcggtggcagtggagcccgtcgtcttctctgccatggagaccaagatcatcacatggggggcggacactgcggcgtgtggggacatcatcttaggcttgcccgtctccgcccgtaggggaagggagatattcctgggaccggccgacagccttgaggggcaggggtggcgtctccttgcgcccatcacagcatacgcccaacagacacggggcctgtttggctgcatcatcactagcctcacaggccgggacaggaaccaggtcgagggggaggtccaagtggtttccaccgcgacacaatctttcctggcgacctgcatcaatggcgtgtgttggacagtctaccacggcgccggctcgaagactctagccggcccaaagggaccaatcacccaaatgtacaccaacgtggaccaggacctcgtcggctggcaagcgccctctggggcgcgttccctgacaccatgcacctgcggcagctcggacctttatttggtcacgagacatgccgatgtcattccggtgcgccggcggagtgatggtaggggaagcttactctcccccaggcccatctcctacttgaagggctcttcgggtggtccactgctttgcccttcggggcacgttgtcgggatcttccgggccgccgtctgcacccggggggtcgcgaaggcggtggatttcatacccgttgagtccatggaaaccactatgcggtctccggtctacacagacaactcatcccctccggccgtaccgcaatcattccaagtggcccatctacacgctcccactggcagcggcaagagcaccagggtgccggctgcgtacgcggcccaagggtacaaggtactcgtcctgaacccgtccgtcgccgccaccttaggtttcgggacgtatatgtctaaggcatatggtaccgaccccaacatcaggaccggggtaaggaccatcactacgggcgcccccattacgtactccacctacggcaagttccttgccgacggtggctgctctgggggtgcctatgacatcataatatgtgatgagtgccactcaactgactcgactaccatcttgggtatcggcacagtcctggaccaagcggagacggctggagcgcggctcgtcgtgctcgccaccgctacgcctccgggatcggtcaccgtgccacaccccaacatcgaggaggtggccctgtctaacactggagagatccccttctatggtaaagccatccccatcgaggccatcaagggggggaggcatctcatcttctgccattccaagaagaagtgtgatgagctcgccgcgcagctgacagccctcgggatcaatgccgttgcatattaccggggtcttgacgtgtccatcataccaactagcggagacgtcgttgtcgtggcaacagacgctctaatgacgggctataccggcgactttgactcagtgattgactgtaatacatgtgtcacccagacagtcgacttcagcttggaccccaccttcaccattgagacgacgaccgtgccccaagactcggtgtcgcgttcgcagcggcgaggtaggactggtaggggtaggggaggcatctacaggtatgtgattccaggagaacggccctcgggcatgttcgattcctcggtcctgtgtgagtgctatgacgcgggctgtgcttggtacgagctcacgcccgctgagaccacggtcaggctacgggcctacatgaatacaccagggttgcccgtttgtcaggatcacctggagttctgggagggcgtcttcacaggtctcacccacatagacgcccacttcttgtcccagactaagcaggcaggagataactttccctacctggtagcataccaagctacagtgtgtgccagggcccaggccccacctccatcgtgggaccaaatgtggaagtgtctcatacggctaaagcctacgctgcacgggccaacacccttgttgtataggctaggagccgtccaaaacgagatcactcttacacaccccataaccaaatacatcatggcatgcatgtcggctgacctggagatcgtcactagcacctgggtgctggtaggcggggtccttgcagctctggccgcgtattgcctgacaacaggcagcgtggtcatagtgggcaggatcatcttgtccgggaagccggctgttgttcctgacagggaagtcctctacagggagttcgatgaaatggaagagtgcgcttcgcacctcccgtacatcgaacaggggatgcagctcgccgagcaattcaaacagaaagcgctcgggttactgcagacagccaccaagcaagcggaggcggctgctcccgtagtggagtccaagtggcgagccctcgaaaccttctgggcgaagcacatgtggaatttcatcagcgggatacagtacttagcaggcttatccaccctgcctgggaaccccgcgatagcatcactgatggcattcacagcctccgtcactagcccgctcaccacccaaaataccctcctgtttaacatcttggggggatgggtggctgcccaactcgcccctcccagcgctgcttcggctttcgtgggcgccggcattgccggtgccgccgttggtagcataggccttgggaaggtgcttgtggacatcctggcgggctacggggcgggggtggctggcgcactcgtggcctttaagatcatgagcggcgagatgccctccaccgaggacctggttaatttactccctgccatcctctctcctggcgccctggtcgttggggttgtgtgcgcagcaatactgcgaaggcacgtgggcccgggagagggggctgtacagtggatgaaccggctgatagcgttcgcttcgcggggtaaccacgtctcccccacgcactatgtgcctgaaagtgacgctgcagcacgtgttacacagatcctctccagccttaccatcactcagctgttgaagaggcttcaccagtggatcaacgaagactgctccacgccatgctccggctcgtggttgagagatgtctgggactggatatgcacggtgttgagcgacttcaagacctggctccagtccaagctcctgccacggttaccgggagtccccttcttctcatgccaacgtgggtacaagggaatctggcggggggacggcatcatgcataccacctgcccatgtggagcgcagatctccggacatgtcaaaaacggttccatgaggatcgtcggccctagaacctgcagcaacacgtggcatggaacattccccatcaacgcgtacaccacgggccactgcacaccctccccggcgccaaactactccagggcgttgtggcgggtggctgctgaggagtacgtggaggttgtgcgggtgggggatttccactacgtgacgggcatgaccactgacaacttaaaatgcccatgccaggttccggcccccgaattcttcacggagctggatggggtgcggttgcacaggtacgctccggcgtgcaagcctctcctacgggaggaggtcacattccaagttgggctcaatcaatacccggttggatcacaactcccatgcgagcccgagccggacgtagcagtgctcacttccatgctctccgacccctctcacattacagcggagacggccaggcgtaggctagccagagggtctcccccctctttggccagctcttcggccagccaattgtccgcgccttctttgaaggctacatgcaccactcaccatggctccccggacaccgacctcgttgaggccaacctcatgtggcggcaggtgatgggcgggagcatcacccgcgtggagtcagagaataaggtagtaatcctggactctttcgtcccactccgaacagaggaggacgagagggaagtgtccgttccggcggagatcctgcggaagaccaggaagttccccccagcgatgcccgtatgggcgcgcccggactacaaccctccacttctagagccctggaagaaaccggactacgtccctcctgtggtacacgggtgtccattgccacctaccaaggcccccccagtgccacctccgcggagaaagaggacggttgtcctgacagagtccaccgtgtcttctgccttggcggagcttgctgctaagaccttcggcggtcccgggtcggagaccgccgatagcggcacagcaaccgcccctcctgaccaggccttcaatgacggcgacaacggatccgacgttgagtcgtactcctccatgcccccccttgagggagagccgggggaccccgatctcagcgacgggtcttggtctaccgtgagcgaggaggctcgcgaggatgtcgtctgctgctcaatgtcctacacatggacgggtgccctgatcacgccgtgcgctgcggaggaaagcaagctgcccatcaacgcgctgagcaactccttactgcgtcgccacaacatggtctacgctacaacatcacgcagtgcaagccagcggcagaagaaggtcacctttgacaggctgcaagtcctggacgaccactaccgggacgtgcttaaggagatgaaggcgaaggcgtccacagttaaagctaagcttctatctgttgaggaagcttgcaagctgacgcccccacactcagccaaatccaagtttggctatggggcaaaggacgtccggaacctatccagcagggccgttaaccacatccgctccgtgtggaaggacctgctggaagacactgagacaccaattgacaccaccatcatggccaaaagtgaggttttctgcgtccaaccagaaaaaggaggccgcaagccagctcgccttatcgtattcccagacctgggagttcgtgtgtgcgaaaagatggccctttacgacgtggtctccacccttcctcaggccgtgatgggctcctcgtacggattccagtactctcccaagcagcgggtcgagttcctggtgaatgcctggaaatcaaagaaatgccccatgggcttctcatatgacacccgctgttttgactcaacggtcactgagagcgacatccgcactgaggagtcaatttaccaatgttgtgacttggcccccgaagccaggcaggctataaggtcgctcacggagcgactttatatcgggggtcccctgaccaattcaaaagggcagagctgcggctatcgccggtgccgcgcgagcggtgtgctgacgaccagctgcggtaataccctcacatgttacttgaaggcctctgcagcctgtcgagctgcgaagctccgggactgcacgatgctcgtgaacggggacgaccttgtcgttatctgtgagagcgcggggacccaagaggatgcggcaaacctacgagtcttcacggaggctatgactaggtactctgccccccccggggacctgccccaaccagaatacgacctggagttgataacatcatgctcctccaatgtgtcggtcgcgcacgacgcatcaggcaaaagggtgtactacctcacccgcaatcccgccaccccccttgcacgggctgcgtgggagacagctagacacactccagtcaactcctggctaggcaatatcatcatgtatgcgcccactctatgggcaaggatgatcctgatgactcatttcttctccatccttctagctcaggagcaacttgaaaaggccctggattgccaaatctacggggcctgttactccattgaaccacttgacctacctcagatcattgaacgactccatggtcttagcgcattttcactccacagttactctccgggtgaaatcaatagggtggcttcatgcctcaggcaacttggggtaccacccttgcgagtctggagacatcgggccagaagtgtccgcgctaagctactgtcccagggggggagagctgccacttgtggcaagtacctcttcaactgggcagtaaagaccaaactcaaactcactccaattccggctgcgtcccggctggacttatccggctggttcgtcgctggttacagcgggggagacatatatcacagcgtgtctcgtgcccgaccccgctggttcatgttgtgcctactcctactttctgtaggggtaggcatctacctgctccccaaccggtgaacggggagctaaccact

SEQ ID NO: 694 - DNA, 9379 bp, Hepatitis C Virus
  misc_feature 1179, 4680: n = A,T,C or G
ttgggggcgacactccaccatagatcactcccctgtgaggaactactgtcttcacgcagaaagcgtctagccatggcgttagtatgagtgtcgtgcagcctccaggatcccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcatcatgagcacaaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccagcccgagggcagggcctgggctcagcccgggtatccctggcccctctatggcaatgagggcatggggtgggcaggatggctcctgtcaccccgtggctctcggcctagttggggccccacggacccccggcgtaggtcgcgtaatttgggtaaggtcatcgataccctcacatgcggcttcgccgacctcatggggtacattccgctcgtcggcgcccccctagggggcgcagccagggcccttgcacatggtgtccgggttctggaggacagcgtgaactatgcaacagggaatttacccggttgctctttctctatcttcctcttggctctgctatcctgtttgaccatcccagcttccgcttatgaggtgcgcaacgtgtccgggatgtaccatgtcacgaacgactgccccaacgcaagcattgtgtatgaggcggcggacgtgatcatgcatgcccccgggtgcgtgccctgcgttcgggagggtaactcctccagctgctgggtagcgctcactcccacgctagcggccaggaatgccagcgtccctactacgacaatacgacgccacgtcgatttgctcgttgggacggctgctttctgctccgccatgtacgtgggggatctctgcggatctntcttccttgtctcacagctgttcaccttctcgcctcgccggcatgagacagtacaggactgcaactgttcaatctatcccggccacgtgtcaggccatcgcatggcttgggatatgatgatgaactggtcacctacaacagccctggtggtgtcgcagttactccggatcccacaagctgtcgtggatatggtggcaggggctcactggggagtcctagcgggccttgcctactattccatggtggggaactgggctaaggttttgattgtgatgctactctttgccggcgttgacgggcaaacccgcgtgacggggggggcgtcagcctttaacacccgcagcttcacgtccctcttttcacctgggccaactcagaaaatccagcttgtaaacacaaatggcagctggcacatcaacaggactgccctgaactgcaatgactccctccaaactgggttccttgccgcgctgttctacacacacaggttcaacgcgtccgggtgcccagagcgtatggccagctgccgccccattgataagttcgatcaggggtggggtcccatcacttatgccgagcgtggcagccaagaccagaggccttattgctggcactacgcgcctaagaagtgtggtattgtacccgcgtcgcaggtgtgtggtccagtgtactgtttcaccccaagcccagttgtggtggggacaaccgaccggttcggtgtccctacttatagctggggggagaatgagacagacgtgctgctccttaacaacacgcggccgccgcaaggcaactggtttggctgtacatggatgaatggcactgggttcaccaagacgtgcgggggccccccgtgcgacatcgggggggtcggcaataacaccttgacctgtcccacggactgcttccggaagcaccctgaggccacttacacaaaatgtggctcggggccttggttgacacccagatgcatagttgactatccatataggctctggcattacccctgcactgtcaactttaccatcttcaaggtcaggatgtatgtagggggcgtggagcacaggctcaatgctgcatgcaattggacccgaggggagcgctgtgacttggaggacagggatagatcggagctcagcccgctactgctgtctacgacagagtggcagatattgccctgttcattcaccaccctaccggccctgtccactggtctaatccatctccatcagaacttcgtggacgtccaatacctgtacggtatagggtcggcggttgtctccattgcaatcaaatgggagtatgtcgtcttgcttttcctcctcctggcggacgcgcgcgtctgtgcctgcttgtggatgatgttgctgatagcccaggccgaggccgccctagagaacttggtggtcctcaatgcggcgtctgtggccggggcgcatggcattctctccttccttgtgttcttctgtgctgcctggtacattaagggcaggctggttcctggggcggcatatgctctctacggcgtatggccgctgctcctgctcctgctggcattaccaccacgagcttatgccttggaccgggagatggctgcatcgtgcggaggcggggtttttgtaggtctggcactcctgaccttgtcaccatactataaagtgttcctcgctaggctcatatggtggttacaatacttcatcaccagagccgaggcgctcttgcaagtgtgggtcccccccctcaacgtccggggaggtcgcgatgccatcatcctcctcgcgtgtgcggtccacccagagcttatctttgacatcaccaagctcctgctctccatactcggtccgctcatggtgctccaggctagcataatccgagtgccgtacttcgtacgcgctcaagggctcattcgtgcatgcatgttagtgcggaaagtcgccgggggtcattatgtccaaatggccttcatgaaactagccgcgctgacaggtacgtacgtttacgaccaccttactccactgcaggattgggcccatgcgggcctgcgagaccttgcggtggcagtagagcccgtcgtcttctctgccatggagaccaagatcatcacctggggggcagacaccgcagcgtgtggggacatcatctcgggtctgcccgtttccgcccgaagggggaaggagatactcctgggaccggccgacaattttgaatggcaggggtggcgactccttgcgccaatcacggcctactctcaacagacgcggggcctgcttggttgtatcatcaccagcctcacgggccgggacaagaaccaggtcgagggggaggttcaagtggtttccaccgcaacacaatctttcctggcgacctgcatcaacggtgcgtgttggactgtctaccacggtgccggctcaaagaccctagccggcccaaaaggcccaattacccaaatttacaccaatgtagaccaggacctcctcggctggcaggcgccccccgggtcgcgctctttgacaccgtgcacctgcggcagctcggacctttacttggtcacgagacatgctgacgtcattccggtgcgccggcggggcgataccagggggagcttgctctctcccaggcctgtctcctacttgaagggctcttcgggtggtccgctgctctgcccctcggggcatgctgtcggcatcttccgggctgctgtgtgcacccggggggttgcgaaggcggtggacttcatccccgttgaatctatggaaactactatgcggtctccggtgttcacagacaactcatctcccccggccgtaccgcagaccttccaagtggcccatctgcatgcccccactggcagcggtaaaagcactaaggtgccggctgcatatgcagcccaagggtataaggtgctcgtcctgaacccgtccgttgctgccaccttgggttttggggcgtatatgtctaaggcacatggcacagaccccaacatcagaactgggacaaggaccatcaccacgggtgcccctatcacgtactccacctatggcaagttccttgccgacggtggttgctctggaggcgcctacgacatcataatatgtgatgagtgccattcaactgactcgactaccgttttgggcattggcacggtcctggaccaagcggagacggctggagcacgacttgtcgtgctcgccaccgctacgcctccgggatcggtcactgtgccacactctaacatcgaggaggtggccctgaccaacactggagagattcccttctacggcaaagccatccccattgatgtcatcaaggggggaagacatctcattttctgccattccaagaagaaatgtgatgagctcgccgcaaagctgtcagccctcggactcaatgctgtagcatattaccgggggcttgacgtgtccgtcataccaaccagcggagacgtcgttgtcgtagcgacagacgctctaatgacgggctataccggtgactttgactcantgatcgactgtaacacatgcgtcacccagacagtcgactttagcttggatcccaccttcaccattgagacgacgaccgtgcctcaagacgcggtgtcgcgctcgcagcggcgaggtaggactggcaggggtaggggaggtatctacagatttgtgactccaggagaacggccctcgggcatgttcgattcctcggtcctgtgtgagtgctatgacgcgggctgtgcttggtacgagctcacgcctgccgagacttcagttaggttgcgggcttaccttaatacaccagggttgcccgtctgccaggaccatctggagttctgggagagcgtctttacaggcctcacccacatagatgcccactttctgtcccagactaaacaggcaggagacaacttcccctacctggtggcataccaagctacagtgtgcgccagagctcaggccccacctccatcgtgggaccaaatgtggaagtgtctcatacggcttaaacctacgctgcacgggccaacacccctgctgtataggctaggacccgttcaaaatgaggtcaccctcacacaccccataaccaaattcatcatggcatgcatgtcggctgacctggaggtcgtcactagcacctgggtgctagtaggcggggtccttgcagcactggccgcgtattgcttaacaacaggcagcgtggtcattgtgggtaggatcatcttgtccgggaggccggctgtcattcccgacagggaagtcctctaccgggagttcgacgaaatggaagagtgtgcctcacacctcccttacatcgaacagggaatgcagctcgccgagcaattcaaacagaaagcgctcgggttgctgcaaacagccaccaagcaagcggaggctgctgctcccgtggtggaatccaagtggcgaacccttgaggccttctgggcgaagcacatgtggaatttcatcagcgggatacagtacttagcaggcttatccactctgcctgggaaccccgcgatagcatcactgatggcattcacagcctctatcaccagcccgctcaccacccaaagtaccctcctatttaacatcttggggggatgggtggctgcccaactcgccccccccagtgctgcttcggcttttgtgggcgccggcatcgccggtgcggctgttggcagcattggccttgggaaggtgcttgtggacatcctggcgggttatggggcaggggtggctggcgcactcgtagcctttaagatcatgagcggcgagaggccctccacggaggatcgggataatatgatccatgccatcctctctcccggcgccctggtcgtcggggtcgtgtgcgcagcaatactgcgtcggcacgtgggcccgggagagggggctgtgcagtggatgaaccggctgatagcgttcgcttcacggggtaaccatgtttcccccacgcactatgtgcctgagagcgacgctgcagtgcgtgttactcagatcctctccagccttaccatcacccagctgctgaagaggcttcaccagtggatcaatgaggactgctccacgccatgctccggctcgtggctaagggatgtttgggactggatatgcacggtgttgagtgatttcaagacctggctccagtccaagctcctgccgcggttaccgggagttcccttcctctcctgccaacgcgggtacaagggggtttggcgaggggacggtatcatgcataccacctgcccgtgtggagcacaaatcaccggacatgtcaaaaacggttccatgaggatcgttgggcctaaaacctgcagcaacacgtggcatggaacattccccatcaacgcacacaccacgggtccctgcacaccctccccggcgccaaactattccagggcgctgtggcgggtgtctgctgaggagtacgtggaagttacgcgggtgggggatttccactacgtgacgggcatgaccactgacaacgtaaagtgcccatgccaggttccggcccccgaattcttcacagaagtggatggggtgcggttacacaggtacgctccggcgtgcaagcctctcctacgggaggaagtcacattccaggtcgggctcaaccaatatcttgttgggtcacagctcccatgcgagcccgaaccggatgtagcagtgctcacttccatgctcaccgacccctcccacattacagcagagacggctaagcgtaggctggccagggggtctcccccctccttggccagctcttcagctagccagttgtctgcgccttccttgaaggcaacatgcactacccaccatgactccccggacgctgacctcatcgaggccaacctcctgtggcggcaggagatgggcgggaacatcacccgcgtggagtcagagaataaggtagtaattctggactctttcgacccgcttcgagcggaggaggatgagagggaaccatccgttccggcggagatcctgcggaaatccaggaagtttccaccagcgttgcccatatgggcacggccagattataaccctcctctgctagagtcctggaaaaacccggactacgtccctccggtggtacacgggtgcccattgccacctaccaaggcccctccaataccacctccacggagaaagaggacggttgttctaacagagtccaccgtgtcttctgccttggcggagcttgctactaagaccttcggcagctccgaatcgtcggccgccgacagcggcacggcgactgctcctcccgaccaggcctccgacgacggcgacaaagaatccgacgttgagtcgtactcctccatgccccctcttgagggagagccgggggaccccgatctcagcgacgggtcttggtctaccgtgagcgaggaggccgccgaggacgtcgtctgctgctcaatgtcctacacatggacaggcgccctggtcacgccatgcgctgcggaggagagcaagttgcccatcaacccgttgagcaactccttgctgcgtcaccataacatggtctacgcgacaacatcccgcagcgcaagcctacggcagaagaaggtcacttttgacagactgcaagtcctggacgaccactaccgggacgtgcttaaggagatgaaggcgaaggcgtccacagtcaaagctaaacttctatctgtagaagaagcctgtaagctgacgcccccacattcagccagatccaaatttggctatggggcaaaggacgtccggaacctaaccggcaaggccgttaaccacatccgctccgtgtggaaggacttgctggaagacactgagacaccaattgacaccaccatcatggcaaaaagtgaggttttctgcgtccaaccagagaaaggaggccgcaagccagctcgctttatcgtattcccagacttgggagttcgtgtatgcgagaagatggccctttatgacgtggtctccacccttcctaaggccgtgatgggctcctcatacggatttcagtactcccctggacagcgggtcgagttcctggtgaaagcctggaaatcaaagaaatgccctatgggcttctcatatgacacccgctgttttgactcaacggtcactgagaacgacatccgcactgaggagtcaatttaccaatgttgtgacttggcccccgaagccagacaggctataaagtcgctcacagagcgactctatatcgggggtcccctgactaattcaaagggccaaaactgcggctatcgccggtgccgcgcgagcggcgtgctgacgaccagctgcggtaataccctcacatgttacttgaaggcctctgcagcctgtcgagctgcgaagctccaggactgcacgatgctcgtgaacggagacgaccttgtcgttatctgtgaaagcgcgggaacccaagaggatgcggcgaacctacgagtcttcacggaggctatgactaggtactctgccccccccggggacccgccccaaccagaatacgacttggagctgataacatcatgctcctccaatgtgtcggtcgcgcacgatgcatctggcaaaagagtgtactacctcacccgtgacccatccaccccccttgcacgggcggcatgggagacagctagacacactccagtcaactcctggctaggcaacatcatcatgtatgcgcccaccttatgggcaaggatgattctgatgactcacttcttctccatccttctagctcaggagcagcttgaaaaagccctggattgccaaatctacggggcctgttactccattgagccacttgacctacctcagatcattgaacgactccatggccttagcgcattttcactccatagttactctccaggtgagatcaatagggtggcttcatgcctcaggaaacttggggtaccacccttgcgagtctggagacatcgggccagaagtgtccgcgctaagttactgtcccagggggggagggccgccacttgtggcaagtacctcttcaactgggcagtaaggaccaaacttaaactcactccaatcccggctgcgtcccagttggacttgtccgactggttcgttgcaggttacagcgggggagacatatatcacagcgtgtctcgtgcccgaccccgctggttcatgttgtgcctactcctactttctgtaggggtaggcatctacctgctccccaaccgatgaacggggagctaaccact

SEQ ID NO: 695 - DNA, 9379 bp, Hepatitis C Virus
ttgggggcgacactccaccatagatcactcccctgtgaggaactactgtcttcacgcagaaagcgtctagccatggcgttagtatgagtgtcgtgcagcctccaggtccccccctcccgggagagccatagtggtctgcggaaccggtgagtacaccggaattgccaggacgaccgggtcctttcttggattaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcatcatgagcacaaatcctaaacctcaaagaaaaaccaaacgtaacaccaaccgccgcccacaggacgttaagttcccgggcggtggtcagatcgttggtggagtttacctgttgccgcgcaggggccccaggttgggtgtgcgcgcacctaggaagacttccgagcggtcgcaacctcgtggaaggcgacaacctattcccaaggctcgtcggcccgagggcagggcctgggctcagcccgggtacccttggcccctctatggcaatgagggcctggggtgggcaggatggctcctgtcaccccgaggctctcggcctagttggggcccctctgacccccggcgtaggtcgcgtaatttgggtaaggtcatcgataccctcacatgcggcttcgccgacctcatggggtacattccgctcgtcggcgcccccttaggaggcgctgccagagccctggcgcatggcgtccgggttctggaggacagcgtgaactatgcaacagggaatctgcccggttgctctttctctatcttcctcttggctttgctgtcttgtttgaccatcccagcttccgcctatgaagtgcgcaacgtgtccggggcgtaccatgtcacgaacgactgctccaactcaagcattgtgtatgatgcagcggacctgatcatgcacgcccccgggtgcgtgccctgcgtccgggagggcaattcctcccgttgctgggtagcgctcactcccacgctcgcggccaggaacagcagcatccccactacgacaattcgacaccacgttgatttgctcgttggggcagctgctctctgttccgctatgtatgtgggggatctctgcggatctgtttttctcgtctcccagctgttcaccttctcacctcgccggtatgagacggtacaagactgcaattgttcaatctatcccggccacgtatcaggtcaccgcatggcctgggatatgatgatgaattggtcacctacagcggccctagtggtatcgcagctactccggatcccacaagccgccgtggacatggtggcgggggcccactggggagtcctagcgggccttgcctactattccatggtggggaactgggctaaagtcttggttgtgatgctactctttgccggcgttgacggggaaacccgcgtgtcaggggggcaggcgggccgcgccacctatggctttgcgtctctcttcagcgcagggtcggctcagaagatccaactcgtaaacactaacggcagctggcacatcaacaggactgctctgaattgcaatgactccctcagcaccgggttccttgctgcgctgttctacacacacaagttcaacgcgtccggatgcccagagcgtatggccagctgtcgccccattgacacgttcgctcaggggtggggtcccatcactcatgccatgcctagcgtctcggaccagaggccatattgctggcactacgcacctcgaccgtgcggtatcgtacctgcgcagcaggtgtgtggtccagtgtattgcttcactccgagccccgttgtggtggggacgactgatcgttctggcgcccccacgtatacctggggggagaatgagacggacgtgctgcttctcaacaacacgcggccaccccaaggcaactggttcggctgcacatggatgaatagcaccgggttcaccaagacgtgcggggggcccccgtgtaacatcgggggggtcggcaacaacaccctgacctgccccacggattgcttccggaagcaccccgaagccacttacacaaaatgtggctcgggcccttggttgacacctaggtgtatagttgattatccatacagactttggcactacccctgtactgtcaactttaccgtctttaaggtcaggatgtatgtggggggcgtggagcacaggctcaacgccgcgtgcaactggacccggggagagcgatgtgacttgacggacagggataggtcagagcttagcccgttattattgtctacaacagagtggcagatattgccctgttccttcactaccttaccagccttgtccaccggattgatccacctccatcagaacatcgtggacgtgcaatacctgtacggtgtggggtcagcggttgtctccgttgtaatcaggtgggagtacgtcgtgctgctcttccttctcctggcagacgcgcgtgtctgcgcctgcttatggatgatgctgctggtagcccaggctgaggccgccttagagaacctggtggtcctcaatgcggcgtccgtggccggagcgcatggcattctctccttccttgtgttcttctgtgctgcctggtacatcaagggcaagctggtccctggggcggcatacgctctttatggcgtatggccgctgcttctgctcctgctggcgttaccaccacgagcatacgccatggaccgggagatggccgcatcatgcggaggcgcggttttcgtaggtctggcactcttgaccttgtcaccacactacaaggtgttccttgctaggctcatgtggtggttacaatactttatcactagggccgaagcgctcttgcaagtgtggatcccccccctcaacgttcgggggggccgcgatgccatcatcctcctcacgtgcgcggcccacccggaaagaatttttgaaatcaccaaaatcttgctcgccatactcggaccgctcatggtgttccaggctggcctagccaaggtgccgtacttcgtgcgcgctcaagggctcatccgtgcgtgcatgttggtgcggaaagtcgcagggggtcattatgtccaaatggccctcatgaagctggccgcactgacgggcacatacgtttataaccatcttactccactgcgggactgggcccacgcgggcctgcgagaccttgcggtggcagttgagcccgtcgtcttctctgacatggagaccaaggtcatcacctggggggcagacaccgcggcgtgtggggacatcatctcgggtctgcccgtctccgcccgaagggggagggagatacttctagggcctgccgatggtcttggagagcaggggtggcggctccttgcgcctatcacggcctactcccagcagacgcggggcctactaggctgcatcatcaccagcctcacaggtcgggacaagaaccaggttgagggggaggtccaagtggtctccaccgcaacgcagtctttcctggcgacctgcgtcaatggcgcgtgttggaccgtctaccatggcgccggctcgaagaccctggccggcccaaagggtccaattactcaaatgtacaccaatgtagaccaggacctcgtcggctggcaggcgccccctgggtcgcgttccctaacaccatgcacctgcggcagctcggacctttacttggtcacgaggcatgccgacgtcattccggtgcgccggcggggcgacagcagggggagcctgctttcccctaggcccatctcctacttgaagggctcttcaggtggtccactgctttgcccctcggggcacattgtgggcatcttccgggctgccgtgtgcacccggggggttgccaaggcggtggacttcatacccgttgagtctatggaaactactatgcggtctccggtctttacggacaattcatctcccccggccgtaccgcagacattccaagtggcccatctacatgcccccaccggcagcggcaagagcactaaggtgccagctgcatatgcagcccaagggtacaaggtgctcgtcctcaacccgtccgttgccgccactttgggttttggggcgtatatgtctaaagcacatggtatcgaccccaacatcagaacaggggcaaggaccatcaccacgggcgctcccattacgtactccacctatggcaagttccttgccgacggcggttgctctgggggcgcctatgatatcataatgtgcgatgagtgccactcaactgactcgacttccatcttgggcataggcactgtcctggaccaagcggagacggctggagcacggctcgtcgtgctcgccaccgctacgcctccgggatcggtcactgtgccacatcccaatatcgaggaggtggccttgtccaacactggagagatccctttctatggtaaagccatccccctcgagactatcaagggggggaggcatctcatcttctgccattccaagaagaaatgtgacgagcttgctgcaaagttgtcggccctcggagttaatgccgtggcgtactaccggggtcttgatgtgtccgttataccaacaagcggagacgtcgttgtcgtggcaacggacgctctaatgacgggctataccggcgactttgactcagtgatcgactgtaatacatgtgtcacccagacagtcgatttcagcttggaccctaccttcaccattgagacaacgaccgtgccccaagacgcggtgtcgcgctcgcagcggcgaggcaggactggtaggggcaggaggggcatatacaggtttgtgactccaggggaacggccttcgggcatgttcgattcttcggtcctgtgtgagtgctatgacgcgggttgtgcttggtacgagctcacgcccgccgagacctcggttaggttgcgggcttacctaaacacaccagggttgcccgtctgccaggaccatctggagttctgggagggtgtcttcacaggcctcacccacatagatgcccacttcttgtcccagactaaacaggcaggagataatttcccctacctggtagcataccaagctacagtgtgcgccagggcccaagctccacctccatcatgggatcaaatgtggaaatgtctcatacggctaaagcctacgctacacgggccaacacccctgttgtacaggctaggagccgtccaaaacgaggtcaccctcacacaccccataaccaaatacatcatgacatgtatgtcggctgacctagaggtcgtcaccagcacctgggtgctggtaggcggggtccttgcagctctggccgcgtactgcctcacaacgggcagtgtggtcattgtgggcaggatcatcttgtcagggaggccggctatcatccccgatagggaagttctctaccaagagttcgacgaaatggaggagtgcgccacacaactcccctacatcgaacagggaatgcagctcgccgagcaattcaagcagaaggcgctcgggttgctgcaaatagccactaagcaagcggaggctgctgcccccgtggtggagtccaagtggcggaccctcgaggctttctgggcgaagcacatgtggaatttcatcagcgggatacagtacttagcaggcttgtccaccttgcctgggaaccccgcgatagcatcactgatggcattcacagcctctatcaccagcccgctcaccacccaacacaccctcttgttcaacatcttggggggatgggtggccgcccaactcgccccccccagcgctgcttcagcttttgtgggcgccggcattgctggcgcggctgttggcagcataggccttgggaaggtgcttgtggacatcctggcgggttatggagcaggggtggcaggcgcactcgtggcctttaaggtcatgagtggcgaagtgccctccaccgaggacctggtcaacttgctccctgccatcctctctcccggtgccctggttgtcggggtcgtgtgcgcagcaatactgcgtcggcatgtgggcccgggggagggggctgtgcagtggatgaaccggctgatagcgttcgcttcgcggggtaaccatgtctcccccacgcactatgtgcccgagagcgatgctgcagcgcgtgtcacccagatcctctccagcctcaccattactcagctgttgaagaagctccaccagtggatcaatgaggactgctccacgccatgctccggctcgtggcttagggatgtttgggactggatatgcacggtgttgagtgacttcaagacctggctccagtccaagctcctgccgcggttgccgggagtccctttcctttcatgtcaacgtgggtacaagggagtctggcggggggatggcatcatgcaaaccacctgcccatgtggagcacaaatcgctggacatgtcaagaacggttccatgaagatcgtcgggcctaaaacctgcagcaacacgtggcatggaacattccccatcaacgcatacaccacgggcccctgcacaccctccccggcgccaaactacaccagggcgttgtggcgggtggctgctgaggagtacgtggaggtcacgcgggtgggggatttccactacgtgacgggcatgactactgacaacatcaaatgcccatgccaggttccggcccccgaattcttcacggagctggatggggtgcggctacacaggtacgctccggcgtgcaaacctctcctacgggaggaggttacattccaggtcgggctcaaccaatacccggttgggtcacagctcccatgtgagcccgaaccggatgtagtggtggtcacttccatgctcaccgacccctcccacattacagcagaaacggctaagcgtaggctggccagggggtctcccccctccttggccagttcttcagctagtcagttatctgctccttccttgaaggcgacatgcactacccgtcatgactccccagacgctgacctcattgaggccaacctcctgtggcggcaggagatgggcgggaacatcacccgcgtggagtcagagaacaaggtagtaattctagactcttttgacccgcttcgagcggaggaggacgagagggaggtatccgtcgcggcggagatcctgcggaaaaccaggaaattccccccggcgctacccatatgggcacgcccggactacaacccaccactgatagagccttggagggacccggactacgtccctccagtggtacacgggtgcccattgccacctaccaagacccctccaataccacctccacggaggaaaaagacggttgtcctgacagaatccaccgtgtcctctgccttggcggagcttgccacaaagaccttcggcaactccggatcgtcggccgacgacagcggcatagcgaccgcccctcctgatcagcccttcgacaacggagacacaggatccgacgctgggtcgtactcctccatgcccccccttgagggagagccgggggaccccgacctcagcgacgggtcttggtctaccgtgagcgaggaggctggtgaggacgtcgtctgctgctcgatgtcctacacatggacaggcgccttaatcacgccatgcgccgcggaggagagcaagctgcccatcaacgcgttgagcaactccttgctgcgtcaccataacatggtctacgccacaacatcccgcatcgcaagccagcggcagaggaaggtcacttttgacagactgcaagtcctggacgaccactaccgggacgtgctcaaggagatgaaggcgaaggcgtccacagttaaggctaaacttttatccgtagaagaagcctgcaagctgacgcccccacattcggccaaatccaaattcggctatggggcgaaggacgtccggaacctatccagcaaggccgttaaccacatccgctccgtgtggaaggacttgctggaagacactgaaacaccatttgacaccaccatcatggcaaaaaatgaggtcttttgtgttcagccagagaagggaggccgcaagccagctcgtcttatcgtattcccagacttgggggttcgtgtgtgcgagaaaatggccctttacgacgtggtctccactcttcctcaggccgtgatgggctcctcgtacggatttcagtactctcctgggcagcgggtcgagttcctggtgaatgcctggaaatcaaagaaaaaccctatgggtttcgcatatgacacccgctgctttgactcaacggtcactgagaatgacatccgtgttgaggagtcaatttaccaaagttgtgacttggcccccgaggccagacaggctataaggtcgctcacggagcggctttatatcgggggccccctgactaattcaaaagggcagcactgcggttaccgtcggtgccgcgccagcggcgtgctgacgactagctgcggtaatacccttacatgttacttgaaggcctctgcagcctgtcgagctgcgaagctccaggactgcacgatgctcgtgtgcggagacgaccttgtcgttatctgtgaaagtgcggggacccaggaggacgcggcgaacctacgagtcttcacggaggctatgactaggtactctgccccccccggggacccaccccaaccggaatacgacttggagttgataacatcatgctcctccaacgtgtcagtcgcgcacgacgcatctggcaaacgggtgtactatctcacccgtgaccccaccacccccattgcgcgggccgcgtgggagacagctagacacactccagtcaactcctggctaggcaacatcatcatgtatgcgcccaccctatgggcaaggatgattctgatgactcacttcttctccatcctgctagcccaggagcagcttgaaaaggccctagattgtcagatctacggggccacttactccattgaaccacttgacctacctcagatcattcagcgactccatggtcttagcgcgttttcactccatagctactctccaggtgagatcaatagggtggcttcatgcctcaggaaacttggggtaccgcccttgcgagtctggagacatcgggccaggagcgtccgcgctagactactgtcccagggggggagggccgccacttgtggcaagtacctcttcaactgggcagtaaagaccaagctcaaactcactccaattccggctgcgtcccagttggacttgtccggctggttcactgctgggtacggcgggggagacatatatcacagcctgtctcgtgcccgaccccgctggttcatgtggtgcctactcctactttctgtaggggtaggcatctatctgctccccaaccggtgaacggggagctaacccct

SEQ ID NO: 696 - DNA, 9379 bp, Hepatitis C Virus
ttgggggcgacactccaccatagatcactcccctgtgaggaactattgtcttcacgcagaaagcgtctagccatggcgttagtatgagtgtcgtgcaacctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggcaggacctgggcgcagcccgggtacccttggcccctctatggcaatgagggcatggggtgggcaggatggctcctgtcaccccgtggctcccggcctagttggggccccacggacccccggcgtaggtcgcgtaatttgggtaaggtcatcgataccctcacatgcggcttcgccgacctcatggggtatattccgctcgtcggcgcccccttggggggcgctgccagggccctagcacatggtgtccgggttctggaggacagcgtgaattatgcaacagggaatttgcccggttgctctttctctatcttcctcttggctctgctgtcttgtttgaccatcccagcctccgcttatgaagtgcgcaacgtgtccggggtataccatgtcacgaatgactgctccaactcaagcattgtgtatgaggcagcagacatgatcatgcatagccccggatgcgtgccctgcgttcgggagggcaactcctcccgttgctgggtagcgctcactcccacgctcgcggccaggaactctagcgtccccactacgacgattcggcgccacgtcgacttgctcgttggggcggctactttctgctccgctatgtacgtgggggatctttgcggatctgttttcctcgtctcccagctgttcaccttctctcctcgtcggcatcagacagtgcaggactgcaattgctcaatctatcccggccacgtatcaggtcaccgcatggcttgggatatgatgatgaactggtcgcccacagcagccctagtggtgtcgcagttgctccggatcccacaagccatcatggacatggtggcgggggcccactggggagtcctggcgggccttgcctactattccatggtggggaactgggctaaggttttgattgtgatgctactctttgccggcgttgacgggcaaactcgcgtgtcaggggggacggctgcttacaccacccgcgggttcacgtccctctttacacaggggccgtctcagaaaatccagcttgtgaacaccaatggcagttggcacatcaacaggactgccctgaactgcaatgactccctcaacactgggtttcttgccgcgctgttctacacacacaggctcaacgcgtccggatgcccagagcgcatggccagctgtcgctccattgacaagtttgaccaggggtggggtcccatcacttacactgagggtagcagcccggaccagaggccttattgctggcactacgcacctcgacagtgtggtattgtacccgcgtcgcaggtgtgtggtccagtgtactgcttcaccccaagccccgttgtggtggggacgaccgatcgctctggtgtccccacataccgctggggggagaatgagacggatgtgctgctcctcaacaacacgcggccaccgcaaggcaactggttcggttgtacatggatgaatagcactggattcaccaagacgtgcgggggccccccgtgtaatatcgggggggtcggcaacaacaccttgatctgccccacggactgcttccggaagcaccccgaggccacttacacaaaatgtggctcggggccttggctgacacctaggtgcttagttgactacccatacaggctctggcactacccctgcactgtcaacttcaccatcttcaaggttaggatgtatgtggggggcgtggagcacaggctcaatgccgcatgcaattggactcgaggagagcgctgtgacttggaggacagggataggtcagagctcagcccgctgctgctgtctacaacagagtggcagatactgccctgctccttcaccaccctaccggctctgtccaccggtttaatccatctccatcagaacatcgtggacgtgcaatacctgtacggtatagggtcggcggttgtctcctttgtaatcaaatgggaatatatcctgttgcttttcctcctcctggcggacgcacgcgtctgcgcctgcttgtggatgatgctgctgatagcccaggctgaggccgccttagagaacctggtggtcctcaatgcggcgtccttggccggagcgcatggcattctctccttccttgtgttcttttgtgccgcctggtatataaagggtaggctggtccccggggcggcatatgccctctatggcgtatggccgttgctcctgcttttgctggcgttaccaccacgggcttacgctatggaccgggagatggccgcatcgtgcggaggcgcggtttttgtgggtctggcattcttgaccttatcaccatactataaagtgttcctcgctaggctcatatggtggttgcaatattttatcaccagagccgaggcgctcttgcaagtgtgggtccctcccctcaacgttcggggaggccgcgatgccatcatcctcctcacgtgtgcggtccacccagagctgatctttgacatcactaaacttctgctcgccatattcggtccagttatggtgctccaggccggcttaattaaagtgccgtacttcgtgcgcgctcaagggctcattcgcgcatgcatgttagtgcggaaaattgccggaggccaatatgtccagatggccttcatgaagctggccgcaatgacaggtacgtacatttatgaccatctcaccccactgggagattgggcccatgcgggcctacgggacctcgcagtggcagtggaacctgtcgtcttctctgacatggagaccaagatcatcacctggggggcagacaccgcagcttgtggggacatcatcttgggcttgccagtctccgcccgaaggggaagggagatacttctgggaccagccgatagtcttgaggggcagggatggcgactccttgcgcccatcacggcctatgcccaacagacgcgaggcttacttggttgtatcatcactagcctcacaggccgggacaagaaccaggtcgagggggaggttcaagtggtttctaccgcaacgcaatctttcctggcgacctgcatcaatggcgtatgttggactgtcttccatggggccggctcgaagaccctagccggtccgaaaggtccaatcacccagatgtacaccaatgtagatcaggacctcgtcggctggctggcgccccctggggcgcggtccctgacaccgtgcacctgcggcagctcggacctttacttggtcacgagacatgctgatgtcattccggtgcgccggcgaggtgacagcagggggagcctactttcccccaggcctatttcctacttgaagggctcttctggcggcccactgctctgcccctcggggcatgtcgtgggcctctttcgagctgctgtgtgcacccggggggttgctaaggcagtggacttcatacccgttgaacacatggaaactactatgcggtccccggtctttacagacaactcatcccctccggccgtaccgcaggcattccaagtggcccatctacacgctcccactggcagcggtaagagcaccagagtgccagctgcatacgcagcccaagggtacaaggtactcgtcctcaatccgtccgttgccgccaccttaagttttggggcgtatatgtctaaggcatatggtgttgatcctaacatcaggactgggacaaggaccatcaccacgggcgcttccatcacgtactccacctatggcaagttccttgccgacggtggttgctccgggggcgcctatgacatcattatatgtgatgagtgccactcaactgactcgactaccatcttgggcatcggcacagtcctggatcaagcggagacggctggagcgcggctcgtcgtgctcgccaccgctacgcctccgggatcggtcaccgtgccacaccccagtatcgaggaggtagccctgtccaacactggagagattcccttctatgggaaagccatccccatcgaggtcatcaaggggggaaggcatctcatcttttgccattccaagaagaaatgtgacgagctcgccgcaaagctgtcatccctcggaatgaacgccgtagcgtattaccggggtcttgacgtgtccgttataccaactagcggagacgtcgttgtcgtggcaacagatgctctaatgacgggcttcaccggtgactttgactcagtgatcgactgtaatacatgtgtcacccagacagtcgacttcagcttggatcccaccttcaccattgatacgacgaccgtgccccaagacgcggtgtcgcgctcgcagcggcgaggtaggacgggcaggggtaggccaggcatctacaggtttgtgactccaggagaacggccttcgggcatgttcgactcctcggtcctgtgtgagtgctatgatgcgggctgtgcttggtacgagctcgcgcccgcggagaccacggttaggttgcgggcttacctaaacacaccagggttgcccgtctgccaggaccacctggagttctgggagggcgtcttcacaggcctcacccacatagatgcccacttcctgtcccagaccaagcaggcaggagacaacttcccctacctggtagcataccaagccacagtgtgcgccagggctcaggctctacctccatcatgggatcaaatgtggaagtgtctcataaggcttaagcctacgctgcacgggccgacacccctgctgtacaggctaggagctgtccaaaatgaggtcaccctcacacatcccataaccaaatacatcatgacatgcatgtcggctgacctggaggtcgtcaccagcacctgggtgttggtgggcggagtccttgcagctctggccgcatattgcctgacaacaggcagtgtggtcattgtgggtaggatcatcttgtccgggaggcctgctgttgttcccgaccgggaagttctctatcgggagttcgatgagatggaagagtgcgcctcacacctcccttacatcgaacagggaatgcagctcgccgagcaattcaaacagaaggcgctcgggctgctgcaagtggccaccaagcaagctgaggctgctgctcccgtggtggagtccaagtggcgagcccttgagaccttctgggcaaagcacatgtggaacttcatcagcggggtacagtacttagcaggcttatccactctacctgggaaccccgcgatagcatcactgatggcattcacagcttctatcactagcccgctcaccacccaaaataccctcctgtttaacatcttggggggatgggtagctgcccaactcgctccccccagcgctgcttcggcttttgtgggcgccggcattgtcggcgcggctgttggcagcgtgggcctcgggaaggtgcttgtggacatcttggcgggctatggggcgggggtggctggcgcactcgtggccttcaaggtcatgagcggcgagacgccctccaccgaggacttggttaatttactccctgccatcctctctcctggcgccttggtcgtcggggtcgtgtgcgcagcaatactgcgacggcacgtgggcccgggagagggggctgtgcagtggatgaaccggctgatagcgttcgcttcgcggggcaaccacgtctcccccacgcactacgtgcctgagagcgacgctgcagcgcgtgttacccaaatcctctccagccttaccatcacccagctgctgaagaggcttcaccagtggatcaatgaagactgctccacgccatgctccggttcgtggctaagggatgtctgggactggatatgcacggtgttgactgacttcaagacctggctccagtctaagctcctgccgcggttaccgggagtccccttcctctcatgccaacgtgggtacaagggagtctggcgcggggacggcgtcatgcaaaccacctgcccatgtggagcacagatcgccggacatgtcaaaaacggttccatgaggatcgttgggcctagaacctgcagcaacacgtggcatggaacattccccatcaacgcatacaccacgggcccctgcacaccttccccggcgccgaactattctaaggcgctgtggcgggtggctgctgaggagtacgtggaggttacgcgggtgggggatttccactacgtgacgggcatgaccgctgacaacgtaaagtgcccatgccaggttccggcccccgaatttttcaccgaattggacggagtgcgattgcacaggtacgctccggcgtgcaaacctctcctacgggaggaggtcgtgttccaggtcgggctcaaccaatacctggtcgggtcgcaactcccatgtgaacccgaaccggatgtggcagtgctcacttccatgctcaccgacccctcccacattacagcagagacggctaggcgtaggctggccagagggtcccctccctccttggccagctcttctgctagccagttgtctgcgccttccctgaaggcgacatgcactacccatcatgactccccggacgctgacctcatcgaggccaacctcctatggcgccaggagatgggcgggaacatcacccgtgtggagtcagagaataaggtagtaatcctggactcttttgacccgattcgagcggaggaggatgagagggaagtatccgtcccggcggagatcctgcggaaatccaggaagttccccgcagcaatgcccatatgggcacgcccggattacaaccctccactgctagagtcctggaaggacccggactacgtccctccggtggtacacgggtgtccattgccacctaccaaggcccctccattaccacctcaacggaggaagaggaccgttgtcctgtcagagtccactgtgtcttctgccctggcagagctcgctactaagaccttcggcagctccggatcgtcggccgtcgacagcggcacggcgaccgctcctcccgaccaggcttccgacgacgacgacaaagcatccgacgttgggtcgtactcctccatgcccccccttgagggagagccgggggaccccgatctcagcgacgggtcttggtctaccgtgagcgaggaggctggtgaggacgtcgtctgctgctcaatgtcctacacatggacaggcgccctgatcacaccatgcgctgcggaggaaagcaagctgcccatcaacgcgctgagcaactctttgctgcgtcaccataacatggtctattccacaacctcccgcagtgcaggcctgcggcagaagaaggtcacctttgacagactgcaagtcctggacgaccactaccgggacgtgctcaaggagatgaaggcgaaggcgtccaaagttaaggccaaactactatctatagaagaagcttgtaagctgacgcccccacattcggccaaatccaaatttggctatggggcaaaggacgtccggaacctatccagcaaggccgttaaccacattcgctccgtgtgggaggacttgctggaagacactgagacaccaattgacaccaccatcatggcgaaaaatgaggttttctgcgtcgaaccagaaaaaggaggccgtaagccagctcgccttatcgtattcccagacctgggagttcgtgtgtgcgagaagatggccctgtatgacgtggtctccacccttcctcaggccgtgatgggctcctcatacggattccagtactctcccggacagcgggtcgaattcctggtgaatgcctggaaatcaaagaaatgccctatgggcttctcatatgacacccgctgttttgactcaacggtcactgagagcgacatccgtactgaggagtcaatttaccaatgttgtgacttggcccccgaagccaggcaggccataaggtcgctcacagagcggctctatatcgggggccccctgaccaattcaaaggggcagaactgcggttatcgccggtgccgcgccagcggcgtgctgacgactagctgcggcaataccctcacatgttacttgaaggcctctgcggcctgtcgagctgcgaagctccaggactgcacgatgctcgtgaacggagacgaccttgtcgtcatctgtgaaagtgcgggaacccaagaggatgcggcgcgcctacgagtcttcacggaggctatgactaggtactctgctccccccggggacctgccccaaccagaatacgacttggagttgataacatcatgctcctccaatgtgtcggtcgcgcacgatgcatccggcaaaagggtgtactacctcacccgcaaccccacgacccccctcgcgcgggctgcgtgggaaacagctagacacactccagtcaactcctggctaggcaacatcatcatgtatgcgcccactttgtgggcgaggatgattctgatgactcacttcttctccatccttctagcacaggagcaacttgaaaaagccctagattgtcagatctacggggcctgttactccattgagccacttgatctacctctgatcattgagcgactccacggtcttagcgcattttcactccatagttactctccaggtgagatcaatagggtggcttcatgcctcaggaaacttggggtaccacccttgcgcgtctggagacatcgggccagaagtgtccgcgctaagctactgtcccagggggggagggctgccacttgtggcaagtacctcttcaactgggcagtaaggaccaagcttaaactcactccaaacccggctgcgtcccggttggacttgtccggctggttcgtagctggttacagcgggggagacatatatcacagcctgtctcgtgcccgaccccgctggttcatgttgtgcctactcctactttctgtaggggtaggcatctacctgctccccaaccggtgaacggggagctaaccact

SEQ ID NO: 697 - DNA, 9379 bp, Hepatitis C Virus
  misc_feature 6476: n = A,T,C or G
ttgggggcgacactccaccatagatcactcccctgtgaggaactactgtcttcacgcagaaagcgtctagccatggcgttagtatgagtgttgtgcagcctccaggtccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcatcatgagcacaaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccagcccgagggcagggcctgggctcagcccgggtacccttggcccctctatggcaatgagggcatggggtgggcaggatggctcctgtcaccccgcggctctcggcctagttggggccccacggacccccggcgtaggtcgcgtaatttgggtaaggtcatcgatacccttacatgcggcttcgccgacctcatggggtacatcccgctcgtcggcgcccccctaggaggcgctgccagggccctggcgcatggcgtccgggttctggaggacggcgtgaactatgcaacagggaatctgcccggttgctctttttctatcttcctcttggctctgctgtcctgtttgaccatcccagcttccgcttatgaagtgcgcaacgcgtccggggtataccatgtcacgaacgactgctctaacgcaagtattgtgtatgaggcagcggacatgatcatgcacacccccgggtgcgtaccctgcgtgcgggagagtaattcctcccgctgctgggtggcgctcactcccacgcttgcggccaggaacagcagcatccccactacgacaatacgacgccacgtcgatttgctcgttggggcagctgctttctgttccgctatgtacgtgggggatctctgcggatctgtcttccttgtttctcagctgttcaccttctcacctcgccggtatgagacggtgcaagactgcaattgctcaatctatcccggccacgtatcaggtcaccgcatggcttgggatatgatgatgaattggtcgcccacaacagccttagtggtgtcgcagttactccggatcccacaaaccgtcgtggatatggtggcgggggcccactggggagtcctggcgggccttgcctactattccatggtggggaactgggctaaggtcttgattgtgatgctactttttgctggcgttgatggaacaacctacacgtcagggggggtggcaggccgcactacccacaccttcacgtccctcttttcaacaggggcgcgccaaaacatccaacttgtaaactccaacggcagctggcacatcaacaggactgccctgaactgcaatgactccctccaaactgggttccttgccgcgctgttctacacacacaggttcaacgcgtccggatgcccagagcgtatggccagctgtcgtcccatcagcgagttcgctcaggggtggggccccatcacccatgtggaccctaacgtgtcggaccagaggccttattgctggcactacgcacctcgaccgtgtggtattatacccgcgtcgcaggtgtgcggtccagtgtattgcttcaccccaagccctgtcgtggtggggacgaccgaccgtttcggcgtccccacgtacaactggggggagaatgagacggacgtgctatacctcaacaacacgcggccgccgcaaggcaactggttcggctgtacatggatgaatagcaccgggttcaccaagacgtgcggggcccccccatgtaacatcgggggggtcggcaataacaccttgacctgccccacggattgcttccggaagcaccccgaggccacctacacaaaatgtggctcggggccttggttgacacctaggtgtatagttgattacccatacagactttggcactacccctgcactgtcaactttaccatcttcaagatcaggatgtatgtgggaggcgtggaacacaggctcaacgccgcgtgcaactggacccgaggagagcgttgtgacttggaggacagggacagatcagagctcagcccgctgctactgtctacaacagagtggcagatactgccctgttccttcaccaccctgccggctctgtccactggtctgatccacctccaccagaacattgtggacgtgcaatatctgtacggtgtagggtcagcggttgtctccattgtaatcagatgggagtatgtcgtgctgctcttcctcctcctggcggacgcgcgtgtctgcgcctgcttatggatgatgctgctgatagcccaggctgaggccgccttagaaaacctggtggtcctcaacgcggcgtccgtggccggagcgcatggcgttctctccttccttgtgttcttctgtgctgcctggtacatcaaaggcaggctggtccctggggcggcatatgctctctatggcgtatggccgctcctcctgctcctgctggcattaccaccacgagcatacgccatggaccgagagatggctgcatcgtgcggaggcgcggttttcacaggtctgatactcttgaccttgtcaccacactacaaagcgttcctcgctaggctcatatggtggttgcaatatttcatcaccagggccgaggctcagctgcaagtgtggatccctcctctcaacgttcgggggggccgcgatgccatcatcctcctcatgtgtgtggcccatccagagctaatttttgaaatcaccaaaatcttgctcgccatacttggtccgctcatggtgctccaggccggcctaactagagtgccatacttcgtgcgcgctcaagggctcatccgtgcatgcatgctggtgcggaaagtcgctgggggccattatgtccaaatggcactcgtgaggctggccgcactgacgggcacgtacgtttatgaccatctcaccccactgcgggactgggcccacgcgggcctgcgagaccttgcggcggcagttgagcccgtcgtcttctctgacatggagaccaagatcatcacctggggggcagacactgcggcgtgtggggacatcatctcgggtctacccgtctccgcccgaagggggaaggagatacttttgggaccggccgacaagttcggagagcaggggtggcgactccttgcacccatcacggcctacgcccagcagacgcggggcgtacttggctgcatcatcactagcctcacaggccgggacaagaaccaggtcgagggggaggttcaggtggtctccaccgcaactcaatctttcctagcgacctgcgtcaacggcgtgtgttggactgtctaccatggcgccggctcaaagacccttgccggcccaaagggcccaatcacccaaatgtacaccaatgtggaccaggacctcgtcggctggcaggcgccccctggggcgcgttccatgacaccatgcacctgcggcagctcggacctttacttggtcacgagacatgctgatgtcattccggtgcgccggcggggcgataccagggggagcctactttcccccaggcccatctcctacctgaagggctcctcgggtggtccactgctttgcccctcggggcacgttgtgggcatcttccgggccgctgtatgcacccggggggttgccaaggcggtggacttcgtacccgttgagtctatggaaactaccatgcggtctccggtcttcacggataactcctctcccccggccgtaccgcagacattccaagtggcccatctacatgcccccactggcagcggcaagagcactaaggtgccagctgcatatgcagcccaagggtacaaggtactcgtcttgaacccgtctgtcgccgccaccctgggttttggggcgtatatgtctaaggcacatggtgtcgaccccaacatcagaactggggtaaggaccatcaccacgggcgcttccatcacgtactccacctatggcaagttccttgccgacggtggttgctctgggggcgcctatgacatcataatatgcgatgagtgccactcaactgactcgacttccatcttgggcatcggcacagtcctggaccaagcggagacggctggagcgcggctcgtcgtgctcgccaccgctacgcctccgggatcggtcaccgtgccacaccccaatattgaggaggtggccttatccaacactggagaggttcccttctacggcaaagccatccccctcgagaacatcaaagggggaaggcacctcattttttgccattccaagaagaaatgtgatgagctcgccgcgaagctgtcggccctcggagttaatgctgtagcgtactaccgaggccttgatgtgtccgtcataccgacaagcggagacgtcgttgtcgtggcaacagacgctctaatgacgggctataccggcgactttgactcagtgatcgactgtaatacatgtgtcacccagacagtcgacttcagcttggaccccaccttcaccatcgagacgacgaccgtgccccaagacgcggtgtcgcgctcgcagcggcgtggcaggactggtaggggcagggggggcatatacaggtttgtgactccaggagaacggccctcgggcatgttcgattcttcggtcctgtgtgagtgctatgacgcgggctgtgcttggtatgaactcacgcccgccgagacctcggttaggttacgggcttacctgaatacaccagggttgcccgtctgccaggaccacctggagttctgggagagcgtcttcacaggcctcacccacatagatgcccactttctgtcccagactaagcaggcaggagacaacttcccctacctggtagcttaccaggctacagtgtgtgccagggcccaggccccgcctccatcgtgggatcaaatgtggaagtgtctcatacggctgaggcctacactgcacgggccaacgcccttgttgtacaggctaggagccgtccagaacgaggtcatcctcacacaccccataaccaaatacatcatggcatgcatgtcggctgacctagaggtcgtcacgagcacctgggtgctagtgggcggggtcctcgcagctctggccgcgtactgcctgacaacaggcagcgtggtcattgtgggcaggatcatcttgtctgggaggccggccgttgttcccgacagggaagttctctaccgggagttcgatgagatggaagagtgttcttcacaactcccttacatcgaacagggaatgcagctcgccgagcaattcaagcaaaaggcgctcgggttgttgcaaacagccaccaagcaagctgaggttgctgctcccgtggtggagtccaagtggcgagcccttgaagccttctgggcaaagcacatgtggaatttcatcagcgggatacagtacttagcaggcttgtccaccctgcctgggaaccctgcaatagcatcattaatggcattcacagcctccattaccagcccgctcaccacccaacatacccttttgtttaacatcttggggggatgggtggccgcccaacttgccccccccagcgccgcctcagcttttgtaggcgccggcatcgctggcgcggctgttggcagcataggccttgggaaggtgctcgtggacatcctagcgggttatggagcaggggtggcaggcgcgctcgtggcctttaaggtcatgagcggcgagatgccctccaccgaggacctggtcaacttgctccctgccatcctctctcctggtgccctcgttgtcggggtcgtgtgcgcagcaatactgcgtcggcacgtgggcccaggggagggggctgtgcagtggatgaaccggctgatagcgttcgcctcgcggggtaaccacgtctcccccacgcattatgtgcctgagagcgacgccgcagcgcgtgtcacccaaatcctctccagccttaccatcactcagctgttgaagaggctccaccagtggattaatgaggactgctccacgccatgctcaggctcgtggctcagggatgtttgggactggatatgcacggtgttgattgatttcaagacctggctccagaccaagctcctgccgcggctgccgggagtccctttcctttcatgtcaacgcgggtacaagggagtctggcggggagatggcgtcatgcaaaccacctgcccatgtggagcacaaatcgccggacatgtcaaaaacggttccatgaggatcgttgggccnaaaacctgcagcaacacgtggcatggaactttccccatcaacgcgtacaccacaggcccctgcacaccctccccggcgccaaactattccagggcgttatggcgggtggctgctgaggagtacgtggaggtcacgcgggtgggggatttccactacgtgacgggcatgaccgctgacaacataaagtgcccatgccaggttccggcccctgaattcttcacggagttggatggggtacggctgcacaggtacgctccggcgtgcaaacctctcctacgggaggaggtcacattccaggtcgggctccaccaatacccggttgggtcacagctcccatgcgagcccgaaccggatgtagcagtgctcacctccatgctcaccgacccctcccacatcacagcagagacggctaagcgtaggctggccagagggtctcctccctctttggccagctcttcagctagtcagttgtctgcgccctccttgaaggcgacttgcaccacccgtcatgactccccggacgctgacctcatcgaggctaacctcctgtggcggcaggagatgggagggaacatcacccgtgtggaatcagagaacaaggtggtaattctagactcttttgacccgctccgagcggaggaggacgagcgggaagtgtccgttgaggcggagatcctgcggaagaccaggaaattccccccagcgatgcccatatgggcacgcccggactacaacccaccactgatagagtcttggaaggacccggactacgcccctccggtggtacacgggtgcccattgccacctaccaaggcccctccaataccacctccacggaggaagaggacggttgtcctgacagaatccaccgtgtcttctgccttggcggagcttgctacaaagaccttcggcagctccaagtcgtcggccgtcgacagcggcacagcgaccgccccccccactcagccctccgacgaaggggatacaggatccgacgttgagtcgtactcctccatgcctccccttgagggagagccgggggaccccgatctcagcgacgggtcttggtctaccgtgagcggagaggccagtgaggatgtcgtttgctgctcgatgtcctacacatggacaggcgccttgatcacgccatgcgccgcggaggagagcaagctgcccatcaatgcgctgagcaactctttgttgcgtcaccacaacatggtctatgccacaacatcccgcagtgcatgccagcggcagaaaaaagtcacctttgacagactgcaagtcctggacgaccactaccgggacgtgctcaaggagatgaaggcgaaggcgtctacagttaaggctaggcttctatccgtggaagaagcctgcaagctgacgcccccacattcagccagatccaaatttggctatggggcgaaggacgtccggaacctatccagcaaggccgttaaccacatccactccgtgtggaaggacttgctggaagacaccgaaacaccaattgacaccaccgtcatggcaaagaatgaggtgatagatgttcaaccagagaagggaggccgcaagccagctcgccttatcgtattcccagacttgggggttcgtgtgtgcgagaagatggccctttacgacgtagtctccacccttcctcaggccgtgatgggctcctcatacgggttccaatactctcctgggcagcgggtcgagttcctggtcaatgcctggaaatcaaagaaaaaacctatgggctttgcatatgacacccgctgttttgactccacggtcaccgagaatgacatccgggttgaggagtcaatttaccagtgttgtgacttggcccccgaggctagacaggccataaggtcgctcacagagcggctttatgtcgggggccccctgactaattcaaaagggcagaactgcggctatcgccggtgccgcgccagtggcgtgctgacgaccagctgcggtaatacccttacatgctacctcaaggcctctgcagcctgtcgagctgcgaagctccaggactgcacgatgctcgtgtgcggagacgaccttgtcgttatctgtgaaagcgcgggaacccaggaggacgcggcgagcctacgagtcttcacggaggctatgactaggtattctgccccccccggggacccgcctcaaccggaatacgacttggagtcaataacatcatgctcctccaacgtgtcggtcgcgcacgatgcatccggcaaacgggtgtactacctcacccgtgaccccaccaccccccttgcgcgggctgcgtgggagacagccagacacactccagttaactcctggctaggcaacatcatcatgtatgcgcccaccttatgggcaaggatgattctgatgactcacttcttctccatccttctagctcaggagcaacttgaaaaagccctagattgtcaaatctacggggccacttactccattgaaccacttgacctacctcagatcattcagcgactccacggtcttagcgcattctcactccatagttactctccaggtgagatcaatagggtggcttcgtgcctcaggaaacttggggtaccgcccttgcgagtctggagacatcgggccagaagtgtccgcgctaagctactgtcccagggggggagggctgccacttgtggcagatacctcttcaactgggcagtaaggaccaagcttaaactcactccaatcccggctgcgtcccagttggacttgtccggctggttcgttgcgggttacagcgggggagacatatatcacagcctgtctcgtgcccgaccccgctggttcatgtggtgcctactcctactttctgtaggggtaggcatctacctgctccccaaccgatgaacggggagctaaccact

SEQ ID NO: 698 - DNA, 9379 bp, Hepatitis C Virus
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacttgttgccgcgcaggggccccaggttgggtgtgcgcgcgactaggaagacttccgagcggtcgcaacctcgtggaaggcgacaacctatccccaaggctcgccagcccgagggcagggcctgggctcagcccgggtacccttggcccctctatggcaacgagggcctggggtgggcaggatggctcctgtcaccccgcggctcccggcctagttggggccccaatgacccccggcgtaggtcgcgtaatttgggtaaggtcatcgataccctcacatgcggcttcgccgacctcatggggtacattccgcttgtcggcgcccccctagggggcgctgccagggccttggcacatggtgtccgggttctggaggacagcgtgaactatgcaacagggaatttgcccggttgctctttttctatcttcctcttggctttgctatcctgtttgaccatcccagcttccgcttatgaagtgcgcaacgtgtccggggtataccatgtcacgaacgactgctccaactcaagcattgtgttcgaagcagcggacttgatcatgcatctccccgggtgcgtgccctgcgttcgggagaacggctcttcccgttgctgggtagcgctcactcccacgctcgcggccaggaacaccagcatccccaccacggcaatacgacgtcacgtcgatttgctcgttggggcggctaccttctgctccgctatgtacgtgggggacctctgcggatctgttttcctcgtctctcagctgttcaccttctcgcctcgccggcatcagacgttacaggactgcaattgctcaatctatcccggccatgtgacaggtcaccgcatggcttgggacatgatgatgaactggtcgcctacaacagccctagtggtgtcgcagttactccggatcccacaagccgtcttggacatggtggcgggggcccactggggagtcctggcgggccttgcctactattccatggtggggaactgggctaaggttttgattgtgatgctactttttgccggcgttgacggggtcacctacacgacagggggatcgctaggccgcaccaccctaggtttcacatccttcttttcagtcgggccgtctcagaaactccagcttataaacaccaatggcagttggcacatcaacaggactgccctgaactgcaatgactcctaccacactgggtttcttgccgcgctgttctatgcacgcagtctcaacatgtccggatgcggagagcgcatgtccagctgccgctctattgacaagttcgaccagggatggggtcctatcacttatgctgagcctgccgacctggaccagaggccttattgctggcactacccacctcgacaatgtggtaccatacccgcatcgcaggtgtgtggtccagtgtactgcttcaccccaagccctgttgtcgtggggacaaccgatcgcttcggcgcccctacgtatacctggggggcgaacgagactgacgtgctgctccttaacaacacgcggccgccgcaaggcaattggttcggctgtacatggatgaataccactgggttcaccaagacgtgcggggggcccccgtgcaacatcgggggggttggcaacaacaccttgatctgccccacggactgcttccgaaagcaccccgaggccacttacacaaaatgtggctcggggccttggttgacacctaggtgcttggttgactacccatacaggctctggcactacccctgcactgtcaactttaccatctttaaggttaggatgtatgtggggggcgtcgagcacaggctcaatgctgcatgcaattggactcgaggagagcgctgtaacttggaggacagggatagatcggagctcagcccgctgctgctgtctacaacagagtggcaggtattgccctgttccttcaccaccctaccggctctgtccactggcctgatccatcttcaccagaatattgtggacgtgcaatacctgtacggtatagggtcagcggttgtctcctttgcaatcaaatgggagtacgtcctgttgcttttccttctcctggcggacgcacgcatctgtgcctgcttgtggatgatgctgctgatagcccaggccgaggccgccttggagaacctggtggtcctcaacgcggcgtccgtggccggatcgcatggcatcctctccttccttgtgttcttctgtgccgcttggtacatcaagggcaggctggtccctggagcggcatatgcactctatggcgtatggccgctgctcctgctcctgctggcgttaccaccacgagcttacgccatggaccgggagatggctgcatcgtgcggaggcgcggtcttcgtgggtttggcacttctgactttgtcaccatactacaaagtgttcctcgccaggctcatatggtggttgcagtatttaatcaccagagcggaggcgcacctgcatgtgtgggtcccccccctcaacgttcggggaggccgcgatgccatcatcctcctcacgtgtgcggtccacccagagctaatctttgacatcaccaaactcctgcttgctatattcggcccgctcatggtgctccaagccggcataactagaatgccgtacttcgtacgcgctcaagggctcattcgtgcatgcatgttggtgcggaaagttgccgggggtcattatgtccaaatggccttcatgaagctgggtgcattgacgggcacgtacatctatgaccatctcaccccactgcgggattgggcccacgcgggcctacgagaccttgcggtggcggtggagcccgtcgtcttttctgacatggagaccaagatcattacctggggggcagacaccgcggcgtgtggggacatcatctcgggtctacctgtctccgcccgaaggggaaaggagatactcctgggaccggccgatagtcttgaggggcgggggtggcgactccttgcgcccatcacggcctactcccaacagacgcggggcctgcttggttgcatcatcactagcctcacaggccgggacaagaaccaggtcgagggggaggttcaagtggtttccaccgcaacgcaatctttcctggcgacctgtgtcaacggcgtgtgttggactgtcttccatggtgctggctcgaagaccctagccggcccaaaaggtccaatcacccagatgtatactaatgtggaccaggacctcgtcggctggccggcgcctcccggggcgcgttctctgacaccatgcacctgtggcagctcggacctttacttggtcacgagacacgctgacgtcatcccggtgcgccgacggggcgatagtagggggagcctactctcccccaggcctgtctcctacttgaagggctcttcgggtggcccactgctttgcccttcggggcacgctgtgggcatcttccgggccgctgtatgcacccgaggggttgcgaaggcagtggactttgtgcccgttgagtccatggaaactactatgcggtctccggttttcacagacaactcatcccctccggccgtaccgcagtcattccaagtggcccatctacacgctcccactggcagcggcaagagtaccaaggtaccggctgcgtatgcagcccaagggtacaaggtgctcgtcctgaatccgtccgttgcagccaccttagggtttggggcgtatatgtctaaggcacatggtactgaccctaacatcagaactgggataagaaccatcaccacaggcgcccccatcacgtactccacctatggcaagttccttgccgacggcggatgctctgggggcgcttatgacatcataatgtgtgatgagtgccattcaactgactcgactaccatcttgggcatcggcacagtcctggaccaagcggagacggctggagcgcggctcgtcgtgctcgccaccgctacgcctccgggatcggtcaccgtgccacacccgaacatcgaggaggtggccctgtctaacactggagagatccccttctatggcaaagccatccccatcgaggccatcaaggggggaaggcatctcattttctgtcattccaaaaaaaagtgcgacgagctcgccgcaaagctgtcaaacctcggagttaacgccgtagcgtattaccggggtcttgacgtgtccgtcataccgaccagcggagacgttgttgtcgtggcaacagacgctctaatgacgggctacaccggtgattttgactcagtgatcgactgtaacacatgtgtcacccagacagtcgacttcagcttggatcccaccttcaccattgagacgacgaccgtaccccaagacgcggtgtcgcgttcgcagcggcgaggtaggactggcaggggtaggaggggcatctacaggtttgtgactccgggagaacggccctcgggcatgttcgattcctcggtcctgtgcgagtgctatgacgcgggctgtgcttggtatgagctcacccccgctgagacctcggttaggttgcgggcttacctaaatacaccagggctgcccgtttgccaggaccatctggagttctgggagagcgtcttcacaggcctcacccacatagacgcccacttcttgtcccagactaagcaggcaggagacaacttcccctacctggtggcataccaagccacggtgtgcgccagggctcaggccccacctccatcgtgggatcaaatgtggaagtgcctcatacggctaaagccaacgctgcacgggccaacgcccctgctgtacaggctgggagccgtccaaaatgaggtcaccctcacacaccccataaccaaatacatcatggcatgcatgtcggccgacctggaggtcgtcactagcacctgggtgctggtaggcggagtccttgcagctttggccgcatattgcttgacaacaggcagtgtggtcattgtgggtaggatcatcttgtccgggaggccggctgttattcctgacagggaagttctctaccaggagtttgatgaaatggaagagtgcgcctcgcacctcccttacatcgaacagggaatgcagctcgccgagcaattcaagcagaaggcaatcgggttgctacaagtggccaccaaacaagcggaggctgccgctcccgtggtggagtctaagtggcgaacccttgaggccttctgggcgaagcacatgtggaacttcatcagcgggatacagtacctagcgggcttatccaccctgcctgggaatcccgcgatagcatcattgatggcattcacagcctctatcaccagcccgctcaccacccaaagtaccctcctgttcaacatcttggggggatgggtagctgcccaactcgctcctcccagtgctgcttcggctttcgtgggcgctggtatcgccggtgcggctgttggcagcataggccttgggaaggtgcttgtggacattctggcgggctatggagcgggggtggctggcgcgctcgtggcctttaagatcatgagcggcgaggcgccctccaccgaggacctgattaatttactccctgccatcctctctcccggcgccctggtcgtcggggtcgtatgcgcagcaatactgcgtcggcacgtgggcccgggagagggggctgtgcagtggatgaaccggctgatagcgttcgcttcgcggggtaatcacgtctcccccacgcactatgtgcctgagagcgacgctgcagtgcgtgttactcagatcctctctagccttaccatcactcagctgctgaagaggctccaccagtggattaatgaagactgctccacgccgtgctccggctcgtggctaagggatgtttgggattggatatgcacagtattgactgacttcaagacctggctccagtccaagctcctgccgcggttgccgggagtcccttttttctcatgccaacgtgggtacaagggagtctggcggggggacggcatcatgcaaaccacctgtccatgtggagcacagattaccggacatgtcaaaaacggttccatgaggatcgttgggccaaaaacctgcagcaacacgtggcatggaacattccccatcaacgcatacaccacgggcccctccacaccctccccggcgcctaactattccagggcgctgtggcgggtggctgctgaggagtatgtggaggttacgcgggtgggggatttccactacataacgggcatgaccactgacaacgtaaagtgcccttgccaggttccggctcctgaattcttcacggaggtggatggagtacggttgcacaggtacgctccggcgtgcagacctctcctacgggaggaggtcgttttccaggtcgggctcaaccaatacctggttgggtcacagctcccatgcgagcccgaaccggacgtcgcagtgcttgcttccatgctcaccgacccctcccacatcacagcagagacggctaagcgcaggttggccagggggtctcccccctccttggccagctcttcagctagccagttgtctgcgccttccttgaaggcgacatgcactacccatcacgactccccggacgccgacctcatcgaggccaacctcctgtggcggcaggagatggggggaaacatcacccgcgtggagtcagagaacaaagtagtaattctggactctttcgacccgcttcgagcggaggaagacgagagggaagtatccgttgcggcggagatcctgcggaaatccaggaagttccccgcagcgatgcccgtatgggcacggccggattacaaccctccactgttagagtcctggaaggacccggactacgtccctccggtggtgcacgggtgcccattgccacctaccaaggcccccccaataccacctccacggaaaaagaggacggttgtcctgacagagtccaccgtgtcttctgccttggcggagctcgccactaagacctttggcggctccgaatcgtcggccgttgacagcggcacggcgaccgcccctcctgaccaggcctccgacgacgatgacaaaggatccgacgttgagtcgtactcctccatgcccccccttgagggggagccgggggaccccgatctcagtgacgggtcttggtctaccgtgagcgaggaggccagtgaggacgtcgtctgctgctcaatgtcctacacgtggacaggtgccctgatcacgccatgcgctgcggaggaaagcaagctgcccatcaacgcgttgagcaactctttgctgcgccaccataacatggtctatgccacaacatcccgcagcgcaagcctgcggcagaagaaggtcacctttgacagactgcaagtcctggacgaccactaccgggacgtgcttaaggagatgaaggcgaaggcgtccacagttaaggctaagcttctatctgtagaagaagcctgcaagctgacgcccccacactcggccaaatccaaatttggctatggggcaaaggacgtccggaacctatccagcagggccgttaaccacatccactccgtgtggaaggacttgttggaagacagtgtgacacctattagcactaccatcatggcaaaaaatgaggttttctgcatccaaccagagaaaggaggtcgcaagccagcccgccttatcgtattcccagatctgggagttcgtgtatgcgagaagatggctctttacgatgtggtctccacccttcctcaggccgtgatgggctcctcatacggattccagtactctcccaagcagcgggtcgagttcctggtcaatacctggaaatcaaagaaaaaccccatgggcttttcatatgacacccgctgttttgactcaacggtcactgagaacgacatccgtgttgaggagtcaatttaccaaagttgtgacttggcccccgaagccagacaggctataaaatcgctcacagagcggctttatatcgggggtcccctgactaattcaaaagggcagaactgtggctatcgccggtgccgcgcgagcggcgtgctgacgaccagctgcggtaataccctcacatgttacttgaaagcctctgcggcctgtcgagctgcgaagctccaggactgcacgatgctcgtgaacggggacgaccttgtcgttatctgtgaaagtgcgggaacccaggaggatgcggcgagcctacgagtcttcacggaggctatgactaggtactctgccccccccggggacccgcctcaaccagaatacgacttggagctgataacatcatgctcctccaatgtgtcggtcgcgcacgatgcatctggcaagagggtgtactacctcacccgtgaccccaccacccccctcgcgcgggctgcgtgggagacagctagacacactccagttaactcctggctaggcaacatcatcatgtatgcgcctaccttatgggcgaggatgattctgatgacccatttcttctccatcctcctagcccaggagcaacttgaaaaagccctggattgccagatctacggggcttattactccattgagccacttgacctacctcagatcattgaacgactccatggtcttagcgcattttcactccatagttactctccaggtgagatcaatagggtggcttcctgcctcagaaaacttggggtaccacccttgcgggtctggagacatcgggccaggagcgtccgcgctaagctactgtcccagggggggagggccgccacttgtggcaaatacctcttcaactgggcagtaaagaccaagctcaaactcactccaatcccggctgcgtcccggctggacttgtccggctggttcgtcgccggctacagcgggggagacatatatcacagcctgtctcgtgcccgaccccgctggttcatgttgtgcctactcctactttccgtaggggtaggcatctacctgctccccaaccgatgaacggggagctaaccact

SEQ ID NO: 699 - DNA, 9373 bp, Hepatitis C Virus
ttgggggcgacattccaccatagatcattcccctgtgaggaactactgtcttcacgcagaaagcgtctagccatggcgttagtatgagtgtcgtgcagcttccaggaccccccctcccgggagagccatagtggtctgcggaaccggtgagtacaccggaattgccaggacgaccgggtcctttcttggatcaacccgctcaatgcctggagatttgggcgtgcccccgcgagaccgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccagcccgagggcagggcctgggctcagcccgggtacccttggcccctctatggcaatgagggcatggggtgggcaggatggctcctgtcaccccgcggctcccggcctaattggggccccacagacccccggcgtaggtcgcgtaatctgggtaaggtcatcgataccctcacatgcggcttcgccgacctcatggggtacattccgctcgtcggcgcccccctaggaggcgctgccagggccctagcgcatggcgtccgggtcctggaggacggcgtgaactatgcaacagggaacttgcccggttgctctttctctatcttcctcttggctctgctgtcctgtttgaccatcccagcctccgcttatgaggtgcgcaacgtgtccggggtgtaccatgtcacgaacgactgctccaactcaagcatcgtgtatgaggcagcggacatgatcatgcattcccccgggtgtgtgccctgcgttcgggagggcaatgtctcccgctgctgggtagcgctcactcccacgctcgcggccaggaacggcagcgtccccactacgacaatacggcgccacgtcgacttgctcgttggggcggctgctttctgttccgctatgtacgtgggagatctctgcgggtctgttttccttgtctcccagctgttcactttctcacctcgccggcatgagacggtacaggactgcaactgttcaatctatcccggccacctatcaggtcatcgcatggcctgggatatgatgatgaactggtcacctacagcagccctagtggtatcgcagttgctccggatcccacaagctgtcatggatatggtggcgggggcccactggggagtcctggcgggccttgcctactattccatggtggggaactgggctaaggttctgattgtgatgctactctttgccggcgttgacgggtggctcatagggagctcgcaaggcgacaccacccgccgctttacgtccctcttttcacctgggccgtctcagaacatccagcttgtaaaaacggaaggcaactggcacattaacaggactgccctgaactgcaatgactcccaccagactggattccttgccgcgctgttctacgcacataagatcaacacgtccggatgcctagagcgcttgaccagctgccaccccattgacaagttcgatcaggggtggggtcccctcacttacgtcgagcatgagggctcggaccagaagccctattgctggcactacgcacctcgaccgtgcggtattgtacccgcgtcgaaggtgtgtggtccagtgtattgcttcaccccaagccctgttgtggtggggacgaccgatcgcttcggcgcccccacgtacacctggggggaaaacgagacggacgtgctgctccttaacaacacgcggccgccgcaaggcaactggttcggctgtacatggatgaatagctctgggtacaccaagacgtgcgggggccctccgtgtaacatcgggggggtcggcaacgacaccctgatttgccccacggactgcttccggaagcaccccgaggccacctacacaaaatgtggctcgggaccttggttgacgccccggtgcatggttgactacccatacaggctttggcactacccctgcactgtcaactttaccgtcttcaaggttaggatgtatgtggggggcgtggagcatagactcagcgctgcatgcaattggacccgaggggagcgttgcaatttggaggacagggacagatcagagctcagcccgctgctgctgtctacaacggagtggcagatactgccctgttccttcaccaccctaccggctctgtccactggtttgatccatctccatcagaacattgtggacgtgcaatacctgtacggtgtagggtcagcggttgtctccttcgtaatcaaatgggagtacgtcctgctgcttttccttctcctggcggacgcccgcatctgtgcctgtttgtggatgatgctgctgataccccaggctgaggcccccctagagaacctggtggtcctcaatgcagcgtccgtggccggggcgcatggtatcctctcctttcttgtgttcttctgcgctgcctggtacatcaagggcaagctggtccctggggcggcatacgctctctatggcgtatggccgctgctcctgctcctgctggcgctaccgccacgagcgtacgccatggaccgggagatggctgcatcgtgcggaggcgcggtttttgtgggtctggtgctcttgaccttgtcaccatactacaaagtgttcctcgctaggctcatatggtggtcacaatattttatcaccagagccgaggcgcatttgcaagtatgggtccccccccttaacgttcgggggggccgcgatgccatcatcctcctcacatgtgcggtccacccagagctaatctttgacatcaccaaaatcttgctcgccatacttggtccactcatggtgctccaggctagcataattaaagtgccgtacttcgtacgcgcccaagggctcattcgtgcatgcatgttggcgcggaaagtcgctgggggtcattatgtccaaatggctttcatgaagctggccgcgctgacaggtacgtacgtctacgaccatctcactccactgcaggactgggcccatgcgagcctacgagaccttgcggtggcagttgagcctgtcgtcttctctgacatggagaccaagatcatcacctggggggcagacaccgcggcgtgtggggatatcatcttgggcctacccgtctccgcccgaagggggaaggagatactcctgggaccggccgatagtcttgaagggcaggggtggcgactccttgcgcccatcacggcctactctcaacagacgcggggcctgcttggttgcatcattactagcctcacgggccgggacaagaaccaggtcgagggggaggttcaggtggtttctaccgcaacgcaatctttcctggcgacctgtgtcaacggcgtgtgctggactgttttccacggcgccggctcaaagaccctagccggcccgaagggtccaatcacccaaatgtacaccaatgtagaccaagacctcgtcggctggcaggcgccccccggggcgcgttccttgacaccgtgcacctgcggcagctcggacctttacttggtcacgagacatgctgacgtcatcccagtgcgccggcggggtgacagcagggggagtctactctcccccaggcccgtctcctacttgaagggctcttcgggcggtccactgctctgtccctcggggcacgccgtgggcatcttccgggctgctgtgtgcacccggggggttgcgaaggcggtggactttgtgcctgttgagtctatggaaactactatgcggtctccggtcttcacggacaactcgtcccccccggccgtaccgcagacattccaggtggcccacctacacgctcccactggcagcggcaagagcactaaggtgccggctgcgtatgcagcccaagggtacaaagtactcgtcctgaatccgtccgttgccgccaccttgggctttggggcgtatatgtccaaggcacatggtgtcgaccctaacatcagaactggggcaaggaccgtcaccacgggcgctcccatcacgtactccacctatggcaagttcctcgccgacggtggttgttctgggggcgcctatgacatcataatgtgtgatgagtgccactcaactgactcgacttccatcttgggcatcggcacagtcctggaccaagcggagacggctggagcgcggctcgtcgtgctcgccaccgctacgcctccgggatcggtgaccgtgccacaccccaatatcgaggaggtagccctatccaacactggagagatccccttctatggcaaagccatccccattgagaccatcaagggggggagacatctcatcttctgccattccaagaagaaatgtgacgagctcgccacaaagctgtcaggcctcggaatcaatgctgtagcgtattaccggggtctcgatgtgtccgtcataccggccagcgggaacgtcgttgtcgtggcaacggacgctctaatgaccggctatactggcgactttgactcggtgatcgactgtaatacatgtgtcacccagacagtcgacttcagcttggaccctaccttcaccattgagacgacgaccgtgccccaagacgcggtgtcgcgctcgcagcggcgaggtaggactggtaggggcaggagaggcatctacagattcgtgactccgggagaacggccctcgggcatgttcgattcctcggtcctgtgtgagtgctatgacgcgggctgtgcttggtatgagctcacgcccgccgagacctcggttaggttgcgggcctacctaaatacaccagggttgcccgtctgccaggaccacctggagttctgggagagcgtcttcacaggcctcacccacatagacgcccacttcttgtcccagactaaacaagcaggagataacttcccctacctggtggcataccaagctacagtgtgcgccagggctcaggctccacccccatcgtgggatcaaatgtggaagtgcctcatacggctaaagcctacgctacacgggccaacgcccctgctgtataggctaggagccgtccaaaatgaggtcaccctcacacaccccataaccaaatacatcatggcatgcatgtcggctgacctggaggtcgtcacgagcacctgggtgctagtaggtggggtccttgcagctctggccgcgtattgcctgacaacaggcagcgtggtcattgtgggcagaatcatcttgtccgggaagccggctgttattcccgacagggaagttctctatcgggagttcgatgagatggaagagtgcgcatcgcacctcccctacatcgagcaggggatgcagctcgccgagcaattcaagcagaaggcgctcgggttgctgcaaacagccaccaagcaagcggaggttgccgctcccgtggtggagtccaagtggcgagcccttgaggccttttgggcgaagcacatgtggaacttcatcagcgggatacagtacttagcaggcttgtccaccctacctggaaaccccgcaatagcatcactgatggcattcacagcctccatcaccagcccgctcaccacccaaagtaccctcctgtttaacatcttgggaggatgggtggccgcccaactcgctccccccagcgctgcttcggctttcgtaggcgccggcatcgctggcgccgctgttggcagcataggccttgggaaggtgcttgtggacattctggcgggctatggggcaggggtggcgggcgcactcgtggcctttaaggtcatgagtggcgagatgccctccactgaggacctggttaacttactccctgccatcctctctcctggcgccctggtcgtcggggttgtgtgcgcagcaatactgcgccggcatgtgggcccaggagagggggctgtgcagtggatgaaccggctgatagcattcgcttcgcggggtaaccacgtctcccccacgcactatgtgcctgagagcgacgctgcggcgcgcgtcacccaaatcctctccagccttaccatcactcagttgttgaagaggctccatcagtggatcaatgaggactgctccacgccatgctccggctcgtggctaagggatgtttgggactggatatgcacggtgttgactgacttcaagacctggctccagtccaagctcctgccacggttaccgggagtccctttcttctcatgccaacgcgggtacaagggagtctggcggggggacggcatcatgcagaccacctgcccatgtggtgcgcaaattaccggacatgtcaagaacggttccatgaggatcattgggcctaagacctgcagcaacacgtggcatggaacattccccatcaacgcatacaccacgggcccctgcacaccctccccggcgccaaactattccagggcgctatggcgggtggctgctgaggagtacgtggaggttacgcgggtgggggatttccactacgtgacgggcatgaccactgacaacgtaaagtgcccatgccaggttccggcccccgaattcttcacggaagtggatggggtgcggctgcacagatacgctccggcgtgcaaacctctcctacgggaggaggtcacattccaggtcgggctcaaccaatatctggttgggtcacagctcccttgtgagcccgagccggatgtagcagtgctcacctccatgctcaccgacccctcccatattacagcagaggcggctaagcgtaggctggccagggggtctcccccctccttggccagctcttcagctagccagttgtctgcgccctctttgaaggcgacatgcactacccatcatgactccccggacgctgacctcatcgaggccaacctcctgtggcggcaggagatgggcggaaacatcacccgcgtggagtcagagaataaggtagtaattctggactctttcgacccgctccgagcggaggaggatgagagggaggtgtccgttccggcggagatcctgcggaaatccaggaagtttcccccggcgatgcccatatgggcacgcccggattacaaccctccactgctagagtcctggaaggacccggactacgtccctccggtggtacacgggtgcccattgccacctaccaaggcccctccaataccacctccacggagaaagaggacggttgtcctgacagagtccaccgtgtcttcagccttggcagagctcgctacaaagactttcgacagctccggatcgtcggccgttgacagcggcacggcgaccgcccctcctgaccagccctccgacaacagtgacgcaggatccgacgttgagtcgtattcctccatgcccccccttgagggggagccgggggatcccgatctcagcgacgggtcttggtctaccgtgagtgaggaggctagtgaggacgtcgtctgctgctcgatgtcatacacatggacaggcgccctgatcacgccgtgcgctgcggagggaagcaagctgcccatcaatgcgttgagcaactctttgctgcgtcaccacaacatggtctatgccacaacatcccgcagcgcgagccaacggcagaagaaggtcacctttgacagactgcaagtcctggacgaccactaccgggacgtgctcaaggagatgaaggcgaaggcgtccacagttaaggctaagcttctatccgtagaggaagcctgcaagctgacgcccccacattcggccagatctaaatttggctatggggcaaaggacgtccggaacctatccggcaaggccgtcaaccacatccgctccgtgtggaaggacttgctggaagacactgagacaccaattgacaccaccatcatggcaaaaaatgagattttctgcgtccaaccagagaaaggaggccgcaagccagctcgccttatcgtgttcccagacttgggggttcgtgtgtgcgagaaaatggccctctacgatgtggtctccacccttcctcaggccgtgatgggctcctcatacggattccagtactctcctggacagcgggttgagttcctggtggatgcctggaaatcaaagaagtgtcctatgggcttcgcatatgacacccgctgttttgactcaacggtcaccgagagtgacatccgtgtcgaggagtcaatctaccaatgttgtgacttggcccccgaagccagacaggccataaggtcgctcacagaacggctttatgtcgggggtcccttgactaattcaaaagggcagaactgcggttatcgccggtgccgcgcgagcggcgtgctgacgaccagctgcggcaacaccctcacatgttacttgaaagcctctgcggcctgtcgagctgcgaagctccgggactgcacgatgctcgtgtgcggagacgacctcgtcgttatctgtgaaagcgcggggacccaagaggatgcggcgagcctacgagtcttcacggaggctatgactaggtactctgccccccctggggacccgcctcaaccggaatacgacttggagttgataacatcatgctcctccaacgtgtcagtcgcacacgatgcatctggcaaaagggtgtactatctcacccgtgaccccactaccccccttgcgcgggctgcgtgggagacagctagaagcactccagtcaactcctggctaggcaacatcatcatgtatgcgcccaccttatgggcaaggatgattctgatgactcacttcttctccatccttctagcccaggagcagcttgaaaaagccctagattgtcagatctacggggcctgttactccattgagccacttgacctacctcagatcattcagcgactccatggtcttagcgcattttcactccatagttactctccaggtgagatcaatagggtggcttcatgcctcagaaaacttggggtaccacccttgcgagtctggagacatcgggccagaagtgtccgcgctaagctactgtcccagggggggagggccgccacttgtggcaagtacctcttcaactgggcagtgaggaccaagcttaaactcactccaatcccagctgcgtcccagctggatttgtccaactggttcgttgctggttacagcgggggagacatatatcacagcctgtctcgtgcccgaccccgctggttcatgttgtgcctactcctgctttctgtgggggtaggcatctacctgctccccaaccggtgaacggggagctaaccact

SEQ ID NO: 700 - DNA, 9416 bp, Hepatitis C Virus
  misc_feature 2772: n = A,T,C or G
atcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacactaaccgtcgcccacaaaacgttaagtttccgggcggcggccagatcgttggcggagtatacttgttgccgcgcaggggccccaggttgggtgtgcgcgcgacaaggaagacttcggagcggtcccagccacgtgggaggcgccagcccatccctaaagatcggcgctccactggcaagtcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccccgtcgtaggcgccccgcttggtggcgtcgccagagctctcgcgcacggcgtgagagtcctggaggacggggttaattttgcaacagggaacttacctggttgctccttttctattttcttgctggccctactgtcctgcatcaccattccggtctctgctgtccaagtgaagaacaccagtaacagctatatggtgactaatgattgttccaacgacagcattacctggcaggttcaggacgcggtcctccacgtccccgggtgcgtcccgtgcgagaaagtggaaaatacatcacggtgctggataccggtctcaccaaacgtggctgtgcggcagcgcggcgccctcacgcaaaacttgcggacgcacatcgatatggttgtgatgtccgccacgctctgttccgcactctacgtgggggatctctgcggcggggtgatgctcgcagcccaaatgttcattgtctcgccggagcgccactggtttgtgcaagaatgcaattgctccatctaccctggcaccatcactggacaccgtatggcatgggatatgatgatgaactggtcgcccacgaccaccatgatcttggcgtacgcgatgcgcattcccgaggtcatcatagacatcatgagcggggctcactggggcgtcatgttcggcctagcctacttctccatgcagggagcgtgggcgaaggtcgttgtcatccttctgctgaccgctggggtggacgcggaaacccaaacagttgggggtgcaaccgggcgcagtgtcttgggcttcaccagcctcttcacgcgtggccctcaacagcagattcagctcatcaacaccaatggcagttggcacatcaaccgcactgccctgaattgcaatgactccttgaacaccggctttatcgcgtccctgttctactacaacaactttaactcgtcagggtgtccccaacgcatggccgcctgtcgcaccatcgaggcctttcggataggatggggcaccttgcaatacgaggataatgtcaccaacccagaagatatgagaccatactgctggcactacccaccaaaacaatgtggcatagtccccgcgaggtcagtgtgcggcccggtgtactgtttcactcccagcccagtggtagtgggcacgacagataaacttggagtgcccacttacacgtggggcgagaatgagacagatgtcttcctattgaacagcacccgaccaccgcgggggtcatggttcggctgcacgtggatgaactccactggcttcaccaagacttgtggcgcaccaccttgccgcactagagctgacttcaacgccagcacggacctgttgtgccccacggactgttttaggaagcatcctgaagccacttacatcaaatgcggttctgggccctggctcacgccaaggtgcctggttgactacccctacaggctctggcattacccctgcacgattaactacaccgtcttcaaggtgaggatgtatgtggggggggttgagcacaggctcacggccgcgtgcaatttcactcgtggggatcgttgcgacttggaggacagggacagaagtcaacagactcctttgttgcactccaccacggaatgggccatcttgccctgctcctactcagaattgcccgctttgtcgactggtcttctccacctccaccaaaatatcgtggacgtacaatacatgtatggcctgtcacctgcccttacaaaatatgtcgttcggtgggagtgggtagtactcttgttcctgctcctagcggacgccagggtctgcgcctgtgtatggatgctcattttgctgggccaggccgaagcagcgctagagaagctggtcgtcttgcatgctgcgagcgcggctagctgcaatggcttcctgtattttgtcatcttttttgtggctgcttggtacatcaagggtcgggcggtccccttggccgcctattccctcactggcctatggcccttctgcctactggtcctagcactgccccaacaggcttatgcttatgatgcatctgtgcacggacagatnggcgcggttctgttgatactgattaccctctttacactcaccccgggttataagactcttctcagccggtgcctgtggtggctgtgttatctcctgaccctgggggaggccatggtccaggagtgggtaccacccatgcaggcacgcggtggccgtgacggcatcatatgggccgccaccatattctgcccgggtgtagtgtttgacataaccaagtggctcctggcggtgcttgggcctggttaccttctaagaggtgctttgacgcgcgtgccatacttcgtcagagctcacgctctgctgaggatgtgcactgtggtgaggcacctcgcggggggtaggtacgtccagatggcgctattagcccttggtaggtggaccggcacttacatctatgaccacctcacccctatgtcggattgggctgctaacggcctgcgagacttggcggtcgctgtggagcctatcatcttcagtccgatggagaagaaggtcatcgtctggggagcggagacggctgcatgcggggacatcttacacggacttcccgtatccgcccgactcggtcgggagattctccttggcccagctgatggctatacctctaaggggtggaggcttctcgcccccatcaccgcttacgcccagcagacgcgaggtctcttgggcgccatagtggtcagcatgacggggcgcgacaagacagaacaggccggggaaatccaaatcctgtccacggtcacccagtccttcctcggaacatccattgcgggggtcctatggactgtctaccacggagctggcaacaaaaccctagccggctcacggggcccggtcacgcaaatgtactcaagtgccgagggggacttggtggggtggcccagccctcctgggaccaaatctttggagccgtgcacgtgtggagcggtcgacctgtacctggtcacgcggaacgctgatgtcatcccggctcgaagacgcggggacaagcggggagcgttactctccccgagacccctttcgaccttgaaggggtcctcggggggaccggtgctttgccccaggggccatgctgtcgggatcttccgggcagctgtgtgctctcggggcgtggctaagtccatagatttcatccccgttgagacactcgacatcgtcacgcggtcccccacctttagcgacaacagcacaccaccagctgtgccccagacctatcaggtcgggtacttgcatgccccaactggcagtggaaagagcactaaggtccctgtcgcatacgccgcccaggggtataaggtgctagtgctcaatccctcggtggctgccaccctggggtttggggcgtacttgtccaaggcacatggcatcaatcccaacattaggactggagtcagaactgtgacgaccggggagcccatcacatactccacgtatggcaaattcctcgccgatgggggctgcgcaggcggcgcctatgacatcatcatatgcgatgaatgccacgccgtggatgctaccaccatcctcggcatcggaacagttcttgaccaagcagagacagccggggtcaggctaactgtactggccacggccacaccccccgggtcggtgacaactccccatcctaatatagaggaggtagccctcgggtcggagggtgagatccccttctatgggaaggcgattcccctgtcttacatcaagggagggagacacttgatcttctgccactcaaagaaaaagtgtgacgagctcgcggcggcccttcggggcatgggcttgaacgctgtggcgtactacagagggttggacgtctccataataccaactcaaggagatgtagtggtcgtcgccaccgacgccctcatgacggggtatactggagactttgacaccgtgatcgactgcaacgtagcggtcactcaagtcgtagacttcagcctggaccccactttcactataaccacacagaccgtccctcaagacgctgtctcacgtagccagcgccgggggcgcacaggtagaggaagattgggtatttataggtatgtttccactggtgagcgagcctcaggaatgtttgacagtgtggtgctcggtgagtgctacgacgcaggggccgcatggtatgaactcacaccatcggagactaccgtcaggcttagagcgtacttcaacacgcctggcctgcctgtgtgccaagaccatcttgagttttgggaggcagttttcaccggcctcacacacatagacgcccacttcctctcccagacaaaacaatcgggggagaatttcgcatacttagtagcctatcaggccacagtgtgcgccagagccaaagctcctcccccgtcctgggacgttatgtggaagtgcttgattcgactcaagcccacgctcgtgggccctacacccctcctgtaccgtttgggctctgttaccaacgaggtcaccctcacacatcctgtgacaaaatacatcgccacatgcatgcaagctgaccttgaggtcatgaccagcacgtgggtcctagctgggggagtcttggcagccgtcgccgcgtattgcttggcgaccgggtgtgtttccatcatcggccgtttgcacatcaaccagcgagccgtcgttgcaccggacaaggaggtcctctatgaggcttttgatgagatggaggaatgcgcctctagagcggctctcattgaagaggggcagcgaatagccgagatgctgaaatccaagatccagggcttattgcagcaagcttctaaacaggcacatgatatacaacccgctgtgcaggcttcatggcccaaggtagagcaattctgggccaaacacatgtggaacttcatcagcggcattcaatacctcgcaggactatcaacactgccagggaaccctgctgtagcttccatgatggcattcagtgccgccctcaccagtccgttgtcaactagcaccactatccttctcaacattttggggggctggctagcgtcccaaatcgcgccacccgcaggggccaccggcttcgtcgtcagtggcctggtgggggcagctgtaggcagcataggcttgggtaaggtgctggtggacatcctggcagggtatggtgcgggcatttcgggggctctcgtcgcattcaagatcatgtctggcgagaagccctccatggaggatgtcgtcaacctgctgcctgggattctgtctccgggtgccctggtggtgggagtcatctgcgcggccatcctgcgccgccacgtggggccgggggaaggcgcggttcagtggatgaacaggcttattgcctttgcttccagaggaaaccacgtcgcccccacccactacgtgacggagtcggatgcgtcgcagcgtgtgacccaactgcttggctcccttactataactagcctactcagaagactccacaactggattactgaggactgccctatcccatgcgccggttcgtggctccgcgacgtgtgggactgggtttgcaccatcttaacagacttcaaaaactggctgacctccaagttattcccaaagatgcccggcctcccctttatctcttgccaaaaggggtacaggggtgtctgggctggcactggtatcatgaccacacgatgtccttgcggcgccaacatctctggtaatgtccgcctgggctctatgagaattacagggcctaagacctgcatgaacacttggcaggggacctttcctatcaattgttacacggagggccagtgcgtgccgaagcccgcgccaaacttcaagaccgccatctggagggtggcggcctcagagtacgcggaggtgacgcagcacgggtcatactcctatataacaggattgaccactgacaatgtgaaggttccctgccaactaccttctccagagtttttctcctgggtggacggggtgcaaatccataggtttgctcccacgccaaagccgtttttccgggatgaggtctcgttcagcgttgggctcaattcatttgtcgtcgggtctcagcttccttgtgatcctgagcctgacactgacgtattgatgtccatgctaacagatccatcccatattacggcggaggccgcagcgcggcgcttagcgcgggggtcacccccgtccgaggcaagctcctcagccagccagctatcggcaccatcgttgcgtgccacctgcaccacccacggcagagcccatgatgtggacatggtggatgccaacctgttcatggggggcgatgtgacccggatagagtccgagtccaaagtggttgttctggactctctcgacccaatggccgaagaaaggagcgatcacgagccctcgataccatcagagtacttgctccccaagagcaggttcccgccagccttaccggcctgggcacggcctgagtacaacccaccgcttgtggaaccgtggaaaagggcagattaccaaccgcccgccgttgcgggctgtgctctccccccccctaagaaaaccccgaccccccccccaaggaaaccccggacagtgggtctgaacgagagcactatagcagatgccctccagcagctggccattaaaaccttcggccagccccctccaagcggggattcaggcctctctacgggggcggacgccgccgattccggcggtcagacgccccctgatgagttggctcattcggagacaggttccatctcctccatgccccccctcgagggggagcctggggacccagacctggagtctgggcaggtagagcttgaatctcccccccaggggggggaggtagctcccggctcggactcggggtcctggtctacttgctccgaggaggacgactccgtcgtgtgctgctccatgtcatactcttggaccggggctctaataactccttgtagccccgaagaggaaaagttgccaattaaccccttgagcaactcgctgttgcgataccacaacaaggtgtactgtactacagcaaagagcgcctcattgagggctaaaaaggtaacttttgataggatgcaagtgctcgacgcccattatcactcagtcttaaaggacatcaagctggcggcctccaaggtcagcgcaaggctcctcaccttggaggaggcatgccaattgaccccaccccattctgcaagatccaagtatgggtttggggctaaggaggtccgcagcttgtccgggagggccgtcaaccacatcaagtccgtgtggaaggaccttctggaagactcacaaacaccaattcctacgaccatcatggccaaaaatgaggtgttctgcgtggaccccaccaaggggggtaagaaagcagctcgccttatcgtttaccctgacctcggtgtcagggtctgcgagaaaatggccctttatgatgtcacacaaaagcttcctcaggcggtgatgggggcttcttatggcttccagtactcccccgctcaacgggtggagtttctcttgaaggcatgggcggaaaagaaagaccctatgggtttttcgtatgatacccgatgcttcgactcaaccgtcactgagagagatatcagaactgaggaatccatatatctggcctgctccctgcccgaggaggcccgcactgccatacattcgctgactgagagactttacgtgggagggcccatgttcaacagcaagggccagacctgcgggtacaggcgttgtcgcgccagcggggtgctcactactagcatgggtaacaccataacatgctatgtaaaagccctagcggcttgcaaggccgcggggatagttgcacccacaatgctggtgtgcggcgacgacttggttgtcatctcagaaagccaggggactgaggaggacgagcggaacctgagagccttcacggaggctatgaccaggtattctgcccctcctggtgacccccccagaccggaatatgacctggagctgataacatcttgctcctcaaatgtgtctgtggcactcggcccacagggccgccgcagatactacctgaccagagaccctaccactccaatcgcccgggctgcctgggaaacagttagacactcccctgtcaactcatggctgggaaacatcatccagtacgctccaaccatatgggttcgaatggtcctgatgacacatttcttctccattctcatggcccaagacactctggaccagaaccttaactttgaaatgtacggatcggtgtattccgtgagccctttggacctcccagccataattgaaaggctacacgggcttgacgccttctctctgcacacatacactccccacgaactaacgcgggtggcttcagccctcagaaaacttggggcgccacccctcaggacgtggaagagtcgggcgcgtgcagttagggcgtccctcatctcccatggggggagagcggccatttgcggtcggtatctcttcaactgggcggtgaaaaccaagctcaaactcactccattgccggaggcacgcctcctggatctatccagttggtttaccgtcggcgccggcgggggcgacatttatcacagcgtgtcgcgtgcccgaccccgcttgttactctttagcctactcctactttccgtaggggtaggcctcttcctactccccgctcgatagagcggcac

SEQ ID NO: 701 - DNA, 9416 bp, Hepatitis C Virus
  misc_feature 1679, 3307: n = A,T,C or G
atcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaatactaaccgtcgcccacaggacgtcaagtttccgggcggcggccagatcgttggcggagtatacttgttgccgcgcaggggccccaggttgggtgtgcgcgcgacaaggaagacttcggagcggtcccagccacgtgggaggcgccagcccatccccaaagatcggcgctccactggcaagtcctggggaaaaccaggatacccctggcccctatatgggaatgagggactcggctgggcaggatggctcctgtccccccgaggttcccgtccctcttggggccccactgacccccggcataggtcgcgcaacgtgggtaaggtcatcgataccctaacgtgtggctttgccgacctcatggggtacatccccgtcgtaggcgccccacttggtggcgttgccagagctctcgcgcacggcgtgagagtcctggaggacggggttaattatgcaacagggaacttacctggttgctccttttctattttcttgctggccctactgtcctgcgtcaccgttccggtctctgctgtccaagtgaagaacaccagtgagacctacatggtgactaatgactgttccaatgacagcatcacctggcagcttcaggccgcggtcctccacgtccccgggtgcgtcccgtgtgagcgaacgggaaatacatcacggtgctggataccggtttcaccaaacgtggccgtgcagcagcccggcgccctcacgcagggcttgcggacgcacatcgacatggttgtgatgtccgccacgctctgctccgccctttacgtgggggacctctgcggcggggtggtgctcgcagcccagctgttcattgtctcgccgcggcgccactggtttgtgcaggaatgcaattgctccatctatcctggtgccatcactggacaccgtatggcatgggacatgatgatgaactggtcgcccacgaccaccatggtcttggcgtacgcaatgcgcgttcccgaggtcattatagacatcattagtggggctcactggggcgtcatgttcggcctagcctacttctctatgcagggagcgtgggcgaaagtcgctgtcatccttctgctgaccgctggggtggaagcgcgcacccacacaactgggagtgtcgccgggcgtaccaccagcggcttcgccggcatcttcacctccggccctaagcagaacattcagctcattaacaccaatggcagttggcacatcaaccgcactgccctaaattgcaatgattccttgaacaccggctttatggcggccttgttctacaccaagaacttcaactcgtctggatgccccgaacgcctgtccgnctgccgcaacatcgaagccttccggataggatggggcaccttgcagtacgaggatgatgttaccaatccagaagatatgagaccatactgctggcactacccaccaaaacagtgtggcatattccccgcggggtctgtgtgcggcccagtgtactgtttcacccccagcccagtagtagtgggcacaaccaacaaacttggagtgcccacttacacatggggggagaatgagacagatgtcttcatattgaacagcacccgaccaccgcgggggtcatggttcggctgcacgtggatgaattccactggtttcaccaagacttgtggcgcaccaccttgccgcattagggccgacttcaatgccagcacggacctcttgtgccccacggactgttttaggaagcatcctgaagccacttacatcaaatgtggttctgggccctggctcacgccaaggtgcctggtcgactacccctacaggctctggcattacccctgcacagtcaactattccatctttaagataaggatgtatgtggggggggttgagcacaggctcacggccgcgtgcaatttctctcgtggggatcgttgcaacttggaggacagggacaggagtcaactgactcctctgttgcactccaccacggaatgggccatccttccctgttcttactcagacttgcccgctttgtcgactggccttctccatctccaccaaaatatcgtggacgtacaatacatgtatggcctgacacctgccctcacaaaatatgtcgttcgatgggagtgggtagtactcttattcctgctcctagcggacgccagggtttgcgcctgcttgtggatgctcatcttgctgggccaggctgaagcagcactagagaagctggtcgtcttgcacgctgcgagtgcggctagctgcaatggcctcctgtattttgtcatctttttcgtggctgcttggtacatcaagggtcgggcggtccccttggccgcctactccctcactggcctatggcccttctgcctactactcctagtactgccccaacaggcttatgcctatgatgcatccgtgcacggacaggtaggcgcggctttgttaatactgattaccctcttcacacttaccccggggtataagaccctcctcagtcggtgtctgtggtggttgtgctatctcctgaccctgggggaagccttgatccaagagtgggtaccacccacgcaggcacgcggtggccgcgatggcatcatatgggccgctaccatgttctgcccgggtgtagtgtttgacataaccaagtggctcttggcggtgcttgggcctgcttacctcctaagagatgccttgacacgcgtgccttatttcgtcagagctcacgctctgctgaggatgtgcaccgtggtgaggaacctcgcggggggtaagtatgtccagatggcgctattagcccttggcaggtggaccggcacttacatctatgaccacctcacacctatgtcggactgggctgctagcggcctgcgggacttggcggtcgctgtggagcccatcatcttcagtccgatggagaagaaagtcatcgcctggggagcagagacagccgcatgcggggatatcntgcacgggctccccgtgtccgcccgacttggtcgggagatcctccttggcccagctgatggctacacctccaaggggtggaggcttctcgcccccatcactgcttacgctcagcagacacgaggcctcttgggcgctatagtggtgagcatgacggggcgcgacaagacagaacaggccggggaaatccaagtcctgtccacggtcactcagtccttcctcggaacaaccatttcgggggttttgtggactgtttaccacggagctggcaacaagactctagccggctcacggggcccggtcacgcagatgtactcgagtgccgagggggacttggtagggtggcccagccctcccgggaccaaatctttggagccgtgtacgtgtggagcggtcgacctgtacctggtcacgcggaacgctgatgtcatcccggctcggagacgcggggacaagcggggagcgttactctccccgagacctctttcgaccttgaaggggtcctcggggggaccggtgctttgccctaggggccacgctgtcgggattttccgggcagccgtgtgctctcggggcgtggccaagtccatagattttatccccgttgagacactcgacatcgtcacgcggtcccccaccttcagtgacaacagcacaccaccagctgtgccccagacctaccaggtcgggtacttgcacgccccgactggcagcgggaaaagtaccaaagtccccgtcgcgtacgccgctcaggggtacaaagtgctagtgcttaatccctcggtggctgccaccttggggtttggggcgtacctgtccaaggcacatggcatcaatcccaacatcaggactggggtcaggactgtgacgaccggggcggccatcacatactccacgtatggcaaattcctcgccgatgggggctgcgcaggcggcgcctatgacatcatcatatgcgacgaatgccacgctgtggattctaccaccattctcggcattggaacagttcttgaccaagcagagacagccggggtcaggctaactgtactggccacggctacgccccccgggtcggtgacgaccccccaccccaatatagaggaggtagccctcgggcaggagggtgagatccccttctatgggagggcgattcccttgtctcacatcaagggagggagacacttgattttctgccactcaaagaaaaagtgtgacgagctcgcggcggcccttcggggcatgggcttgaacgctgtggcatattacagagggttagacgtctccgtaataccaactcaaggagatgtagtggtcttcgccaccgacgccctcatgacggggtatactggagactttgactctgtgatcgattgcaacgtagcggtcactcaagtcgtagacttcagtttggaccccaccttcaccataaccacacagactgtccctcaagacgccgtctcgcgtagccagcgccgagggcgtacaggtagggggagactgggcatttataggtatgtttccactggtgagcgagcctcaggaatgtttgacagtgtggtgctctgtgagtgctacgacgcaggggctgcatggtatgagctcacaccagcagagactaccgtcaggcttagagcgtatttcaacacgccaggcttgcctgtgtgccaagaccatcttgagttttgggaggcagttttcaccggcctcacacacatagatgcccacttcctttcccaaacaaagcaatcgggggagaatttcgcatacttggtagcctatcaagccacagtgtgcgctagagccaaggcccctcccccgtcctgggacgtcatgtggaagtgtttgacccgacttaagcccacgctcgtgggtcccacacctctcctgtaccgtttgggctccgttgccaacgagatcaccctcacacaccctgtgacaaagtacatcgccacatgcatgcaagctgaccttgaggtcatgactagcacgtgggttctagctgggggagtcttggcagccgtcgccgcgtattgcttggcgaccgggtgtgtttctatcatcggccgtttgcacatcaatcagcgagccgtcgttgcgccggacaaggaggtcctctatgaggcttttgatgagatggaggaatgtgcctctagagcggctctcgttgaagaggggcagcggatagccgagatgctgaagtccaagatccaaggcttattgcagcaagcttctaaacaggcccaggacatacaacccgctgtgcaggcttcatggcccaaggtagaacaattctgggctaaacacatgtggaacttcatcagcggcattcaatacctcgcaggactgtcaacactgccagggaaccccgctgtggcttccatgatggcattcagtgccgccctcaccagtcctctgtcaactagcaccactatccttctcaacattttgggaggctggctggcgtcccaaatcgcgccacccgcaggggccaccggcttcgtcgtcagtggcctggtgggggcagctgtaggcagcataggcctgggcaaggtgctggtggacatcctggcagggtatggtgcgggcatttcgggggccctcgtcgcatttaagatcatgtctggcgagaagccctccatggaggatgttgtcaatctgctgcctgggattttgtctccgggtgccttagtggtgggagtcatctgcgcggccattctacgccgccacgtgggaccgggggaaggtgcggtccaatggatgaacaggctcattgcctttgcttccagaggaaaccacgtcgcccctacccactacgtgacggagtcggatgcgtcgcagcgtgtgacccaactgcttggatcccttactataactagtctactcaggagactccacaattggattactgaggactgccccatcccatgcgccggttcgtggctccgtgatgtgtgggattgggtttgcaccatcctaacagactttaaaaattggctgacctccaaattgtttccaaagatgcccggcctcccctttatctcttgccagaaggggtacaagggcgtgtgggccggcactggtatcatgaccacacgatgtccttgcggcgccaacatctctggtaatgtccgcctgggctctatgagaatcacagggcctaaaacctgcatgaacacttggcaggggacctttcctatcaattgttacacggagggccagtgcgtgccgaaacccgcgccaaacttcaaggtcgccatctggagggtggcggcctcagagtacgcggaggtgacgcagcacggatcatactcctatataacaggattgaccactgacaatttgaaagttccctgccaactaccttctccagagttcttctcctgggtggatggggtgcaaatccataggttcgctcccacaccaaagccgtttttccgggatgaggtctcgttctgcgttggactcaattcatttgttgtcgggtctcagcttccttgtgaccctgagcccgacactgacgtactgacgtccatgctaacagatccatcccatatcacggcggagaccgcagcgcggcgcttggcgcgggggtcacctccatccgaggcaagctcctcagcgagccagctatcagcgccatcgctgcgagccacctgcaccacccatggcaagacttatgatgtggacatggtggatgccagcctgttcatggggggcgatgtgactcggatagagtctgagtccaaagtggtcgtcctggactctctcgacccaatggccgaagaagagagcgacctcgagccctcgataccatcggagtatatgctctccaggaacaggttcccgccagccttaccggcctgggcacggcctgattacaacccaccgcttgtggagtcgtggaagaggccagattaccaaccggccactgttgcgggctgtgctctccccccccctaagaaggccccgacgccccccccaaggagacgccggacagtgggtctgagcgagagcaccataggagacgccctccaacagctggccatcaagtccttcggccagccccccccaagcggcgattcaggcctttccacgggggcggacgccgccgactccggcagtcggtcgccccctgatgagttggctctttcggaaacaggttctacctcctccatgccccccctcgagggggagcctggggatccagacctggagcctgagcaggtagagccccaaccccccccccaggggggggaggtggctcccggctcggactcggggtcctggtctacttgctccgaggagaatgtctccgtcgttttctgctccatttcatactcctggaccgggggtctaataactccttgtatccccgaaaaagaaaagttgccatttaaccccttaagcaactccctgttgcgatacgacaacaaggtgtactgtactacatcaaagagcgcctcactgagggctaaaaaggtaacttttgataggatgcaagtgctcgacgcctattatgactcagtcttaaaggacatcaagctagcggcctccaaagtcagcgcaaggctcctcaccttggaggaggcgtgccaattgactccaccccattccgcaagatccaagtatgggtttggggctaaggaggttcgcagcttgtccgggagggccgttaaccacatcaagtccgtgtggaaggacctcctggaagactcacaaacaccaattcccacgaccatcatggccaaaaatgaggtgttctgcgtggaccccaacaaggggggtaagaaagcagctcgccttatcgtttaccctgacctcggtgtcagagtttgcgagaagatggccctttatgatgtcacacaaaagcttcctcaggcagtgatgggggcctcttatggcttccagtactcccccgctcaacgggtggagtttctcttgaaggcatgggcggaaaaaaaagaccctatggggttttcgtatgatacccgatgctttgactcaaccgtcactgagagagacatcagaactgaggagtccatataccggccttgttccttgcccgaggaggcccacactgccatacactcgctgactgagagactttacgtgggagggcccatgtttaacagcaagggccaggcctgcgggtacaggcgttgccgcgccagcggggtgctcaccactagcatggggaacaccatcacatgctatgtgaaagccctagcggcctgtaaggctgcggggatagttgcgcccacaatgctggtatgcggcgacgacttggttgtcatctcagaaagccaggggactgaggaggacgagcggaacctgagagccttcacggaggctatgaccaggtactctgcccctcctggtgaccctcccagaccggaatatgacctggagctgataacatcttgttcctcaaatgtgtctgtgcacttgggcccacaaggccgccgcagatactacctgaccagagaccctaccactccaatcgcccgggctgcctgggaaacagttagacactcccctgtcaattcatggctgggaaacatcatccagtacgctccaaccgtatgggttcgcatggtcctgatgacacacttcttctccattctcatggcccaagacaccctggaccagaacctcaactttgaaatgtacggatcagtgtactctgtgagtcctttggacctcccagccataattgaaaggttacacgggcttgacgctttctctctgcacacatactctccccacgaactgacgcgggtggctgcagccctcagaaaacttggggcgccacccctcagagcgtggaagagtcgggcgcgtgcagttagggcgtccctcatctcccatggagggagggcggccgtttgcggtcggtatctcttcaactgggcggtgaagaccaagctcaaactcactccattgccggaagcacgccacctggatttatccagttggtttactgtcggcgccggcgggggccacatttatcacagcgtgtcgcgtgcccgaccccgcttattactccttggcctactcctacttttcgtaggggtaggcctcttcctactccccgctcggtagagcggcac

SEQ ID NO: 702 - DNA, 9416 bp, Hepatitis C Virus
  misc_feature 2796, 9171: n = A,T,C or G
atcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacactaaccgtcgcccacaagacgttaagtttccgggcggcggccagatcgttggcggagtatacttgttgccgcgcaggggccccaggttgggtgtgcgcgcgacaaggaagacttcggagcggtcccagccacgtgggaggcgccagcccatccccaaagatcggcgctccactggcaagtcctggggaaaaccaggatacccctggcccctatatgggaatgagggactcggctgggcaggatggctcctgtccccccgaggttcccgtccctcttggggccccactgacccccggcataggtcgcgcaacgtgggtaaggtcatcgataccctaacgtgcggctttgccgacctcatggggtacatccccgtcgtaggcgccccgcttggtggcgtcgccagaactctcgcgcacggcgtgagagtcctggaggacggggttaattatgcaacagggaacttacctggttgctccttttctatcttcttgctggccctactgtcctgcatcaccattccggtctctgctatcgaagtgaagaacaccagtgacggttatatggtgactaatgactgttccaatggcagcatcacctggcaactccaggccgcggtcctccacgtccccgggtgcgtcccgtgcgagaaagtgggaaatacatcacggtgctggataccggtctcaccaaacgtagccgtgcagcggcctggcgccctcacgcagggcctgcggacgcacatcgacatggttgtgatgtccgccacgctctgctctgctctctacgtgggggacctctgcggcggggtgatgctcgcagcccatatgttcattgtcacgccgcaacaccactggtttgtgcaggattgcaattgctccatctaccctggtaccatcactggacaccgcatggcatgggacatgatgatgaactggtcgcccacggccaccatgatcctggcgtacgcgatgcgcgtccccgaggtcatcatagacatcattggtggggctcattggggcgtcatgttcggcttagcctacttctctatgcagggagcctgggcaaaagtcgttgtcatcctcctgctgaccgctggggtggacgcgaatacctactccgtcgggggttccactgcgcatctcacccagacctttgccggcctcttcaccctgggctctcagcagaatatccagctcatcaacaccaatggcagttggcacatcaaccgtactgccctgaattgcaatgaatccctgaacaccggctttctcgcgtccctgttctacacccacgcgttcaactcgtcaggatgtcccgaacgcctgtccgcctgccgcaacatcgaggctttccggataggatggggcgttttgcaatacgaggaaaatgtcaccaatccagaagatatgagaccatattgctggcactacccaccaaaacagtgcggcatagtccccgcgaggtctgtatgtggcccggtgtactgtttcactcccagcccagtggttgtgggcacgaccgataagcttggagtgcctacttatacatggggagagaatgagacagatgtcttcctattgaatagcacccggccaccgcggggggcatggttcggctgcacgtggatgaactccactggtttcaccaagacttgtggcgcaccaccttgccgcatcagagctgacttcaacgccagtacggacctgttatgccccacggactgttttaggaagcatcctgaggccacttacaccaaatgtggctctgggccttggctcacgccaagatgcatggtcgactacccctacaggctcggcattcatccctgcacagtcaactataccatcttcaagataaggatgtatgtggggggggttgaacacaggcttacggccgcgtgtaacttcactcgtggggatcgttgcaacttggaggacagagacagaagtcaactgtctcctttgttgcactccaccacggaatgggccattttgccttgtactttctcagacttgcccgctttgtcgactggtcttctccacctccaccaaaacatcgtggacgtgcaatacatgtatggcctgtcacctgccatcacaagacatatcgttcgatgggagtgggtggtactcttattcctgctcttggcggacgccagggtctgcgcatgcgtgtggatgctcatcttgctgggccaggccgaagcagcactagagaagctggtcgtcttgcacgctgcgagcgcagctagctgcaatggcttcctatactttgtcatcttcttcgtggctgcctggtacatcaaggggcgggcagtcccccttgctgcctattcccttaccggcctatggtccttctgcctactgctcctagcactgccccaacaggcttatgcctatgacgcatctgtgcacgggcagataggcgctgttttgttgatactagtnaccctttttacactcaccccggggtataagatccttcttagccggtgcctatggtggttgtgctatctcctgaccttgggggaagccatgatccaggagtgggtaccacccatgcaggtgcgtggcggccgcgatggcatcatatgggccgccaccatattctgcccgggtgtggtgtttgacataaccaagtggctcttggcgttgcttgggcctggttatctcctaagaggtgctttgacgcgtgtgccgtatttcgtcagagctcacgctctgctgaggatgtgcaccatggcgaggcacctcgcggggggtaagtacgtccagatggcgttattagcccttggtaggtggactggcacttacatctatgaccatctcacccctatgtcggactgggctgctagtggcctgcgggacctggcggtcgctgtggagcccatcatcttcagtccgatggagaagaaagtcatcgtctggggagcggagacagccgcatgcggggacatcctacacggactccccgtgtccgcccgactcggccgggaggtcctccttggcccagctgatggctacacctccaaggggtggaagcttctcgcccccatcactgcttacgcccagcagacacgaggtctcttgggtgccatagtggtaagcatgacggggcgagacaagacagaacaggccggggagatccaagtcctgtccacagtcactcaatccttcctcggaacatccatttcaggggtcttatggactgtctaccacggagctggcaacaagactctagccggctcacggggtccggtcacacagatgtactcgagtgccgagggggacttggtagggtggcccagccctcctgggaccaaatctttggagccgtgcacgtgtggagcggtcgacctgtacctggtcacgcggaacgctgatgtcatcccggctcgcaggcgcggggacaagcggggagcgttactctccccgagacccctttcgaccttgaaggggtcctcggggggaccggtgctttgccctaggggccacgctgtcgggatcttccgggcagctgtgtgctctcggggcgtggctaagtccatagatttcatccccgttgagacacttgacatcgtcacgcggtctcccacctttagtgacaacagcacaccaccggctgtgccccagacctatcaggtcgggtacttacatgccccaactggcagtggaaagagcaccaaagtccctgtcgcctacgccgctcaggggtataaggtactaattcttaatccctcggtgggtgccaccttggggtttggggcgtacttgtccaaggcatatggcatcaatcccaacatcaggactggggtcagaactgtgacaaccggggactccatcacatactccacatatggtaaattcctcgctgatgggggctgcgcaggcggcgcctatgacatcatcatatgcgatgaatgccacgccgttggatctaccaccaatctcggtatcggaacagtccttgatcaagcagagacggccggggtcagactaactgtgctggctacggctacgctccccgggtcagtggagaccccccatcccaatatagaggaggtagccctcgggcaggagggtgagatccccttctatgggagggcgattcccctgtcctacatcaagggagggaggcacttgatcttctgccactcaaagaaaaagtgtgacgagctcgcggcggcccttcggggcatgggcttgaacgctgtggcatactacagagggttggacgtctccgtaataccaactcagggagatgtagtggtcgtcgccaccgacgccctcatgacggggttcactggagactttgacaccgtgatcgactgcaacgtagcggtcactcaagtcgtagacttcagcctggaccccaccttcaccataaccacacagactgtacctcaagacgctgtctcacgtagccagcgccgggggcgcacgggtagaggaagactgggcacttataggtacgtttccactggtgaacgagcttcaggaatgtttgacagtgtagtgctctgtgagtgctacgacgcaggagctgcatggtatgagcttacaccagcggagaccaccgtcaggcttagagcttattttaacacacctggcttgcctgtgtgccaagaccatcttgagttttgggaggcagttttcaccggcctcacacacatagatgcccacttcctttcccaaacaaagcaagcgggagagagctttccatacctggtagcttatcaagctacagtatgcgctagagccaaagccccccccccgtcctgggacattatgtggaagtgcttaactcgactcaagcccacgctcgtgggccctacacccctcctgtaccgtttgggctctgttaccaacgagatcaccctcacacatcctgtgacgaaatacatcgccacatgcatgcaagctgaccttgaggtcatgaccagcacgtgggtcctagctgggggagtcttggcagccgtcgccgcgtattgcctggcgaccgggtgtgtttccatcatcggccgcttgcatatcaatcagcgagccatcgttgcaccggacaaggaagtcctttatgaggcttttgatgagatggaggaatgtgcctctaaagcggctctcctagaagaagggcagcgaatagccgagatgttgaagtccaagatccaaggcttactgcagcaagcctctaaacaggcccaggacatacaacccgctgtgcaggcttcatggcccaaggtggaacaattctgggccaaacacatgtggaacttcattagcggcatccaatacctagcaagactgtcaacactgccagggaaccccgctgtggcttccatgatggcgttcagtgccgccctcaccagcccgttgtcaactagcaccactatccttctcaacattttgggaaggtggctggcgtcccaaattgctccacccgcgggggccaccggcttcgtcgtcagtggcctggtgggggctgctgtgggcaatataggtctgggtaaggtgctggtggacattctggcagggtatggcgcgggcatttcgggggccctcgtcgcattcaagatcatgtctggcgagaagccctccatggaagatgtcatcaacctgctgcctgggatcctgtccccgggtgccctggtggtgggggtcatctgcgcggccattctgcgccgccacgtgggaccgggggaaggcgcggtccaatggatgaacaggctcatcgccttcgcttccagaggaaaccacgtcgcccctactcactacgtgacggagtcagatgcgtcgcagcgtgtgacccagctgcttggctctcttacaataactagcctactcaggagactccacaattggattactgaggactgccccatcccatgcgccggctcgtggcttcgcgatgtgtgggactgggtttgcaccatcctgacagattttaaaaactggctgacttccaagttgttcccaaagatgcctggcctcccctttatctcttgccaaaaggggtacaagggtgtgtgggccggcactggtatcatgaccacacgatgtccctgcggcgccaacatttctggcaatgtccgcctgggctcaatgagaatcacagggcctaaaacctgcatgaacatttggcaggggacctttcctatcaactgttacactgagggccagtgcgtgccgaaacccgcgccgaacttcaagaccgccatctggagggtggcggcctcagagtacgcggaggtgacgcagcacgggcaatactcctatgtgacaggattgaccactgacaacttgaaagttccctgccaactaccttctccagagttcttttcctgggtggacggagtgcaaatccataggtttgcccccacaccaaagccgttctttcgggatgaggtctcgttttatgttgggctcaattcgtttgtcgtagggtctcagctcccctgtgatcctgagcccgatacagatgtgttgatgtccatgttaacagaaccatcccatattacggcggaggctgcagcgcggcgcttagcacgggggtcacccccgtctgaggcgagctcttcagcgagccagctatcagcaccatcgctgcgagccacctgcaccacccacggcaaggcttatgatgtggacatggtggatgccaacctgttcatggggggcgatgtgactcggatagaatctgagtcaaaagtggtcgttctggactctctcgacccaatggctgaagaaaagagcgacctcgagccctcaataccatcggagtatatgctccccaggaacaggttcccgccagccttaccggcctgggcacggcctgattacaacccaccgcttgtggaatcgtggaagaggccagattaccaaccgcccactgttgcgggctgtgctctccccccccctaagaaaaccccgacgcctcccccaaggaggcgccggacagtgggtctggatgagagcaccataggagatgccctccagcagctggccatcaagaccttcggccagatccccccaagcgccgattcaggcctttccacgggggcggacgccgccgactccggcggccggacgtcccctgacgagttggctctttcggagacaggttccatttcctccatgcccccccttgagggggagcctggggatccagacctagagcccgagcaggtagagcttcaacctcccccccaggagggggagctagctcccggctcggactcggggtcttggtcgacttgctccgaggaggatgactccgtcgtgtgctgctccatgtcgtactcctggaccggggctctaataactccttgtagccccgaagaagagaagttaccaattaaccccttgagcaactcgttgttgcgatatcacaacaaggtatactgtactacatcaaagagtgcctcactgagggctaaaaaggtaacctttgacaggatgcaagtgctcgacgcccattacgactcagtcttaaaggacatcaagctagcggcctctaaggtcagtgcaaggctcctcaccttagaggaggcctgccagttgaccccaccccattctgcaagatccaaatatggatttggggctaaagaggtccgcagcttgtccgggagagccgtcaaccacatcaagtccgtgtggaaggacctcctggaagactcacaaacaccaattcctacgaccatcatggccaaaaatgaggtgttctgcgtcgaccccaccaaggggggtaagaaagcagctcgccttatcgtttaccctgacctcggcgtcagggtatgcgagaaaatggccctttatgatatcacacaaaagcttcctcaggcggtgatgggggcttcttatggcttccagtactcccctgcacaacgggtggagtttctcttgaaggcatgggcggaaaagaaagacccattgggtttttcgtatgatacccgatgctttgactcaaccgtcactgagagagacatcagaactgaggagtccatataccgggcctgctccctgcccgaggaagctcacactgccatacattcgctgactgagagactttacgtgggggggcctatgctcaacagcaaaggccaatcctgcgggtacaggcgttgccgcgccagcggagtgctcaccactagcatggggaacaccatcacatgctatgtgaaagccctagcagcttgtaaggctgcggggatagttgcgcccacaatgctggtatgcggcgacgacttggttgtcatctcagaaagccaggggactgaggaggacgagcggaacctgagagccttcacggaggctatgaccaggtattctgcccctcctggtgaccctcccagaccggaatatgacctggagctgataacatcttgttcctcaaatgtgtccgtggcgctgaacccactgggccgccgcagatactacctgaccagagaccccaccactccaattgcccgggctgcctgggaaacagttagacactcccctgtcaattcatggctgggaaacatcatccagtacgccccaacaatatgggctcgcatggtcctgatgacacacttcttctccattctcatggctcaagacaccctggaccagaatctcaactttgagatgtacggatcggtgtactccgtgagtcctttggacctcccagccataattgaaaggctacacgggcttgacgctttctctctgcacacatactctccccacgaactgacgcgggtggcttcaaccctcagaaaacttggggcgccacccctcagagcgtggaagagtcgggcgcgtgcagttagggcgtccctcatctcncgtggagggagagcggccgtttgcggtcggtatctcttcaactgggcggtgaagaccaagctcaaactcactccattgccggaggcacgcctcctggatttatccagttggttcaccgtcggcgccggcgggggcgacatttatcacagcgtgtcgcgtgcccgaccccgcttattactccttggcctactcctactttctgtaggggtaggcctctttctactccccgctcggtagagcggcac

SEQ ID NO: 703 - DNA, 9416 bp, Hepatitis C Virus
  misc_feature 2415, 3654: n = A,T,C or G
atcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacactaaccgtcgcccacaagacgttaagtttccgggcggcggccagatcgttggcggagtatacttgttgccgcgcaggggccccaggttgggtgtgcgcacgacaaggaatacttcggagcggtcccagccacgtggaaggcgccagcccatccctaaagatcggcgctccactggcaagtcctggggaaaaccaggatacccctggcccctatatgggaatgaaggactctgctgggcgggatggctcctgtccccccgaggttcccgtccctcttggggccccactgacccccggcataggtcgcgcaatgtgggtaaagtcatctataccctaacgtgcggctttgccgacctcatggggtacattcccgtcgtaagcgccccgcttggtggcgtcgccagagctctcgcgcacggtgtgagagtcctggaggatggggttaattatgcaacagggaacttacctggttgctccttttctatcttcttgctggccctactgtcctgcatcactgttccggtctctgctgcccaggtaaggaacataagcactagttacatggtgactaatgattgttccaatgacagcatcacctggcagcttaaggccgcagtcctccacgtccccgggtgcgtcccgtgcgagagagtgggtaatacatcacgatgctggataccggtctcaccaaacgtggctgtgcagcaccgcggtgccctcacgcagggcttgcggacgcacatcgacatggttgtgatgtccgctacgttctgctccgctctctacgtgggggacctctgcggcggggtgatgctcgcagcccagctgttcattatctcgccggagcaccactggtttgtgcaggaatgcaattgttccatctaccctggtaccatcactggacaccgtatggcatgggacatgatgatgaactggtcgcccacggccaccatgatcttggcgtacgcgatgcgcgttcccgaggtcatcataaacatcattagcggggctcactggggcgtcatgttcggcttagcctacttctccatgcagggagcgtgggcaaaagtcgttgccatccttctgctggccgctggggtggacgcgaccacccacagcgttgggggcagtgccgcgcacaccaccagaagtttcgtcggcctgttcagcgctggcgctcagcagaacattcagctcatcaacaccaatggcagttggcatatcaaccgcactgccttgaactgcaatgactccttgaacaccggctttatcgcgtccctgttctacacccaccgcttcaactcgtcaggatgtcccgaacgcctatccgcctgccgtaacatcgaggcctttcggataggatggggcaccttgcaatacgaggatgatgtcaccaatccagaagatatgagaccatattgctggcactacccaccaaaacagtgcggcatagtccccgcaaggtctgtgtgcggcccagtgtactgtttcactccaagcccagtggtggtgggcacgaccgacagacgtggagtgcctacttacacgtggggggagaatgagacagatgtcttcctattgaacagcacccgaccaccgtcgggatcatggtttggctgcacgtggatgaactccactggcttcaccaagacttgtggcgcaccaccttgccgcatcagagctgacttcaatgccagcacggacctgttgtgccccaccgactgttttaggaagcatcctgaagccacttacaccaggtgtggttctgggccctggctcacgccaaagtgcctggtcgactatccctacaggctctggcattacccctgcacagttaactataccatcttcaagataaggatgtatgtggggggggttgagcacaggctcacggccgcgtgcaatttctctcgcggggatcgttgcaacttggaggacagggacagaagtcaattgtctcctttgttgcactccaccacagaatgggccattctgccctgcacttattcagacttgcccgccttgtcgaccggtctgctccacctccaccaaaacatcgtggacgtncaatacatgtatggcctgtcaccagccctcacaaaatacgtcgttcgatgggagtgggtagtactcctattcctactcctagcggacgccagggtttgtgcctgtgtgtggatgctcatcttgctgggccaagccgaagcagcgctagagaagctggtcatcttgcacgctgcgagcgcggctagctgcaacggcttcctatactttgtcatctttttcgtggctgcttggtacatcaagggtcgggcggtccccttggccgcctattccctcactggcctatggcccttctgcctattgctcctagcactgccccaacaggcttatgcctatgatgcatctgtgcacggacagataggcgcggctttactggtactgattaccctctttacactcaccccggggtataagacccttctcagccggtgcctgtggtggttgtgctatctcctgaccctgggggaagccatggtccaggaatgggcaccgtccatgcaggcgcgcggtggccgcgatggcatcatatgggccgccaccatattctgcccggggatagtgtttgacataaccaagtggctcttggcggtgcttgggcctggttacctcctaagagatgctttgacacgcgtgccgtatttcgtcagagctcacgctctgctgaggatgtgcaccgtggtgaggcacctcgcggggggtaagtacgtccagatggcgctgttagcccttggtaggtggaccggcacttacatctatgaccatctcacccctatgtcagattgggctgctaatggcctgcgggacttggcggtcgccgtggagcctatcatcttcagcccaatggagaagaaagtcatcgtctggggagcggagaccgctgcatgcggggacatcttatacggacttcccgtgtcagctcgactcggccgggagatcctcctcggcccagctgatggctatacctccaaggggtggaggcttcttgcccccatcactgcttacgcccagcagactcgaggtctcttgggcgccatagtggtgagcatgacggggcgtgataagacagaacaggccggggagatccaagtcctgtccacagtcactcagtccttcctcggaacaaccatttcggggatcctgtggactgtttaccacggagctggcaacaagactctagccggttcacggggcccggtcacacagatgtattcgagtgccgagggagacttggtagggtggccnagcccccctgggaccaaatctttggagccgtgcacgtgtggagcggtcgacctgtatctggtcacgcggaacgctgatgtcatcccggctcgaagacgcggggacaagcggggagcgttgctctccccgagacccctttcgaccttgaaggggtcctcgggggggccggtgctttgccctaggggccacgctgtcgggatctttcgggcagctgtgtgctcccggggcgtagctaagtccatagacttcatccccgttgaggcgctcgacatcgtcacgcggtctcccacttttagtgacaacagcacaccaccggctgtgccccagacctatcaggtcgggtacttgcatgccccaactggcagtggaaagagtaccaaggtccctgtcgcgtacgccgctcaggggtacaaagtgttggtgcttaatccttcggtggctgccaccctggggtttggggcgtgcttgtccaaggcacatggcatcaaccccaacattaggactggggtccaaactgtgacaaccggagaggccatcacgtactccacatatggcaaattcctcgctgatgggggctgcgcaggcggcgcctatgatatcatcatatgcgacgaatgccatgctgtggatgctaccaccattctcggcatcggaacagttcttgatcaagcagaaacagccggggtcaggctaactgtgctggccacggccacgccccccgggtcagtgacaaccccccatcccaatatagaggaggtagccctcgggcacgaaggtgagatccccttctatgggagggcgattcccctgtcttacatcaagggagggagacacttgatcttctgccactcaaagaaaaagtgtgacgagctcgcggcgggccttccgggcatgggcttgaacgctgtggcatactacagagggttggacgtctccataataccaactcagggagatgtggtggtcgtcgccaccgacgccctcatgacggggtacactgacgactttgactccgtgatcgactgcaacgtagcggtcactcaggtcgtagacttcagcttggaccccaccttcactataaccacacagactgtccctcaagacgctgtctcacgtagccagcgccgggggcgcacaggtagaggaagattgggcacttataggtatgtttccactggtgagcgagcctcaggaatgtttgacagtgtggtgctctgtgagtgctacgacgcaggagctgcatggtatgagctcacaccaggggagactaccgtcaggcttagagcgtacttcaacacgcctggcttgcctgtgtgccaagaccatcttgagttctgggaggcagttttcaccggcctcacacacatagatgcccacttcctttcccaaacaaagcaagcgggggagaattacgcgtacttagtagcctatcaggctacggtgtgcgccagagccaaagcccctcccccgtcttgggacgtcatgtggaagtgcttgactcgacttaagcccacgctcgtgggccctaaacctctcctctaccgtttgggctctgttaccaacgaggtcaccctcacgcatcctgtgacgaaatacatcgccacatgtatgcaagctgaccttgaggtcatgaccagcacgtgggtcctagctgggggagtcttggcagccgtcgccgcgtattgcttggcgaccgggtgtgtttccatcatcggccggttgcatatcaaccagcgagctgtcgttgcgccggacaaggaggtcctttatgaggcttttgatgagatggaggaatgtgcctctaaagcggctctcattgaagaggggcagcgaatagccgagatgctgaagtccaagatccaaggcttattgcagcaagcctctaaacaggcccaggacatacaacccgctgtgcaggcttcatggcccaaggtggagcaattctgggccaaacacatgtggaacttccatagcggcattccatacctcgcaagactgtcacaactgccagggaacccggctgtggcttcaatgatggcattcaagtgcgccctcaccagtccgttgtcaactagcaccactatccttctcaacatccttggaggctggttggcgtcccaaatcgcgccacccgccggggccaccggcttcgtcgtcagcggcctggtaggggctgccgtaggcagcataggcctgggtaaggtgctggtggacatcctggcggggtatggtgcgggcatttcgggagccctcgtcgcattcaagatcatgtctggcgagaagccctctatggaggatgttgtcaatctgctgcctgggattctgtctccgggtgccctggtggtgggagtcatctgcgcggccattctgcgccgccacgtgggaccgggggaaggcgcggtccaatggatgaacaggctcattgcctttgcctccagaggaaaccacgtcgcccctactcactacgtgacggagtcggatgcgtcgcagcgtgtgacccaactgcttggctcccttactataaccagcctactcagaagactccacaattggatcactgaggactgtcccatcccatgcgccggctcgtggctccgtgatgtgtgggactgggtttgcaccatcctaacagattttaaaaactggctcacctccaaattgttcccaaagatgcccggcctcccctttatctcttgccaaaaggggtataggggtgtgtgggccggcactggcatcatgaccacacgatgtccttgcggcgccaacatctctggcaatgtccgcttgggctccatgagaatcacagggcctaaaacctgcatgaacacttggcaggggacctttcctatcaattgttacacggagggccagtgcgtgccgaaacccgcgccaaacttcaagaccgccatctggagggtggcggcctcggagtatgcggaggtgacgcagcacgggtcatactcctacataacaggactgaccactgacaacttgaaagttccctgccaattaccttctccagagttcttttcctgggtggacggggtgcagatccacaggtttgcccccacgccaaagccgttttttcgggatgaggtctcgttttgcgttgggctcaattcatttgtcgtcgggtctcagcttccttgcgaccttgagcccgatacagatgtattgatgtccatgctaacagatccatcccacatcacggcggaggctgcagcgcggcgcctagcgcgggggtcacccccatctgaggcaagctcctcagcgagccagttatcggcaccatcgctgcgcgccacctgcaccacccacggcaagacctatgacgtggacatggtggatgctaacttgttcatggggggcgatgtgactcggatagagtctgagtccaaagtggtcgttctagactctctcgacccaatggccgaagacaggagcgaccacgaaccctcgataccatcggagtatatgctccccaagaccaagttcccgccagccttgccggcctgggcacggcctgattacaacccaccgcttgtggaatcgtggaagaggccagattaccaaccacccactgttgcgggctgtgctctccccccccccaagaaaaccccgacgcctcccccaaggagacgccggacggtgggtctgaacaaaagcactataggaaatttcctccaacagctggccatcaagtccttcggccagccccccccaagcggtgattcaggcctttccacgggggcggacgccgccaattccggcggtcggacgtcccctgatgatttggctctttcggagacaggttccatttcctccatgccccccctcgagggggagcctggggatccagacctagagcctgagcaggtagagcttcaacctcccccccaggggggggaggtagctcccggctcggactcggggtcttggtctacttgctccgaggaggatgactccgtcgtgtgctgctccatgtcatactcctggaccggggctctaataactccttgtagccccgaagaggaaaagttaccaattaaccccttgagcaactcactgttgcgatatcacaacaaggtgtactgtactacatcaaagagcgcctcattgagggctaaaaaggtaacttttgataggacgcaagtgctcgacgctcattatgactcagtcttaaaggacatcaagctggcggcctccaaagtcaacgcgaggctcctcaccgtggaggaggcgtgtcagttgactccaccccattctgcaagatccaagtatgggtttggggctaaggaggtccgcagcttgtccgggagggccgttaaccacatcaagtccgtgtggaaggacctcctggaagactcacaaacaccaattcctacgaccatcatggccaaaaatgaggtgttctgcgtggaccccaccaaggggggtaagaaagcagctcgcctcatcgtttaccctgacctcggcgttagggtttgcgagaagatggccctttatgatgtcacacaaaagcttcctcaggcggtgatgggggcttcttatggcttccagtactcccccgctcaacgggtggatttcctcttgaaggcatgggcggaaaagagagaccctatgggtttttcgtatgatacccgatgctttgactcaactgtcactgagagagacatcagaactgaggagtccatataccaagcttgttccttgcccgaggaggcccgcactgccatacattcgctgactgagagactttacgtgggaggccccatgtttaacagcaagggccagacctgcggttacaggcgttgccgcgccagcggggtgctcactactagcatggggaacaccatcacatgctatgtgaaagccctagcggcttgcaaggctgcggggatagttgcgcccacaatgctggtatgcggcgacgacttggttatcatctcagaaagccaggggactgaggaggacgagcggaacttgagagccttcacggaggctatgaccaggtattctgcccctcctggtgacccccccagaccggaatatgacttggagctgataacatcctgttcctcaaatgtgtctgtggcgttgggcccacagggccgccgcagatactacctgaccagagaccctaccactccaatcgcccgggctgcctgggaaacagtcagacactcccctgtcaattcatggctgggaaacatcatccagtacgccccaaccgtgtgggctcgcatggtcctgatgacacactttttctccattctcatggcccaagacaccctggaccagaatctcaactttgagatgtacggatcggtgtactccgtgagtcctttggacctcccagccataattgaaaggttacacgggcttgacgctttctccctgcacacatacactccccacgaactgacgcgggtggcatcagccctcagaaaacttggggcgccacccctcagagcgtggaagagtcgggcgcgtgcagtcagagcgtccctcatctcccgtggagggagggcggccgtttgcggtcggtatctcttcaactgggcggtgaagaccaagctcaaactcactccattgccggaggcacgcctcctggatttatccagttggtttaccgtcggcgccggcgggggcgacatttatcacagcgtgtcgcgtgcccgaccccgcttattactccttagcctactcctactttccgtaggggtaggcctcttcctactccccgctcgatagagcggcac

SEQ ID NO: 704 - DNA, 9416 bp, Hepatitis C Virus
atcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacactaaccgtcgcccacaagacgttaagtttccgggcggcggccagatcgttggcggagtatacttgttgccgcgcaggggccccaggttgggtgtgcgcacgacaaggaagacttcggagcggtcccagccacgtgggagacgccagcccatccccaaagatcggcgctccactggcaagtcctggggaaaaccaggatacccctggcccctatacgggaacgagggactcggctgggcaggatggctcctgtccccccgaggttctcgtccctcttggggccccaatgacccccggcataggtcgcgtaacgtgggtaaggtcatcgataccctaacgtgcggcttcgccgacctcatggggtacatccccgtcgtaggcgccccgcttggtggcgttgccagagctctcgcgcatggcgtgagggttctggaggacggggtcaattacgcaacagggaatctacctggttgctccttttctatcttcttgctggccctactgtcctgtatcaccattccagtctctgctgtccaagtgaagaacaccagcaacagctacatggtgaccaatgactgttccaatgacagcatcacctggcagcttcaggcggcggtcctccacgtccccgggtgcgtcccgtgcgagagagtgggaaatacatcacggtgctggataccggtctcaccaaatgtggctgtgcagcagcgcggcgccctcacgcagggcttgcggacgcacatcgacatggtcgtgatgtccgctacgctctgctctgctctctacgtgggggacctctgcggcggggtaatgctggcagcccagatgttcattatctcgccggagcaccactggtttgtgcaggaatgcaattgctccatctacctgggtaccatcactgggcatcgtatggcgtgggacatgatgatgaactggtcacccactaccaccatgatcctggcttacgtgatgcgcgtccccgaggtcatcatagacatcattagtggagctcattggggcgttatgttcggcctggcctacttctctatgcagggagcgtgggccaaggtcgttgtcatccttctgatgaccgctggagtggacgcgggatccaccagaattgggagtgctgtctctcataacaccgacagcttcgccggcctcctctcacccggctctaagcagaacatccagcttattaacaccaatggcagttggcacatcaaccgcaccgccctgaattgtaatgacagcttgaacaccggcttcctcgcgtccctgttctacgtcaggaacttcaactcgtcagggtgtcccgaacgcctgtcctcctgccgcagtattgaggccttccggataggatggggcactttgcaatacgaggataatgtcaccaatccagaagatatgaggccatattgctggcactatccaccacagcaatgtggcatagtccccgcgaagtccgtgtgcggcccagtgtactgtttcacccccagcccagtcgtggtgggcacgaccgatagacttggagtgcccacttacacgtggggggagaatgagacagatgttttcctgttgaacagcacccgaccaccgcgggggtcatggttcggctgcacgtggatgaactccactggtttcaccaagacttgtggcgcgccaccttgccgcattagagccgacttcaatgccagcacggaccttttgtgccccacggactgttttaggaagcatcctgacgccacttacatcaaatgtggttctgggccctggctcacgccgaggtgcctggtcgactacccttacaggctctggcactacccctgcacagttaactattccatcttcaagataaggatgtatgtaggggggattgagcacaggctcacggccgcgtgtaatttcacccgtggggatcgttgcgacttagaggacagggacaggagccaactgtcccctctgttgcactctaccacggaatgggccatcttgccctgctctttctcagacttgcccgctttgtcgactggtctactccacctccaccaaaatatcgtggacgtacaatacatgtatggcctgtcacctgcccttacaaaatatgtcgttcgatgggagtgggtagtgctcttattccttctcctagcggacgccagggtctgcgcctgcgtgtggatgcttatcttgctgggccaggcagaggcagcactagagaagctggtcgtcttgcacgctgcgagcgcagctagctgcaatggcttcctatattttgtcatctttttcgtggctgcttggtacatcaaaggtcgggtggtccccttggccacctattccctcaccggcctatggcccttttgcctactgctcctcgcactgccccaacaggcttatgcctatgatgcatctgtgcaagggcagttaggcgttagtttgttggtactgatcaccctctttacactcaccccggcgtataagaccctccttagccggtgtctgtggtggttgtgctatctcctgaccctgggggaagccatgattcaggagtgggtaccacccatgcaggcgcgtggtggccgtgatggcattatatgggctaccaccatattctgcccgggtgtggtgtttgacataaccaagtggctcctggcgctgcttgggcctggctacctcctgagaggtgctttgacgcgcgtgccgtacttcgtcagagctcacgctctgctgaggatgtgcactatggtgaggcacctcgcggggggtaggtacgtccagatggcgctgttagcctttggtaggtggactggcacttatatctatgaccacctcgcccctatgtcggattgggctgccaacggcctgcgggacttggcggtcgctgtagagcctatcatcttcagtccgatggagaagaaagtcatcgtctggggggcggagacggccgcatgcggggacatcttacatggactccccgtgtccgcccgactcggtcgggagattctccttggcccagctgacggctacacctccaaggggtggaagcttctcgcccccatcaccgcttacgcccagcagacacgaggtctcttgggcgccatagtggtgagcatgacgggacgcgacaagacagagcaggccggggaaatccaagtcctgtccacagtcacccagtccttcctcggaacatccatctcgggggtcttatggaccgtttaccacggagctggcaataagaccctagccggctcacggggcccggtcacgcagatgtactcgagtgctgaaggagacttggtagggtggcccagccctcctgggaccaaatctttggagccgtgctcgtgtggagcggtcgacctgtacctggtcacgcggaacgctgacgtcatcccggctcgaagacgcggggacaagcggggagcgttactctccccgagacctctttcgactttgaaggggtcctcggggggaccggtgctttgccccaggggccacgctgtcgggatcttccgggcagctgtgtgctctcggggcgtggctaagtccatagacttcatccccgttgaagcactcgacatcgtctcgcggtctcccacctttagtgacaacagcacaccaccagctgtgccccagacctaccaggtccggtacttgcatgctccgaccggcagtggaaaaagcaccaaagtccctgtcgcgtacgctgcccaggggtataaagtgctagtgcttaatccctcggtggctgccaccctggggtttggggcgtatttgtccaaggcacatggcatcaatcccaacattaggactggagtcagaactgtgacgaccggggcggccataacgtactccacatatggcaaattcttcgccgatgggggctgctcgggcggcgcctatgacatcatcatatgcgacgaatgccacgccgtggacgctaccaccatcctcggcatcggaacagttcttgaccaagcagagacagccggagtcaggttaactgtactggccacggccactccccctgggtcggtgacgaccccccatcccaatatagaggaggtggccctcgggcaggagggtgagatccccttctatgggagagcgcttcccctgtcttacatcaagggagggagacacttgatcttctgccattcaaagaaaaagtgtgatgagctcgcggcggcccttcggggcatgggcttgaatgctgtggcatactacagagggttggacgtctccgtaataccaactcaaggagacgtagtggttgtcgccaccgatgccctcatgacggggtatactggaaactttgactccgtgatcgactgcaacgtagcggtcactcaagtcgtagacttcagcctggaccccaccttcactataaccacacagactgtccctcaagacgctgtctcacgcagccagcgccgggggcgcacaggtagaggaagattgggtatctataggtatgtttccactggtgagcgagcctcagggatgtttgatagcgtggtgctctgtgagtgctacgacgcaggggctgcgtggtatgagcttacgccagcggagactaccgtaaggcttagagcgtatttcaacacgcctggcttgcccgtgtgccaagaccatcttgagttttgggaggcagttttcaccggcctcacacacatagatgcccacttcctttcccaaacaaagcaatcgggggagaatttcgcatacttagtagcctatcaggctacagtgtgcgctagagctaaagcccctcccccgtcctgggacgtcatgtggaagtgcctgactcgactcaagcccactctcgtgggccccacacctctcctataccgtttgggctctgttaccaacgaggtcactttcacacatcctgtgacaaaatacatcgccacatgcatgcaagctgaccttgaagtcatgaccagcacgtgggtcctagctgggggggtcttggcagccgtcgccgcatattgcttggcaaccgggtgtgtttccatcatcggccgtttgcacatcaaccagcgagccgtcgtcgcaccggacaaggaggtcctttatgaggcttttgatgaaatggaggaatgtgcctctaaagcggctctcattgaagaggggcagcggatggccgagatgctgaagtccaagatccaaggcttattgcagcaagcctctaaacaggcccaggacatacaacccgctgtggaggcttcatggcccaaagtggagcaattctgggccaaacacatgtggaacttcattagcggcattcagtacctcgcaggactgtcaacactaccagggaatcctgctgtggcttccatgatggcattcagtgctgccctcaccagtccgttatcaactagcaccactatccttctcaacattctgggaggctggctggcgtcccaaattgcgccacccgcgggggccaccggctttgtcgtcagtggcctagtgggggctgctgtaggcagcataggcctgggcaaggtgctggtggatatcctggcggggtatggcgcgggcatttcgggggccctcgtcgcattcaagatcatgtctggcgagaagccctccatggaggacgtcatcaatctgctgcctgggattttgtctccgggtgccctggtggtgggagtcatctgcgcgggcattctgcgccgccacgtggggccgggagaaggcgcggtccaatggatgaacaggctcatagcctttgcttccagaggaaaccacgtcgcccctacccattacgtgacggagtcggatgcgtcgcagcgtgtgacccaactgcttggctcccttactataactagcctactcagaagactccacaattggattactgaggactgccccatcccatgcgccggctcgtggctccgtgatgtgtgggactgggtttgcaccatcctaacagactttaaaaattggctgacctccaaattgttcccaaagctgcccggcctcccctttgtctcctgtcaaaagggttatagaggtgtgtgggccggcactggcatcatgaccacacggtgtccttgcggcgccaacatctctggcaatgttcgcctgggctctatgagaatcacagggcccaaaacctgtatgaacacttggcaggggacctttcctatcaattgttatacggagggccagtgcatgccgaaacccgcgccaaacttcaagaccgccatctggagggtggcggcctcagagtacgcggaggtgacgcggcacggggcttactcctatataacagggctgaccactgacaacttgaaagttccctgccaactaccctctccagagtttttctcctgggtggacggagtgcaaatccataggttcgctcccacaccaaagccgttttttcgggatgaggtctcgtttaccgttgggctcaattcatttgtagtcgggtctcagcttccttgtgaccctgagcccgatactgatgtattgatgtccatgctaacagatccatcccatatcacggcggaggctgcagcgcggcgcttagcgcgggggtcacccccatctgaggcaagctcctcggcgagccagctatcggcgccatcgctgcgagccacctgcaccacccacggcaagacctatgatgtggacatggtggatgccaacctgttcatggggggcgatgtgacccggatagagtctgagtccaaagtggtcgttctggactctctcgacccgatggccgaagaaaggagcgacctcgagccctcaataccatcggagtatatgctccccaggaacacgttcccgccagccttaccggcctgggcacggcctgattacaatccgccgctcgtggaatcgtggaggaggccagattaccaaccgcccactgttgcgggctgtgctctcccgcctcccaagaaaaccccgacgccccccccaaggagacgtcggacagtgggtctgagcgagagcaccataggagatgccctccagcagctggccatcaaaaccttcggccagccccctccaagcggcgattcaggcctctctacaggggcggacgccgccgactccggcggtcggacgccccctgatgagttggccctttcggagacaggttctacctcctccatgccccccctcgagggggagcctggggatccagacctggagcccgaccaggtagagcttcgacccccctcccaagggggggaggcagctcccggctcggactctgggtcctggtctacttgctccgaggaggatgactccgtcgtgtgctgctccatgtcatactcctggaccggggccctaataactccttgttgccccgaagaagaaaagttaccaatcaaccccttgagcaactccctgttgcgataccacaacaaggtgtacagtactacatcaaagagcgcctcattaagggctaaaaaggtaacttttgatagggtgcaagtgctcgacgcccactatgactcagtcttaaaggacatcaagctagcggcctccaaggtcagcgcaaagctcctcaccttggaggaggcgtgccaattgactccaccccattctgcaagatccaaatatggatatggggccaaggaggttcgcagcttgtccgggagggccgttaaccacatcaagtccgtgtggaaggacctcctggaagactcacaaacaccaattcctacgaccatcatggccaaaaatgaggtgttctgcgtggaccccaccaaggggggtaagaaagcagctcgccttatcgtttaccctgacctcagtgttagggtctgcgagaagatggccctttatgatgtcacacaaaagcttcctcaggcagtgatgggggcatcttatggattccagtactcccccgcccagcgggtggagtttctcttgaaagcatgggcggataagaaagaccctatgggtttttcgtatgacacccgatgctttgactctaccgtcactgagagagacattagaactgaggaggccatataccaggcttgctccttgcctgaggaggcccgtactgccatacactcgctgactgagagactctacgtgggagggcctatgttcaacagcaagggccagacctgcgggtacaggcgttgccgcgccagcggggtgctcaccactagcatggggaacaccatcacatgctatgtgaaggccctagcggcttgcaaagctgcggggatagttgcgcccacaatgctggtatgcggcgatgacttggttgtcatctcagaaagccaggggactgaggaggacgagcggaacctgagagccttcacggaggctatgaccaggtattccgcccctcctggtgacccccccagaccggaatatgacctggagctgataacatcctgttcctcgaatgtgtctgtggcactcggcctacagggccgccgcagatactacctgaccagagaccctaccactccaatcgcccgggctgcctgggaaacagttagacactcccctgtcaattcatggttgggaaacatcatccagtatgctccaactatatgggtccgcatggtcctgatgacacattttttctccatccttatggcccaagacactctggaccaggaccttaattttgaaatgtacggatcggtgtactccgtgagtcctctggacctcccagccataattgaaaggttacacgggcttgacgccttccttctgcacacatacactccccacgaactgacgcgggtggcttcagccctcagaaaacttggggcgccgcccctcagagcgtggaagagtcgggcacgtgcagttagagcgtccctcatctcccgtggggggagggcggccgtttgcggtcggtatctcttcaactgggcggtgaagaccaagctcaaactcactccattgccggaagcgcgcctcctggatttatccagttggttcaccgtcggcgccggcgggggcgacatttatcacagcgtgtcgcgtgcccgaccccgcttattactccttggcctactcctactttccgtaggggtaggcctcttcctactccccgctcggtagagcggcac

SEQ ID NO: 705 - DNA, 9416 bp, Hepatitis C Virus
cactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggataaacccactctatgtccggtcatttgggcgtgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaagcacaaaccgccgcccacaggacgttaagttcccgggtggcggccagatcgttggcggagtttacttgctgccgcgcaggggccccaggttgggtgtgcgcgcgacaaggaagacttctgagcgatcccagcctcgtggaagacgccagcccatcccgaaagatcggcgctccaccggcaagtcctggggaaagccaggatatccttggcccctgtacggaaacgagggttgcggctgggcaggttggctcctgtccccccgcgggtctcgtcctcattggggccccactgacccccggcatagatcacgcaatttgggcagagtcatcgataccattacgtgtggttttgccgacctcatggggtatatccctgtcgttggcgccccggtcggaggcgtcgccagagctctggcacacggtgttagggtcctggaggacgggataaattatgcaacagggaatttacccggttgctccttttctatcttcttacttgccctcctgtcatgcgtcacagtgccagtgtctgcagtggaagtcaggaacatcagttctagctactacgccactaatgactgctcgaacagcagcatcacctggcagctaaccaacgcagttctccatcttcctggatgtgtcccatgtgagaatgacaatggcactttgcgctgctggatacaagtaacacctaatgtggctgtaaaacaccgcggcgcactcactcacaacctgcgaacgcacgtcgacatgatcgtaatggcagctacggtctgctcggccttgtacgtgggagatgtgtgcggagccgtgatgatcgtgtcgcaggctctcatagtatcgccagaacgccacaacttcacccaagagtgcaattgttccatctaccaaggtcatatcaccggccaccgcatggcatgggacatgatgctgaactggtcaccaactcttaccatgatcctcgcctacgctgctcgcgttcccgagctggcccttgaaattgtctttggcggccactggggtgtggcgtttggcttggcctatttctccatgcagggagcgtgggccaaagtcattgccatcctccttcttgtcgcgggagtggatgcaaccacctattccaccggcgcgcaagtgggtcaaaccgtttcggggttcgctggcatgtttagatctggttccaggcagaacatccagttaatcaacaccaatggcagctggcacataaaccggaccgccctcaattgcaatgacagcttacagacgggtttcatggcttccctgttttacgccaagagattcaacagctctggctgccccgagcgcttgtcttcctgccgcaggctggatgattttcgcatcgggtggggaaccttggaatacgagactaatgtgaccaacgatgaggacatgaggccgtactgttggcattaccccccgaagccttgcggtatcgtctcggataagacggtttgcggcccgttttattgttatactcctagccctgttgtcgtaggcaccagtgacaagcagggcgtacccacctacagctggggggaaaatgagaccgatgtattcctgataaatagcacaagacccccgcgaggagataggttcggttgcacttggatggacgagactgggttcactaagacatgcggagcaccaccttgccgcattaggagggactacaacagcagtatcgatttattgtgccccacagactgttttaggaagcacccaggtgctacatatattaaatgtggagcagggccttggttgacccccaggtgcgtggtagattacccctatagactgtggcattatccatgcaatgtaaattttaccatcttcaaggtgcggatgtatgtagggggggtggagcatcgattgaccgcagcatgctacttcacgcgcggagaccgctgccaattggaagatagggataggggtcagcagagtccactgctgcattccaccactgagtgggcggtgttgccatgcacctactccgacctgccggcactatctactggcctattgcacctccaccaaaacatcgtggacgtgcagtacctctatggactttctccggctgtcacaagatacatcgtgaagtgggaatgggtggtcctacttttcttgttgttggcagacgccaggatctgcgcatgcctttggatgctcatcatactggcccaagccgaggcggcgcttgagaagctcatcatcttgcactccgctagcgctgctagtgccaatgggccactgtggttcttcatcttcttcacagcggcctggtacttaaagggcagggtggtccccgtggccacgtactctgttctcggcttgtggtccttcctcctcctagtcctggccctaccacagcaggcttatgccttggacatcgctgaacaaggggaattagggctggccatattagcaatcatatccatctttactcttaccccagcatataagattctcctgagccgttcagtgtggtggctgtcctacatgctggtcttggccgaggcccagattcagcaatgggtcccccccctggaagcccgaggggggcgtgacgggatcatctgggtggctgtcattctacacccacgccttgtgttcgaggtcacgaaatggttgttagcacttctggggcctgcctacctccttaaagcgtccctgctacgggtgccatacttcgtgagggctcacgctctgctacgaatgtgtaccctggtgagacacctcgcaggagctaggtacgtccagatgctgttgatcaccatgggcaggtggaccggcacttacatctatgaccacctctcccctttatcaacttgggcagcccagggtttgcgggacttggcagtcgccgtggagcctgtggtgttcagcccgatggagaagaaggtcattgtgtggggggctgagacagtggcatgtggagacatcctgcatggcctcccggtttccgcgaggctaggtagagaggttctgctcggccctgccgatagctacacctcgaaggggtggaagctcctagctcccattactgcctacactcagcagactcgtggcctcctgggtgctatcgtggtcagcctaacgggccgcgacaagaacgagcaggctggacaagtccaggttctgtcttccgtcacacaatctttcttgggaacatctatttcgggggtcctctggacggtatatcacggagctggcaataagaccttggctggccccaaaggaccagtcactcagatgtacaccagcgcagagggggacctcgtgggatggcctagcccccccgggactaagtcgttagacccctgtacctgtggggccgtggacctctacctggtcacccgaaacgctgatgtcattccggtccggaggaaagatgaccgacggggtgcactactctcgccgaggcctctctcaaccctcaaaggatcatccggcggacccgtgctctgctctaggggacatgccgtgggcttgttcagggcggccgtgtgtgctaggggtgtggccaaatctattgacttcatccctgttgaatctctcaatatcgccacaaggacgcccagcttctctgacaacagcacaccaccagctgtgccccagtcttaccaggtgggctacttgcatgcaccaacgggtagcgggaaaagcaccaaggtccctgccgcatatgccagtcaggggtataaagtactcgtactaaatccctctgtcgcggccacacttggttttggggcctacatgtccaaagcccacgggatcaacccccacatcagaaccggagtacggactgtgaccaccggggactctatcacctactccacttatggcaagttcatcgcggatggaggctgctcagctggcgcctatgatgtcatcatatgcgacgaatgccattcagtggacgctactaccatccttggcattggaacagtcctcgaccaggctgagaccgcaggtgtcaggctagtggttctagccacagccacacctcccggcacggtgacaacaccccacagtaacatagaggaggtggcccttggtcatgagggcgagatccccttttatggcaaggctattcccctagctttcatcaaggggggtagacacctaatcttttgccattcaaggaagaagtgcgacgagctcgcagcggcccttcggggcatgggtgtcaatgctgtcgcctactacaggggtctcgacgtctccgttataccaactcaaggagacgtggtggtcgtcgccaccgatgccctaatgactggatacaccggggactttgactctgtcatcgattgcaacgtcgcggtaactcagattgttgactttagcctagacccgacctttaccatcaccactcaaaccgtccctcaggatgctgtctcccgcagtcaacgtagagggagaactgggagggggcgactgggcatttacaggtatgtctcatcaggcgagaggccgtctgggatgttcgacagcgtagtgctctgtgagtgctatgatgccggggcagcctggtacgagcttacgcctgctgagactacggtgagactccgggcttatttcaacacgcccggtttacccgtgtgtcaagaccacttggaattctgggaagcggtcttcacgggtctcacacacattgatgcccacttcctctcccagacgaagcaaggaggagacaactttgcgtatctgacggcctatcaggccacagtatgcgctagagcaaaggctcctcctccttcgtgggacgtgatgtggaagtgtctaactaggcttaaacctacactgactggtcctacccccctcctctaccgcttgggtgccgtgaccaacgaggttaccctgacgcaccccgtgacgaaatatatcgccacgtgcatgcaggctgacctcgagatcatgacgagctcatgggttctggcagggggggtgctagccgccgtggcagcttactgcctggcgaccggctgcatttccatcattggccgcttacacctgaatgatcaggtagttgtggcccctgacaaggaaatcttatatgaggcctttgatgagatggaagaatgcgcctccaaagccgccctcatcgaggaagggcagcggatggcggagatgctcaagtctaaaatacaaggcctcctacaacaggccacaagacaagcccaagacatacacccagctatacagtcatcatggcccaagcttgaacaattttgggccaaacatatgtggaacttcatcagtggtattcagtacctggcgggactctccaccctaccgggaaatcccgcagtggcatcaatgatggctttcagcgccgcattgactagcccattacccaccagcaccaccatcctcttgaacatcatggggggatggttggcctcccagattgccccccccgctggagccactggcttcgttgtcagtggcctggtgggggcggccgtcggaagcataggcctgggtaagatactggtggacgttttggctgggtacggtgcaggcatttcaggggctctcgtagcttttaaaatcatgagcggcgagaagccctcggtagaagatgttgtaaatctcctgcccgctatcctgtctcctggcgctttggtagtgggagtcatctgtgcagcgatcctgcgccgccacgtcggccagggagagggggcggtccagtggatgaacagactgatcgcctttgcctccagaggaaaccacgttgcccctacccactacgtggcggagtctgacgcttcgcagcgcgtgacgcagctgctaggttcgctcacaattaccagcttactcaggagactacatgcctggatcactgaagactgcccagtcccatgttcggggtcttggctccgggacgtttgggattgggtttgttccattctcacagactttaagaactggctgtcttcaaaattgctccccaagatgcctggtcttcccttcatctcttgccaaaagggatacaggggtgtatgggctggcacgggagtcatgactacacggtgtccatgcggagcgaacatctcgggccatgtccgcatgggtaccatgaaaataacaggcccgaagacctgcttgaacctgtggcagggaaccttccccattaattgctacacagaagggccttgcgtgccaaaaccccctcctaattataagaccgcaatttggagggtggcagcgtcagagtacgtcgaggtcacgcagcatggctctttctcgtatgtaacggggttaaccagtgacaaccttaaagtcccctgccaggtaccagctccagaattcttctcttgggtggacggggtgcagatacatcgattcgcccccactccaggtcctttctttcgggatgaggtaacgttcaccgtaggcctcaattcctttgtggtcggctctcagctcccctgtgaccctgaaccggacaccgaggtattggcctccatgttgacagacccgtcccacattaccgcggaggcggcagccaggcggttggccaggggatctcccccttcacaggccagttcttcagcgagccagctctccgccccgtccttgaaggctacctgtaccacccataagatggcatatgattgtgacatggtggatgccaaccttttcatgggaggtgatgtgacccggactgagtccgactctaaagtgatcgttctcgactcccttgattccatgactgaggtagaggatgatcgtgagccttccataccatcagagtacctgatcaagaggagaaagttcccaccggcactacctccctgggcccgtccagaatacaaccctcctgtgatcgagacatggaagaggccggactatgaaccacccactgtcctaggctgtgcccttccccccacacctcaagcgccagtgcccccaccgcggaggcgccgcgccaaagtcctgactcaggacaatgtggagggagttctcagggagatggcaaacaaagtgctcagccctctccaagaccacaatgactccggtcactccactggagcggataccggaggagacagcgtccagcagccctctgacgagactgccgtttcagacacgggatcactgtcctccatgcccccccttgagggagagccgggggaccctgacctagagtttgatccaacgggatccgcccccccttctgagggggagtgtgaggtcattgattcggactctaagtcgtggtccacagtctctgatcaagaggattccgtcatctgctgctccatgtcatactcctggacaggggccctcataacaccatgtgggcccgaggaggagaagttgcctattaaccctctgagcaattcgctcatgcggttccataacaaggtgtactccacaacctcgaggagtgcctctctgagggcaaagaaggtgacctttgacagggtgcaggtgctggacacacactatgactcagtcttgcaggacgttaagcgggccgcctccaaggttagtgcgaggctcctctcagtagaggaagcttgcgcgctgaccccgccccattccgccaaatcacgctacggatttggggcaaaggaggtgcgcagcttatccaggagggccgtcaaccacatccggtccgtgtgggaggacctcctggaagaccaacatactccaattgacacaattgtcatggccaaaaatgaggtgttttgcgtcgatcccactaaaggcgggaaaaagccagctcgcctgatcgtataccccgaccttggggtcagggtgtgcgaaaagatggccctctatgacatcgcacagaagcttcccaaagcaataatggggccatcctatgggttccaatactctcctgcagaacgggtcgattttctcctcaaagcttggagaagtaagaaggacccaatggggttctcatatgacacccgctgctttgactcaaccgtcacggagagggatataagaacagaagaatccatatatcaggcttgttccctgcctcaagaggccagaactgtgatacactcgctcactgagagactctacgtaggagggcccatgacaaacagcaagggacaatcctgcggttacaggcgttgccgcgcgagcggcgttttcactaccagcatggggaataccatgacatgttacatcaaagctctcgcagcatgtaaggctgcagggatcatggaccctatcatgctggtgtgtggagacgacctggtcgtcatctcagagagccaaggtaacgaggaggacgagcgaaacctgagagtcttcacggaggctatgaccaggtattccgcccctcccggtgaccttcccagaccagaatatgacttggagcttataacatcctgctcctcaaacgtatcggtagcgctggaccctcggggtcgccgccggtacttcctaactagagaccctaccactccaatcacccgagctgcttgggaaacagtaagacactcccctgtcaattcttggctgggcaacatcatccagtacgcccctacaatctgggtccggatggtcataatgacccacttcttttccatactattggcccaggacactctgaaccaaaatctcaattttgagatgtatggggcagtatattcggtcaatccattagacctaccggccataattgaaaggctacatgggcttgatgccttctcactgcacacatactctccccacgaactctcacgggtggcagcaactctcagaaaacttggagcgcctccccttagagcgtggaagagtcgggcgcgtgctgtgagggcctcactcatcgcccagggagggagggcggccacttgtggccgctatctcttcaactgggcggtgaagacaaagctcaaactcactccattgcccgaggcgagccgcctggatttatccgggtggttcaccgtgggcgccggcgggggcgacatctttcacagcgtgtcgcatgcccgaccccgcctgttactcctttgcctactcctactcagcgtaggagtaggcatctttttactccccgctcggtagagcggcaaac

SEQ ID NO: 706 - DNA, 9618 bp, Hepatitis C Virus
gccagccccctgatgggggcgacactccaccatgaatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggataaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcacgtcggcccgagggcaggacctgggctcagcccgggtacccttggcccctctatggcaatgagggctgcgggtgggcgggatggctcctgtctccccgtggctctcggcctagctggggccccacagacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttctggaagacggcgtgaactatgcaacagggaaccttcctggttgctctttctctatcttccttctggccctgctctcttgcttgactgtgcccgcttcggcctaccaagtgcgcaactccacggggctttaccacgtcaccaatgattgccctaactcgagtattgtgtacgaggcggccgatgccatcctgcacactccggggtgcgtcccttgcgttcgcgagggcaacgcctcgaggtgttgggtggcgatgacccctacggtggccaccagggatggcaaactccccgcgacgcagcttcgacgtcacatcgatctgcttgtcgggagcgccaccctctgttcggccctctacgtgggggacctgtgcgggtctgtctttcttgtcggccaactgttcaccttctctcccaggcgccactggacgacgcaaggttgcaattgctctatctatcccggtcatataacgggtcaccgcatggcatgggatatgatgatgaactggtcccctacgacggcgttggtaatggctcagctgctccgcatcccacaagccatcttggacatgatcgctggtgctcactggggagtcctggcgggcatagcgtatttctctatggtgggaaactgggcgaaggtcctggtagtgctgctgctatttgccggcgtcgacgcggaaacccacgtcaccgggggaagtgccggccacactgtgtctggatctgttagcttcctcgcaccaggcgccaagcagaatgtccagctgatcaacaccaacggcagttggcacctcaatagcacggccctgaactgcaatgatagccttaacaccggctggttggcagggcttttctatcaccacaagttcaactcttcaggctgccctgagaggctagccagctgccgaccccttaccgattttgaccagggctggggccctatcagttatgccaacggaagcggccccgaccagcgcccctactgctggcactaccccccaaaaccttgcggtattgtgcccgcgaagagtgtgtgtggtccggtatattgcttcactcccagccccgtggtggtgggaacgaccgacaggtcgggcgcgcctacctacagctggggtgaaaacgatacggacgttttcgtccttaacaataccaggccaccgctgggcaattggttcggttgtacctggatgaactcaactggattcaccaaagtgtgcggagcgcctccttgtgtcatcggaggggcgggcaacaacaccctgcactgccccactgattgcttccgcaagcatccggacgccacatactctcggtgcggctccggtccctggatcacacccaggtgcctggtcgattacccgtataggctttggcattatccttgtaccatcaactacaccatatttaaaattaggatgtacgtgggaggggtcgagcacaggctggaagctgcctgcaactggacgcggggcgaacgttgcgatctggaagatagggacaggtccgagctcagcccgttactgctgaccactacacagtggcaggtcctcccgtgttccttcacaaccctgccagccttgtccaccggcctcatccacctccaccagaacattgtggacgtgcagtacttgtacggggtggggtcaagcatcgcgtcctgggccattaagtgggagtacgtcgttctcctgttccttctgcttgcagacgcgcgcgtctgctcctgcttgtggatgatgctactcatatcccaagcggaggcggctttggagaacctcgtaatacttaatgcagcatccctggccgggacgcacggtcttgtatccttcctcgtgttcttctgctttgcatggtatctgaagggtaagtgggtgcccggagcggtctacaccttctacgggatgtggcctctcctcctgctcctgttggcgttgccccagcgggcgtacgcgctggacacggaggtggccgcgtcgtgtggcggtgttgttctcgtcgggttgatggcgctgactctgtcaccatattacaagcgctatatcagctggtgcttgtggtggcttcagtattttctgaccagagtggaagcgcaactgcacgtgtggattccccccctcaacgtccgaggggggcgcgacgccgtcatcttactcatgtgtgctgtacacccgactctggtatttgacatcaccaaattgctgctggccgtcttcggacccctttggattcttcaagccagcttgcttaaagtaccctactttgtgcgcgtccaaggccttctccggttctgcgcgttagcgcggaagatggccggaggccattacgtgcaaatggtcatcattaagttaggggcgcttactggcacctatgtttataaccacctcactcctcttcgggactgggcgcacaacggcttgcgagatctggccgtggctgtagagccagtcgtcttctcccaaatggagaccaagctcatcacgtggggggcagataccgccgcgtgcggtgacatcatcaacggcttgcctgtttccgcccgcaggggccgggagatactgctcgggccagccgatggaatggtctccaaggggtggaggttgctggcgcccatcacggcgtacgcccagcagacaaggggcctcctagggtgcataatcaccagcctaactggccgggacaaaaaccaagtggagggtgaggtccagattgtgtcaactgctgcccaaaccttcctggcaacgtgcatcaatggggtgtgctggactgtctaccacggggccggaacgaggaccatcgcgtcacccaagggtcctgtcatccagatgtataccaatgtagaccaagaccttgtgggctggcccgctccgcaaggtagccgctcattgacaccctgcacttgcggctcctcggacctttacctggtaacgaggcacgccgatgtcattcccgtgcgccggcggggtgatagcaggggcagcctgctgtcgccccggcccatttcctacttgaaaggctcctcggggggtccgctgttgtgccccgcggggcacgccgtgggtatatttagggccgcggtgtgcacccgtggagtggctaaggcggtggactttatccctgtggagaacctagagacaaccatgaggtccccggtgttcacggataactcctctccaccagtagtgccccagagcttccaggtggctcacctccatgctcccacaggcagcggcaaaagcaccaaggtcccggctgcatatgcagctcagggctataaggtgctagtactcaacccctctgttgctgcaacactgggctttggtgcttacatgtccaaggctcatgggatcgatcctaacatcaggaccggggtgagaacaattaccactggcagccccatcacgtactccacctacggcaagttccttgccgacggcgggtgctcggggggcgcttatgacataataatttgtgacgagtgccactccacggatgccacatccatcttgggcatcggcactgtccttgaccaagcagagactgcgggggcgagactggttgtgctcgccaccgccacccctccgggctccgtcactgtgccccatcccaacatcgaggaggttgctctgtccaccaccggagagatccctttttacggcaaggctatccccctcgaagtaatcaagggggggagacatctcatcttctgtcattcaaagaagaagtgcgacgaactcgccgcaaagctggtcgcattgggcatcaatgccgtggcctactaccgcggtcttgacgtgtccgtcatcccgaccagcggcgatgttgtcgtcgtggcaaccgatgccctcatgaccggctataccggcgacttcgactcggtgatagactgcaatacgtgtgtcacccagacagtcgatttcagccttgaccctaccttcaccattgagacaatcacgctcccccaggatgctgtctcccgcactcaacgtcggggcaggactggcagggggaagccaggcatctacagatttgtggcaccgggggagcgcccctctggcatgttcgactcgtccgtcctctgtgagtgctatgacgcaggctgtgcttggtatgagctcacgcccgccgagactacagttaggctacgagcgtacatgaacaccccggggcttcccgtgtgccaggaccatcttgaattttgggagggcgtctttacaggcctcactcatatagatgcccactttctatcccagacaaagcagagtggggagaaccttccttacctggtagcgtaccaagccactgtgtgcgctagggctcaagcccctcccccatcgtgggaccagatgtggaagtgtttgattcgcctcaagcccaccctccatgggccaacacccctgctatacagactgggcgctgttcagaatgaaatcaccctgacgcacccagtcaccaaatacatcatgacatgcatgtcggccgacctggaggtcgtcacgagcacctgggtgctcgttggcggcgtcctggctgctttggccgcgtattgcctgtcaacaggctgcgtggtcatagtgggcagggtcgtcttgtccgggaagccggcaatcatacctgacagggaagtcctctaccaagagttcgatgagatggaagagtgctctcagcacttaccgtacatcgagcaagggatgatgctcgccgagcagttcaagcagaaggccctcggcctcctgcagaccgcgtcccgtcaggcagaggttatcgcccctgctgtccagaccaactggcaaaaactcgagaccttctgggcgaagcatatgtggaacttcatcagtgggatacaatacttggcgggcttgtcaacgctgcctggtaaccccgccattgcttcattgatggcttttacagctgctgtcaccagcccactaaccactagccaaaccctcctcttcaacatattgggggggtgggtggctgcccagctcgccgcccccggtgccgctactgcctttgtgggcgctggcttagctggcgccgccatcggcagtgttggactggggaaggtcctcatagacatccttgcagggtatggcgcgggcgtggcgggagctcttgtggcattcaagatcatgagcggtgaggtcccctccacggaggacctggtcaatctactgcccgccatcctctcgcccggagccctcgtagtcggcgtggtctgtgcagcaatactgcgccggcacgttggcccgggcgagggggcagtgcaatggatgaaccggctgatagccttcgcctcccgggggaaccatgtttcccccacgcactacgtgccggagagcgatgcagctgcccgcgtcactgccatactcagcagcctcactgtaacccagctcctgaggcgactgcaccagtggataagctcggagtgtaccactccatgctccggttcctggctaagggacatctgggactggatatgcgaggtgttgagcgactttaagacctggctaaaagctaagctcatgccacagctgcctgggatcccctttgtgtcctgccagcgcgggtataagggggtctggcgaggggacggcatcatgcacactcgctgccactgtggagctgagatcactggacatgtcaaaaacgggacgatgaggatcgtcggtcctaggacctgcaggaacatgtggagtgggaccttccccattaatgcctacaccacgggcccctgtaccccccttcctgcgccgaactacacgttcgcgctatggagggtgtctgcagaggaatacgtggagataaggcaggtgggggacttccactacgtgacgggtatgactactgacaatcttaaatgcccgtgccaggtcccatcgcccgaatttttcacagaattggacggggtgcgcctacataggtttgcgcccccctgcaagcccttgctgcgggaggaggtatcatttagagtaggactccacgaatacccggtagggtcgcaattaccttgcgagcccgaaccggacgtggccgtgttgacgtccatgctcactgatccctcccatataacagcagaggcggccgggcggaggttggcgaggggatcacccccctctgtggccagctcctcggctagccagctatccgctccatctctcaaggcaacttgcaccgctaaccatgactcccctgatgctgagctcatagaagccaacctcctatggaggcaggagatgggcggcaacatcaccagggttgagtcagaaaacaaagtggtgattctggactccttcgatccgcttgtggcggaggaggacgagcgggagatctccgtacccgcagaaatcctgcggaagtctcggagattcgcccaggccctgcccgtttgggcgcggccggactataaccccccgctagtggagacgtggaaaaagcccgactacgaaccacctgtggtccatggctgtccgcttccacctccaaagtcccctcctgtgcctccgcctcggaagaagcggacggtggtcctcactgaatcaaccctatctactgccttggccgagcttgccatcaaaagctttggcagctcctcaacttccggcattacgggcgacaatacgacaacatcctctgagcccgccccttctggctgcccccgcgactccgacgctgagtcctattcctccatgccccccctggagggggagcctggggatccggatcttagcgacgggtcatggtcaacggtcagtagtgaggccagcgcggaggatgtcgtgtgctgctcaatgtcttactcttggacaggcgcactcgtcaccccgtgcgccgcggaagaacagaaactgcccatcaatgcactgagcaactcgttgctacgtcaccacaacttggtgtattccaccacctcacgcagtgcttgccaaaggcagaagaaagtcacatttgacagactgcaagttctggacagccattaccaggacgtgctcaaggaggttaaagcagcggcgtcaaaagtgaaggctaacttgctatccgtagaggaagcttgcagcctgacgcccccacactcagccaaatccaagtttggttatggggcaaaggacgtccgttgccatgccagaaaggccgtaacccacatcaactccgtgtggaaagaccttctggaagacaatgtaacaccaatagacactaccatcatggctaagaacgaggttttctgcgttcagcctgagaaggggggtcgtaagccagctcgtctcatcgtgttccccgatctgggcgtgcgcgtgtgcgaaaagatggctttgtacgacgtggttaccaagctccccttggccgtgatgggaagctcctacggattccaatactcaccaggacagcgggttgaattcctcgtgcaagcgtggaagtccaagaaaaccccaatggggttctcgtatgatacccgctgctttgactccacagtcactgagagcgacatccgtacggaggaggcaatctaccaatgttgtgacctcgacccccaagcccgcgtggccatcaagtccctcaccgagaggctttatgttgggggccctcttaccaattcaaggggggagaactgcggctatcgcaggtgccgcgcgagcggcgtactgacaactagctgtggtaacaccctcacttgctacatcaaggcccgggcagcctgtcgagccgcagggctccaggactgcaccatgctcgtgtgtggcgacgacttagtcgttatctgtgaaagcgcgggggtccaggaggacgcggcgagcctgagagccttcacggaagctatgaccaggtactccgccccccccggggaccccccacaaccagaatacgacttggagctcataacatcatgctcctccaacgtgtcagtcgcccacgacggcgctggaaagagggtctactacctcacccgtgaccctacaacccccctcgcgagagctgcgtgggagacagcaagacacactccagtcaattcctggctaggcaacataatcatgtttgcccccacactgtgggcgaggatgatactgatgacccatttctttagcgtccttatagccagggaccagcttgaacaggccctcgattgcgagatctacggggcctgctactccatagaaccactggatctacctccaatcattcaaagactccatggcctcagcgcattttcactccacagttactctccaggtgaaatcaatagggtggccgcatgcctcagaaaacttggggtaccgcccttgcgagcttggagacaccgggcccggagcgtccgcgctaggcttctggccagaggaggcagggctgccatatgtggcaagtacctcttcaactgggcagtaagaacaaagctcaaactcactccaatagcggccgctggccagctggacttgtccggctggttcacggctggctacagcgggggagacatttatcacagcgtgtctcatgcccggccccgctggttttggttttgcctactcctgcttgctgcaggggtaggcatctacctcctccccaaccgatgaaggttggggtaaacactccggcctcttaggccatttcctgtttttttttttttttgtttttttttttttttttttttttttttttttttttttttttttttttttttttttcctttcctttttttttttttttccctttttatggtggctccatcttagccctagtcacggctagctgtgaaaggtccgtgagccgcatgactgcagagagtgctgatactggcctctctgcagatcatgt

SEQ ID NO: 707 - DNA, 9365 bp, Hepatitis C Virus
ttgggggcgacactccaccatgaatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggataaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaaccccaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcacgtcggcccgagggcaggacctgggctcagcccgggtacccttggcccctctatggcaatgagggttgcgggtgggcgggatggctcctgtctccccgtggctctcggcctagctggggccccacagacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttctggaagacggcgtgaactatgcaacagggaaccttcctggttgctctttctctatcttccttctggccctgctctcttgcctgaccgtgcccgcttcagcctaccaagtgcgcaattcctcggggctttaccatgtcaccaatgattgccctaattcgagtattgtgtacgaggcggccgatgccatcctacacactccggggtgtgtcccttgcgttcgcgagggtaacgcctcgaggtgttgggtggcggtgacccccacggtggccaccagggacggcaaactccccacaacgcagcttcgacgtcatatcgatctgctcgtcgggagcgccaccctctgctcggccctctacgtgggggacctgtgcgggtctgtctttcttgttggtcaactgtttaccttctctcccaggcgccactggacgacgcaagactgcaattgttctatctatcccggccatataacgggtcatcgtatggcatgggatatgatgatgaactggtcccctacggcagcgttggtggtagctcagctgctccggatcccacaagccatcttggacatgatcgctggtgcccactggggagtcctggcgggcatagcgtatttctccatggtggggaactgggcgaaggtcctggtagtgctgctgctatttgccggcgttgacgcggaaacccacgtcaccgggggaagtgccggccacaccacggctgggcttgttcgtctcctttcaccaggcgccaagcagaacatccaactgatcaacaccaacggcagttggcacatcaatagcacggccttgaactgcaatgaaagccttaacaccggctggttagcagggctcttctatcaccacaaattcaactcttcaggttgtcctgagaggttggccagctgccgacgccttaccgattttgcccagggcgggggtcctatcagttacgccaacggaagcggcctcgatgaacgcccctactgctggcactaccctccaagaccttgtggcattgtgcccgcaaagagcgtgtgtggcccggtatattgcttcactcccagccccgtggtggtgggaacgaccgacaggtcgggcgcgcctacctacagctggggtgcaaatgatacggatgtctttgtccttaacaacaccaggccaccgctgggcaattggttcggttgcacctggatgaactcaactggattcaccaaagtgtgcggagcgcccccttgtgtcatcggaggggtgggcaacaacaccttgctctgccccactgattgcttccgcaagcatccggaagccacatactctcggtgcggctccggtccctggattacacccaggtgcatggtcgactacccgtataggctttggcactatccttgtaccatcaattacaccatattcaaagtcaggatgtacgtgggaggggtcgagcacaggctggaagcggcctgcaactggacgcggggcgaacgctgtgatctggaagacagggacaggtccgagctcagcccgttactgctgtccaccacgcagtggcaggtccttccgtgttctttcacgaccctgccagccttgtccaccggcctcatccacctccaccagaacattgtggacgtgcagtacttgtacggggtagggtcaagcatcgcgtcctgggctattaagtgggagtacgtcgttctcctgttccttctgcttgcagacgcgcgcgtttgctcctgcttgtggatgatgttactcatatcccaagcggaggcggctttggagaacctcgtaatactcaatgcagcatccctggccgggacgcacggttttgtgtccttcctcgtgttcttctgctttgcgtggtatctgaagggtaggtgggtgcccggagcagcctacgccctctacgggatatggcctctcctcctgctcctgctggcgttgcctcagcgggcatacgcactggacacggaggtggccgcgtcgtgtggcggcgttgttcttgtcgggttaatggcgctgactctgtcgccatactacaagcgctatatcagctggtgcatgtggtggcttcagtattttctgaccagagtagaagcgcaactgcacgtgtgggttccccccctcaacgttcggggggggcgcgatgccgtcatcttactcatgtgtgctgtacacccgactctggtatttgacatcaccaaactactcctggccatcttcggacccctttggattcttcaagccagtttgcttaaagtcccctacttcgtgcgcgttcaaggccttctccggatctgcgcgctagcgcggaagatagccggaggtcattacgtgcaaatgatcttcatcaagttaggggcgcttactggcacctatgtgtataaccatctcacccctcttcgagactgggcgcacaacggcttgcgagatctggccgtggctgtggaaccagtcgtcttctcccgaatggagaccaagctcatcacgtggggggcagataccgccgcgtgcggtgacatcatcaacggcttgcccgtctctgcccgtaggggccaggagatactgcttggaccagccgacggaatggtctccaaggggtggaggttgctggcgcccatcacggcgtacgcccagcagacgagaggcctcctagggtgtataatcaccagcctgactggccgggacaagaaccaagtggagggtgaggtccagatcgtgtcaactgctacccaaaccttcctggcaacgtgcatcaatggggtatgctggactgtctaccacggggccggaacgaggaccatcgcatcacccaagggtcctgtcatccagatgtataccaatgtggaccaagaccttgtgggctggcccgctcctcaaggttcccgctcattgacaccctgcacctgcggctcctcggacctttacctggtcacgaggcacgccgatgtcattcctgtgcgccggcaaggtgatagcaggggtagcctgctttcgccccggcccatttcctacttgaaaggctcctcggggggtccgctgttgtgccccgcgggacacgccgtgggcctattcagggccgcggtgtgcacccgtggagtggctaaggcggtggactttatccctgtggagaacctagagacaaccatgagatccccggtgttcacggacaactcctctccaccagcagtgccccagagcttccaggtggcccacctgcatgctcccaccggcagcggtaagagcaccaaggtcccggctgcgtacgcagctcagggctataaggtgttggtgctcaacccttctgttgctgcaacgctgggctttggcgcttacatgtccaaggcccatggggtcgatcctaatatcaggaccggggtgagaacaattaccactggcagccctatcacgtactccacctacggcaagttccttgccgacggcgggtgctcaggaggtgcttatgacataataatttgtgacgagtgccactccacggatgccacatccatcttgggcatcggcactgtccttgaccaagcagagactgcgggggcgagattggttgtgctcgccactgctacccctccgggctccgtcactgtgccccatcctaacatcgaggaggttgctctgtccaccaccggagagatccctttttacggcaaggccatccctctcgaggtgatcaaggggggaagacatctcatcttctgtcactcaaagaagaagtgcgacgagctcgccgcgaagctggtcgcactgggcatcaatgccgtggcctactaccgcggtcttgacgtgtctgtcatcccggccagcggcgatgttgtcgtcgtgtcgaccgatgctctcatgactggctttactggcgacttcgaccctgtgatagactgcaacacgtgtgtcactcagacagtcgatttcagccttgaccctacctttaccattgagacaaccacgctcccccaggatgctgtctccaggactcaacgccggggcaggactggcagggggaagccaggcatctacagatttgttgcaccgggggagcgcccctccggcatgttcgactcgtccgtcctctgtgagtgctatgacgcgggctgtgcttggtatgagctcacgcccgccgagactacagttaggctacgagcgtacatgaacaccccggggcttcccgtgtgccaggaccatcttgaattttgggagggcgtctttacgggcctcactcatatagatgcccactttctatcccagacaaagcagagcggggagaactttccttacctggtagcgtaccaagccaccgtgtgcgctagggctcaagcccctcccccatcgtgggaccagatgtggaagtgtttgatccgccttaaacccaccctccatgggccaacacccctgctatacagactgggcgctgttcagaatgaaatcaccctgacgcacccagtcaccaaatacatcatgacatgcatgtcggccaacccggaggtcgtcacgagcacctgggtgctcgttggcggcgtcctggctgctctggccgcgtattgcctgtcaacaggctgcgtggtcatagtgggcaggattgtcttgtccgggaagccggcaattatacctgacagggaggttctctaccaggagttcgatgagatggaagagtgctctcagcacttaccgtacatcgaacaagggatgatgctcgctgagcagttcaagcaggaggccctcggcctcctgcagaccgcgtcccgccaagcagaggttatcacccctgctgtccagaccaactggcagaaactcgaggccttctgggcgaagcacatgtggaatttcatcagtgggacacaatacttggcgggcctgtcaacgctgcctggtaaccccgccattgcttcattgatggcttttacagctgccgtcaccagcccactaaccactagccaaaccctcctcttcaacatattgggggggtgggtggctgcccagctcgccgcccccggtgccgctaccgcctttgtgggcgctggcttagctggcgccgccatcggcagcgttggactggggaaggtcctcgtggacatacttgcggggtatggcgcgggcgtggcgggagcccttgtggcattcaagatcatgagcggtgaggtcccctccacggaggacctggtcaatctgctgcccgccatcctctcgcctggagcccttgtagtcggtgtggtctgcgcagcaatactgcgccggcacgttggcccgggcgagggggcagtgcaatggatgaaccggctaatagccttcgcctcccgggggaaccatgtctcccccacgcactacgtgccggagagcgatgcagccgcccgcgtcactgccatactcagcaacctcactgtaacccagctcctgaggcgactgcatcagtggataggctcggagtgtaccactccatgctccggttcctggctaagggacatctgggactggatatgcgaggtgctgagcgactttaagacctggctgaaagccaagctcatgccacaactgcctgggattccctttgtgtcctgccagcgcgggtataggggggtctggcgaggagacggcattatgcacactcgctgccactgtggggctgagatcactggacatgtcaaaaacgggacgatgaggatcgtcggtcctaggacctgcaggaacatgtggagtgggacgttccccattaacgcctacaccacgggcccctgtactccccttcctgcgccgaactataagttcgcgctgtggagggtgtctgcagaggaatacgtggagataaggcgggtgggggacttccactacgtatcgggcatgactactgacaatcttaaatgcccgtgccagatcccatcgcccgaatttttcacagaattggacggggtgcgcctacataggtttgcgcccccctgcaagcccttgctgcgggaggaggtatcattcagagtaggactccacgagtacccggtggggtcgcaactaccttgcgagcccgaaccggacgtagccgtgttgacgtccatgctcactgatccctcccatataacagcagaggcggccgggaggaggttggcgagagggtcacccccttctatggccagctcctcggctagccagctgtccgctccatctctcaaggcaacttgcaccaccaaccatgactcccctgacgccgagctcatagaggctaacctcctgtggaggcaggagatgggcggcaacatcaccagggttgagtcagagaacaaagtggtgattctggactccttcgatccgcttgtggcagaggaggatgagcgggaggtctccgtacccgcagaaattctgcggaagtctcagagattcgcccgggccctgcccgtttgggcgcggccggactacaaccccccgctaatagagacgtggaaagagcctgactacgaaccacctgtggtccatggctgcccgttaccacctccacggtcccctcctgtgcctccgcctcggaaaaagcgtacggtggtcctcaccgaatcaaccctatctactgccttggccgagcttgccaccaaaagttttggcagctcctcaacttccggcattacgggcgacaatacgacaacatcctctgagcccgccccttctggctgcccccccgactccgacgttgagtcctattcttccatgccccccctggagggggagcctggggacccggatttcagcgacgggtcatggtcgacggtcagtagtggggccgacacggaagatgtcgtgtgctgctcaatgtcttattcctggacaggcgcactcgtcaccccgtgcgctgcggaagaacaaaaactgcccatcaacgcactgagcaactcgttgctacgccatcacaatctggtgtattccaccacttcacgcagtgcttgccaaaggcagaagaaagtcacatttgacagactgcaagttctggacagccattaccaggacgtgctcaaggaggtcaaagcagcggcgtcaagagtgaaggctaacttgctatccgtagaggaagcttgcagcctgacgcccccacattcagccaaatctaagtttggctatggggcaaaagacgtccgttgccatgccagaaaggccgtagcccacatcaactccgtgtggaaagaccttctggaagacagtgtaacaccaatagacactaccatcatggccaagaacgaggttttctgcgttcagcctgaaaaggggggtcgtaagccagctcgtctcatcgtgttccccgacctgggcgtgcgcgtgtgcgagaagatggccctgtacgacgtggttagcaagctccccctggccgtgatgggaagctcctacggattccaatactcaccaggacagcgggttgaattcctcgtgcaagcgtggaagtccaagaagaccccgatggggttctcgtatgatacccgctgttttgactccacagtcactgagagcgacatccgtacggaggaggcaatttaccaatgttgtgacctggacccccaagcccgcgtggccataaagtccctcactgagaggctttatgttgggggccctcttaccaattcaaggggggaaaactgcggctaccgcaggtgccgcgcgagcggcgtactgacaactagctgtggtaacaccctcacttgctacatcaaggcccgggcagcctgtcgagccgcagggctccaggaccgcaccatgctcgtgtgtggcgacgacttagtcgttatctgtgaaagtgcgggggtccaggaggacgcggcgagcctgagagccttcacggaggctatgaccaggtactccgccccccccggggaccccccacaaccagaatacgacttggagcttataacatcatgctcctccaacgtgtcagtcgcccacgacggcgctggaaagagggtctactaccttacccgtgaccctacaacccccctcgcaagagccgcgtgggagacagcaagacacactccagtcaattcctggctaggcaacataatcatgtttgcccccacactgtgggcgaggatgatactgatgacccatttctttagcgtcctcatagccagggatcagtttgaacaggctcttaactgtgagatctacggagcctgctactccatagaaccactggatctacctccaatcattcaaagactccatggcctcagcgcattttcactccacagttactctccaggtgaaatcaatagggtggccgcatgcctcagaaaacttggggttccgcccttgcgagcttggaaacaccgggcccggagtgtccgcgctaggcttctgtccaggggaggcagggctgccatatgtggcaagtacctcttcaactgggcagtaagaacaaagcccaaactcactccaatagcggccgctggccggctggacttgtccggttggttcacggctggctacagcgggggagacatttatcacagcgtgtctcatgcccggccccgctggtcctggttttgcctactcctgctcgctgcaggggtaggcatctacctcctccccaaccgatga

SEQ ID NO: 708 - DNA, 9359 bp, Hepatitis C Virus
  misc_feature 1169, 8120, 8576, 9047: n = A,T,C or G
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggtggtggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggcaggacctgggctcagcccgggtacccttggcccctctatggcaatgagggcatggggtgggcaggatggctcctgtcaccccgcggctctcggcctagttggggccccacggacccccggcgtaggtcgcgtaatttgggtaaggtcatcgataccctcacatgcggcttcgccgacctcatggggtacattccgctcgtcggcgcccccctggggggcgctgccagggccctggcgcatggcgtccgggttctggaggacggcgtgaactatgcaacagggaatctgcccggttgctctttctctatcttcctcttggctttgctgtcctgtttgaccatcccagcttccgctatcgaagtgcgcaacgtgtccggagtgtaccatgtcacgaacgactgctccaacgcaagcattgtgtatgaggcagcggacatgattatgcatacccccgggtgcgtgccctgcgttcgggagaacaactcctcccgctgctgggtagcgctcactcccacgctcgcggccaggaactccagcatccccactacgacaatacgacgtcacgtcgatttgctcgttgggacggctgctttctgctccgctatgtacgtgggagatctntgcggatctgttttccttgtctctcagctgttcaccttctcgcctcgccggcatgagacagtacaggactgcaattgctcaatctatcccggccacgtatcgggtcaccgcatggcttgggacatgatgatgaactggtcacctacaacagctctagtggtgtcgcagttactccggatcccacaagctgtcgtggacatggtggcgggagcccactggggagtcctggcgggcctcgcctactattctatggcggggaactgggctaaggtcttgattgtgatgctactttttgccggcgtcgacggggaaacttatacgacagggggggcgcaggcccatactacccgcgggcttgcgaccctcttttcgtttgggccgtcccaaaacatccagcttataaacaccaacggcagctggcacatcaacaggactgccctgaactgcaatgactccctcaacactgggttccttgccgcgctgttctacgcccacagattcaacgcgtccggatgcccggagcgcatggccagctgccgccccattgacaagttcgctcaggggtggggtcccatcgcttacgctaagccgctcagcttggaccagaagccctattgttggcactacgcaccccaaccgtgcggtattgtacccgcgtcgcaggtgtgcggtccagtgtactgcttcaccccaagccctgttgtggtggggacgaccgatcgtttcggcgtccctacgtatagctggggggagaatgagacggacgtgctgcttctcaacaacacgcggccgccgcgaggcaactggttcggctgcacatggatgaatggcactgggttcaccaagacgtgcgggggccccccgtgcgacatcgggggggtcggcaatgacaccttgatctgccccacggattgcttccggaagcaccccgaggccacttacaccaaatgcggttcggggccctggttgacacctaggtgcatggttgactacccatacaggctttggcactacccctgcactgtcaattttaccatcttcaaggttaggatgtatgtggggggtgtggagcacaggctcaacgccgcatgcaactggacccgaggagagcgttgtgacttggaggacagggatagatcagagcttagcccgctgctgctgtctacaacagagtggcaggtattgccctgttccttcaccaccctaccggctctgtccaccggcttgatccatctccatcggaacatcgtggacgtacaatacctgtacggtatagggtcagcggttgtctcctacgcaattaagtgggagtatgtcctgttgctcttccttttcctggcggacgcgcgcgtctgtgcctgcttgtggatgatgctgctaatagttcaggctgaggccgccttagagaacttggtggtcctcaatgcggcgtccgtggccggaacgcatggcattctctctttccttgtgttcttctgtgctgcctggtacatcaagggcaggctggtccctggggcggcatatgctttctatggcgtatggccgctgctcctgctcctgctggcgttgccaccacgagcatacgccatggaccgggagatggctgcatcgtgcggaggcgcggttttcataggtctggcactcttgaccttgtcaccacactataaagtgttcctcgccaggctcatatggtggttacaatattttatcaccagagccgaggcacacttgcaggtgtggatcccccccctcaacgttcgggggggccgcgatgccatcatcctcctcatgtgcgcgatccacccagagctaatctttgccatcaccaaaatcttgctcgccatactcggcccgctcatggtgctccaggctggcataactagggtgccgtactttgtgcgcgcccatgggcttattcgtgcatgcgtgctggtgcgggaagtcgctgggggtcattatgtccaaatggctctcatgaggctggccgcactgacaggcacgtacgtttatgaccatcttactccactgcgggattgggcccacgagggcctacgagaccttgcggtggcagttgagcccgtcgtcttctctgacatggagaccaagatcattacctggggggcagacaccgcggcgtgtggggacatcatcctaggcctgcccgtctccgcccgcagggggagggagatacttctgggaccggcagatagtcttgagggacaggggtggcgactccttgcgcccatcacggcctatgcccaacaaacgcggggcctacttggctgcatcgtcaccagcctcacaggccgggacaagaaccaggtcgagggggaggttcaagtggtttccaccgcaacacaatctttcctggcgacctgcgtcaacggcgtgtgttggactgtctaccacggcgccggcacaaagacccttgccggccaaaaaggcccaatcacccaaatgtacaccaatgtagaccaggacctcgtcggctggctagcgcctcccggggcgcgatccttgacaccgtgcacctgcggcagctcggacctttacttggtcacgaggcatgctgatgtcattccggtgcgccggcggggcgacagcagaggaagcctactctcccccaggcccgtctcctacttgaagggctcttcgggtggtccactgctctgcccctcggggcatgctgtgggcatcttccgggctgctgtgtgcacccggggggttgcgaaggcggtggactttgtgcccgttgagtctatggaaacaactatgcggtccccggtcttcacggacaactcgtcccccccggccgtaccgcaaacattccaagtggcccatctacacgctcccactggcagcggcaagagcactaaggtgccggctgcatatgcagcccaagggtacaaggtactcgtcctgaacccgtctgttgccgccaccctaggtttcggggcgtatatgtctaaggcacatggtgtcgaccctaacatcagaactggggtaaggaccatcaccacgggtgcccccattacgtactccacctatggcaagttccttgccgacggtggttgctctgggggcgcctatgacatcataatatgtgatgagtgtcactcaactgactcgactaccatcttgggcatcggcacagtcctggaccaagcggagacggctggagcgcgactcgtcgtactcgccaccgctacgcctccgggatcggtcaccgtgccacatcccaatatcgaggaggtggctctgtccaacattggagagatccccttctatggtaaagccatccccatcgagaccatcaagggggggaggcacctcatattttgccattccaggaaaaaatgtgatgagctcgctgcaaagctgtcgggtctcgggcttaacgctgtagcgtattaccggggtcttgacgtgtccgtcataccgaccagcggagacgtcgttgtcgtggcaacagacgctctaatgacgggcttcactggcgactttgactcagtgatcgactgtaatacatgtgtcacccagacagtcgacttcagcttggaccctaccttcaccattgagacgacgaccgtgccccaagacgcggtgtcgcgctcgcagcggcgaggcaggactggtaggggcaggacaggcatctacaggtttgtgactccaggagaacggccctcgggcatgttcgattcctcggtcctgtgtgagtgctatgacgcgggctgtgcttggtacgagctcacgcccgccgagacctcagttaggttgcgggcttacctgaatacaccagggttgcccgtctgccaggaccatctggagttctgggagggcgtcttcacaggcctcacccacatagatgcccacttcctgtcccagactaagcaggcaggagacaacttcccctacttggtagcataccaggctacggtgtgcgccagggctcaggctccacccccatcgtgggaccaaatgtggaaatgtctcatacggctaaagcccacgctgcacgggccaacacccctgctgtataggctaggagccgtccaaaatgaggtcatcctcacacaccccataactaaattcatcatggcatgcatgtcggctgatctggaggtcgccacgagcacctgggtgctagtaggcggagtcctcgcagctctggccgcgtattgcctgacaacaggcagcgtggtcattgtaggcaggatcatcttgtctggaaagccggctattgtacccgacagggaagtcctctaccagcagttcgatgagatggaagagtgcgccacacacctcccttacatcgaacaaggaatgcagctcgccgaacaattcaagcagaaggcactcgggttgttgcagacagccaccaagcaagcagaggctgctgctcccgtggtggagtccaagtggcgagcccttgagagcttctgggcgaaacatatgtggaatttcatcagcgggatacaatacttagcaggcttgtccactctgcctgggaaccccgcaatagcatcactgatggcattcacagcctctatcaccagcccgcttaccacccaacataccctcctgttcaacatcttggggggatgggtggctgcccaactcgccccccccagcgctgcttctgctttcgtaggcgccggcatcgccggcgcggccgttggcagcataggccttgggaaggtgctagtggacatcttggcgggttatggagcgggggtggcaggcgccctcgtggcctttaaggtcatgagtggcgagatgccttccactgaggacttggtcaacttgctccctgccatcctctcccctggtgccctagtcgtcggggtagtgtgcgcagcaatactgcgtcggcatgtgggcccaggggagggggctgtgcagtggatgaaccggctgatagcgttcgcttcgcggggtaaccacgtctcccccacgcactatgtgcccgagagcgacgctgcagcgcgtgtcactcagatcctctccagccttaccatcactcagctgctgaagaggctccaccagtggattaacgaggactgctccacgccatgctccggctcgtggctaagggacgtttgggactggatatgcacggtgttaactgattttaagacctggctccagtccaagctcctgccgcggttaccgggggtccccttcctctcatgccaacgtgggtacaagggcgtctggcggggagacggcatcatgcaaaccacctgcccatgtggagcgcagatcaccggacatgtcaaaaacggttccatgaggatcgttgggcctaggacctgcagcaacacgtggcatggaacattccccatcaacgcatacaccacgggcccctgcacgccctccccggcgcccaattattccagggcgctgtggagggtgactgctgaggagtacttggaggttacgcaggtgggggatttccactacgtgacgggcatgaccactgacaacgtaaagtgcccatgccaggttccggcccccgaattcttcacggaggtggatggggtgcggctgcacaggtacgctccgccgtgcaaacctctcctacgggaggaggtcacattccaggtcgggctcaaccaatacctggtcgggtcacagctcccatgtgagcccgaaccggatgtagcggtgctcacttccatgctcaccgacccctcccatatcacagcagaggcggctaagcgtaggctggccagggggtctcccccctccttagccagctcttcagctagccagttgtctgcgccttccttgaaggcgacatgcactacccgtcatgactccccagatgctgacctcatcgaggccaatctcctgtggcggcaggagatgggcgggaacatcacccgcgtggagtcagagaacaaggtagtaattctggactctttcgagccgcttcgagcggaggaagatgagagggaagtatccgttccggcggaaatcctgcggagatccaggaaatttccccgagcgatgcccatatgggcaaggccggattacaaccctccactggtagagtcctggaaggacccggactacgtacctccggtggtacatgggtgcccattgccacctactaaggcccctccaataccacctccacggaggaaaaggacggttgtcctgacagaatccaccgtgtcttctgccttggctgagctcgccacaaagaccttcggcagctccgaatcgtcggccgtcgacagcggcacggcgaccgcccctcctgaccagccctccgacgacggcgacgcagggtccgatgttgagtcgtactcctccatgcccccccttgagggggagccgggggatcccgatctcagcgacgggtcttggtctaccgtgagcgaggaggctagtgaggacgtcgtctgctgctcgatgtcctacacatggacaggcgccctgatcacgccatgctccgcggaggaaagcaagctgcccatcaacgcgttgagcaactctttgctgcgtcaccacaacatggtctatgccacaacatctcgcagcgcaagccagcggcagaagaaggtcacctttgacagactgcaggtcctggacgaccattaccgggacgtgctcaaggagatgaaggcgaaggcgtccacggttaaggctaaacttctacccgtagaagaagcctgcaagctgacgcccccacactcggccaaatccaaatttggctatggggcaaaggacgtccggaacctatccagcaaggccgttaaccacatcctctccgtgtggaaggacttgctggaagacactgagacaccaattgacaccaccatcatggcaaaaaatgaggttttctgcgtccaaccagagaaaggaggccgcaagccagctcgccttatcgtattcccagacttgggggttcgtgtgtgcgagaaaatggccctttatgacgtngtctccacccttcctcaggccgtgatgggctcctcatacgggttccagtactctcctggacagcgggtcgagttcctggtgaatgcctggaaaaaaaagaaaaaccctatgggcttcgcatatgacacccgctgttttgactcaacggtcaccgagagtgacatccgtgttgaggagtcaatctaccaatgttgtgacttggcccccgaagccagacaggccataaggtcgctcacagagcggctttatatcgggggtcccctgactaactcaaaggggcagaactgcggttatcgccggtgccgcgcgagcggcgtgctgacgaccagctgcggtaataccctcacatgttacttgaaggcctctgcagcctgtcgagctgccaagctccaggactgcacgatgctcgtgtgcggagacgacctcgtcgttatctgtgaaagcgcgggaacccangaggacgcggcgagcctacgagtcttcacggaggctatgactaggtactctgccccccccggggacccgcccaaaccagaatacgacttggagttgataacatcatgctcctccaatgtgtcggtcgcgcacgatgcatctggcaaaagggtgtactacctcacccgtgaccccaccaccccacttgcgcgggctgcgtgggagacagctagacacactccagtcaactcctggctaggcaacatcatcatgtatgcgcccaccttatgggcaaggatgatcctgatgactcacttcttctccatccttctagctcaggaacaacttgaaaaggctctagattgtcagatctacggggcctgttactccattgagccacttgacctacctcagatcattcagcgactccatggtcttagcgcattttcactccatagttactctccaggtgaaatcaatagggtggctgcntgcctcagaaaacttggggtaccacccttgcgagtctggagacatcgggccagaagtgtccgcgctaagctactgtcccagggggggagggctgccaactgtggcaaatacctcttcaactgggcagtaaggaccaagcttaaactcactccaattccggctgcgtcccagttggacttgtccagctggttcgttgctggttacagcgggggagacatatatcacagcctgtctcgtgcccgaccccgctggttcatgttgtgcctactcctactttccgtaggggtaggcatctacctgctccccaaccga

SEQ ID NO: 709 - DNA, 9587 bp, Hepatitis C Virus
gccagcccccgattgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcatcatgagcacaaatcctaaacctcaaagaaaaaccaaacgtaacaccaaccgccgcccacaggacgttaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggtaggacctgggctcagcccgggtacccttggcccctctatggcaacgagggtatggggtgggcaggatggctcctgtcaccccgtggctctcggcctagttggggccccacagacccccggcgtaggtcgcgtaatttgggtaaggtcatcgatacccttacatgcggcttcgccgacctcatggggtacattccgcttgtcggcgcccccctaggaggcgctgccagggccctggcgcatggcgtccgggttctggaggacggcgtgaactatgcaacagggaatctgcccggttgctctttctctatcttcctcttagctttgctgtcttgtttgaccatcccagcttccgcttacgaggtgcgcaacgtgtccgggatataccatgtcacgaacgactgctccaactcaagtattgtgtatgaggcagcggacatgatcatgcacacccccgggtgcgtgccctgcgtccgggagagtaatttctcccgttgctgggtagcgctcactcccacgctcgcggccaggaacagcagcatccccaccacgacaatacgacgccacgtcgatttgctcgttggggcggctgctctctgttccgctatgtacgttggggatctctgcggatccgtttttctcgtctcccagctgttcaccttctcacctcgccggtatgagacggtacaagattgcaattgctcaatctatcccggccacgtatcaggtcaccgcatggcttgggatatgatgatgaactggtcacctacaacggccctagtggtatcgcagctactccggatcccacaagccgtcgtggacatggtggcgggggcccactggggtgtcctagcgggccttgcctactattccatggtggggaactgggctaaggtcttgattgtgatgctactctttgctggcgttgacgggcacacccacgtgacagggggaagggtagcctccagcacccagagcctcgtgtcctggctctcacaagggccatctcagaaaatccaactcgtgaacaccaacggcagctggcacatcaacaggaccgctctgaattgcaatgactccctccaaactgggttcattgctgcgctgttctacgcacacaggttcaacgcgtccggatgtccagagcgcatggccagctgccgccccatcgacaagttcgctcaggggtggggtcccatcactcacgttgtgcctaacatctcggaccagaggccttattgctggcactatgcaccccaaccgtgcggtattgtacccgcgtcgcaggtgtgtggcccagtgtattgcttcaccccgagtcctgttgtggtggggacgaccgaccgttccggagtccccacgtatagctggggggagaatgagacagacgtgctgctactcaacaacacgcggccgccgcaaggcaactggttcggctgtacatggatgaatagcaccgggttcaccaagacgtgcgggggccccccgtgtaacatcgggggggttggcaacaacaccttgatttgccccacggattgcttccgaaagcaccccgaggccacttacaccaaatgcggctcgggtccttggttgacacctaggtgtctagttgactacccatacagactttggcactacccctgcactatcaattttaccatcttcaaggtcaggatgtacgtggggggcgtggagcacaggctcaacgccgcgtgcaattggacccgaggagagcgctgtgacctggaggacagggatagatcagagcttagcccgctgctattgtctacaacggagtggcaggtactgccctgttcctttaccaccctaccggctctgtccactggattgatccacctccatcagaatatcgtggacgtgcaatacctgtacggtgtagggtcagtggttgtctccgtcgtaatcaaatgggagtatgttctgctgctcttccttctcctggcggacgcgcgcgtctgtgcctgcttgtggatgatgctgctgatagcccaggctgaggccaccttagagaacctggtggtcctcaatgcggcgtctgtggccggagcgcatggccttctctccttcctcgtgttcttctgcgccgcctggtacatcaaaggcaggctggtccctggggcggcatatgctctctatggcgtatggccgttgctcctgctcttgctggctttaccaccacgagcttatgccatggaccgagagatggctgcatcgtgcggaggcgcggtttttgtaggtctggtactcttgaccttgtcaccatactataaggtgttcctcgctaggctcatatggtggttacaatattttatcaccagggccgaggcgcacttgcaagtgtgggtcccccctcttaatgttcggggaggccgcgatgccatcatcctccttacatgcgcggtccatccagagctaatctttgacatcaccaaactcctgctcgccatactcggtccgctcatggtgctccaagctggcataaccagagtgccgtacttcgtgcgcgctcaagggctcattcatgcatgcatgttagtgcggaaggtcgctgggggtcattatgtccaaatggccttcatgaagctgggcgcgctgacaggcacgtacatttacaaccatcttaccccgctacgggattgggcccacgcgggcctacgagaccttgcggtggcagtggagcccgtcgtcttctccgacatggagaccaagatcatcacctggggagcagacaccgcggcgtgtggggacatcatcttgggtctgcccgtctccgcccgaaggggaaaggagatactcctgggcccggccgatagtcttgaagggcgggggtggcgactcctcgcgcccatcacggcctactcccaacagacgcggggcctacttggttgcatcatcactagccttacaggccgggacaagaaccaggtcgagggagaggttcaggtggtttccaccgcaacacaatccttcctggcgacctgcgtcaacggcgtgtgttggaccgtttaccatggtgctggctcaaagaccttagccggcccaaaggggccaatcacccagatgtacactaatgtggaccaggacctcgtcggctggcaggcgccccccggggcgcgttccttgacaccatgcacctgtggcagctcagacctttacttggtcacgagacatgctgacgtcattccggtgcgccggcggggcgacagtagggggagcctgctctcccccaggcctgtctcctacttgaagggctcttcgggtggtccactgctctgcccttcggggcacgctgtgggcatcttccgggctgccgtatgcacccggggggttgcgaaggcggtggactttgtgcccgtagagtccatggaaactactatgcggtctccggtcttcacggacaactcatcccccccggccgtaccgcagtcatttcaagtggcccacctacacgctcccactggcagcggcaagagtactaaagtgccggctgcatatgcagcccaagggtacaaggtgctcgtcctcaatccgtccgttgccgctaccttagggtttggggcgtatatgtctaaggcacacggtattgaccccaacatcagaactggggtaaggaccattaccacaggcgcccccgtcacatactctacctatggcaagtttcttgccgatggtggttgctctgggggcgcttatgacatcataatatgtgatgagtgccattcaactgactcgactacaatcttgggcatcggcacagtcctggaccaagcggagacggctggagcgcggcttgtcgtgctcgccaccgctacgcctccgggatcggtcaccgtgccacacccaaacatcgaggaggtggccctgtctaatactggagagatccccttctatggcaaagccatccccattgaagccatcagggggggaaggcatctcattttctgtcattccaagaagaagtgcgacgagctcgccgcaaagctgtcaggcctcggaatcaacgctgtggcgtattaccgggggctcgatgtgtccgtcataccaactatcggagacgtcgttgtcgtggcaacagacgctctgatgacgggctatacgggcgactttgactcagtgatcgactgtaacacatgtgtcacccagacagtcgacttcagcttggatcccaccttcaccattgagacgacgaccgtgcctcaagacgcagtgtcgcgctcgcagcggcggggtaggactggcaggggtaggagaggcatctacaggtttgtgactccgggagaacggccctcgggcatgttcgattcctcggtcctgtgtgagtgctatgacgcgggctgtgcttggtacgagctcacccccgccgagacctcggttaggttgcgggcctacctgaacacaccagggttgcccgtttgccaggaccacctggagttctgggagagtgtcttcacaggcctcacccacatagatgcacacttcttgtcccagaccaagcaggcaggagacaacttcccctacctggtagcataccaagccacggtgtgcgccagggctcaggccccacctccatcatgggatcaaatgtggaagtgtctcatacggctgaaacctacgctgcacgggccaacacccttgctgtacaggctgggagccgtccaaaatgaggtcaccctcacccaccccataaccaaatacatcatggcatgcatgtcggctgacctggaggtcgtcactagcacctgggtgctggtgggcggagtccttgcagctctggccgcgtattgcctgacaacaggcagtgtggtcattgtgggtaggattatcttgtccgggaggccggctattgttcccgacagggagcttctctaccaggagttcgatgaaatggaagagtgcgccacgcacctcccttacattgagcagggaatgcagctcgccgagcagttcaagcagaaagcgctcgggttactgcaaacagccaccaaacaagcggaggctgctgctcccgtggtggagtccaagtggcgagcccttgagacattctgggcgaagcacatgtggaatttcatcagcgggatacagtacttagcaggcttatccactctgcctgggaaccccgcaatagcatcattgatggcattcacagcctctatcaccagcccgctcaccacccaaagtaccctcctgtttaacatcttgggggggtgggtggctgcccaactcgccccccccagcgccgcttcggctttcgtgggcgccggcatcgccggtgcggctgttggcagcataggccttgggaaggtgcttgtggacattctggcgggttatggagcaggagtggccggcgcgctcgtggcctttaaggtcatgagcggcgagatgccctctaccgaggacctggtcaatctacttcctgccatcctctctcctggcgccctggtcgtcggggtcgtgtgtgcagcaatactgcgtcggcacgtgggtccgggagagggggctgtgcagtggatgaaccggctgatagcgttcgcctcgcggggtaatcacgtttcccccacgcactatgtgcctgagagcgacgccgcagcgcgtgttactcagatcctctccagccttaccatcactcagctgctgaaaaggctccaccagtggattaatgaggactgctccacaccgtgttccggctcgtggctaagggatgtttgggactggatatgcacggtgttgactgacttcaagacctggctccagtccaagctcctgccgcagctaccgggagtcccttttttctcgtgccaacgcgggtacaagggagtctggcggggagacggcatcatgcaaaccacctgcccatgtggagcacagatcaccggacatgtcaaaaacggttccatgaggatcgtcgggcctaagacctgcagcaacacgtggcatggaacattccccatcaacgcatacaccacgggcccctgcacaccctctccagcgccaaactattctagggcgctgtggcgggtggccgctgaggagtacgtggaggtcacgcgggtgggggatttccactacgtgacgggcatgaccactgacaacgtaaagtgcccatgccaggttccggctcctgaattcttctcggaggtggacggagtgcggttgcacaggtacgctccggcgtgcaggcctctcctacgggaggaggttacattccaggtcgggctcaaccaatacctggttgggtcacagctaccatgcgagcccgaaccggatgtagcagtgctcacttccatgctcaccgacccctcccacatcacagcagaaacggctaagcgtaggttggccagggggtctcccccctccttggccagctcttcagctagccagttgtctgcgccttccttgaaggcgacatgcactacccaccatgtctctccggacgctgacctcatcgaggccaacctcctgtggcggcaggagatgggcgggaacatcacccgcgtggagtcggagaacaaggtggtagtcctggactctttcgacccgcttcgagcggaggaggatgagagggaagtatccgttccggcggagatcctgcggaaatccaagaagttccccgcagcgatgcccatctgggcgcgcccggattacaaccctccactgttagagtcctggaaggacccggactacgtccctccggtggtgcacgggtgcccgttgccacctatcaaggcccctccaataccacctccacggagaaagaggacggttgtcctaacagagtcctccgtgtcttctgccttagcggagctcgctactaagaccttcggcagctccgaatcatcggccgtcgacagcggcacggcgaccgcccttcctgaccaggcctccgacgacggtgacaaaggatccgacgttgagtcgtactcctccatgcccccccttgagggggaaccgggggaccccgatctcagtgacgggtcttggtctaccgtgagcgaggaagctagtgaggatgtcgtctgctgctcaatgtcctacacatggacaggcgccttgatcacgccatgcgctgcggaggaaagcaagctgcccatcaacgcgttgagcaactctttgctgcgccaccataacatggtttatgccacaacatctcgcagcgcaggcctgcggcagaagaaggtcacctttgacagactgcaagtcctggacgaccactaccgggacgtgctcaaggagatgaaggcgaaggcgtccacagttaaggctaaactcctatccgtagaggaagcctgcaagctgacgcccccacattcggccaaatccaagtttggctatggggcaaaggacgtccggaacctatccagcaaggccgttaaccacatccactccgtgtggaaggacttgctggaagacactgtgacaccaattgacaccaccatcatggcaaaaaatgaggttttctgtgtccaaccagagaaaggaggccgtaagccagcccgccttatcgtattcccagatctgggagtccgtgtatgcgagaagatggccctctatgatgtggtctccacccttcctcaggtcgtgatgggctcctcatacggattccagtactctcctgggcagcgagtcgagttcctggtgaatacctggaaatcaaagaaaaaccccatgggcttttcatatgacactcgctgtttcgactcaacggtcaccgagaacgacatccgtgttgaggagtcaatttaccaatgttgtgacttggcccccgaagccagacaggccataaaatcgctcacagagcggctttatatcgggggtcctctgactaattcaaaagggcagaactgcggttatcgccggtgccgcgcgagcggcgtgctgacgactagctgcggtaacaccctcacatgttacttgaaggcctctgcagcctgtcgagctgcgaagctccaggactgcacgatgctcgtgaacggagacgaccttgtcgttatctgtgaaagcgcgggaacccaagaggacgcggcgagcctacgagtcttcacggaggctatgactaggtactctgccccccccggggacccgccccaaccagaatacgacttggagctgataacatcatgttcctccaatgtgtcggtcgcccacgatgcatcaggcaaaagggtgtactacctcacccgtgatcccaccacccccctcgcacgggctgcgtgggaaacagctagacacactccagttaactcctggctaggcaacattatcatgtatgcgcccactttgtgggcaaggatgattctgatgactcacttcttctccatccttctagcacaggagcaacttgaaaaagccctggactgccagatctacggggcctgttactccattgagccacttgacctacctcagatcattgaacgactccatggccttagcgcattttcactccatagttactctccaggtgagatcaatagggtggcttcatgcctcaggaaacttggggtaccacccttgcgagtctggagacatcgggccaggagcgtccgcgctaggctactgtcccagggggggagggccgccacttgtggcaagtacctcttcaactgggcagtgaagaccaaactcaaactcactccaatcccggctgcgtcccagctggacttgtccggctggttcgttgctggttacagcgggggagacatatatcacagcctgtctcgtgcccgaccccgctggttcatgctgtgcctactcctactttctgtaggggtaggcatctacctgctccccaaccgatgaacggggagctaaacactccaggccaataggccatttcctgttttttttttttttttttttttttttttttttttcttttccttctttttccctttttctttcttccttctttaatggtggctccatcttagccctagtcacggctagctgtgaaaggtccgtgagccgcatgactgcagagagtgctgatactggcctctctgcagatcatgt

SEQ ID NO: 710 - DNA, 9609 bp, Hepatitis C Virus
gccagcccccgattgggggcgacactccaccatagatcactcccctgtgaggaactactgtcttcacgcagaaagcgtctagccatggcgttagtatgagtgtcgtgtagcctccgggaccccccctcccgggagagccatggtggtctgcggaaccggtgagtacaccggaattgccaggacgaccgggtcctttcttggatcaacccgctcaatgcctggagatttgggcgtgcccccgcgagactactagccgagtagtgttgggtcgcgaaaggccttgtggtactgcctgatagggtgcttgcgagtgccccgggaggtctcgtagaccgtgcaccatgagcacgattcctaaacctcaaagaaaaaccaaacgtaacacctaccgccgcccacaggacgtcaagttcccgggcggtggccagatcgttggtggagtttacctgttgccgcgcaggggccccaggttgggtgtgcgcgcgactaggaagacttccgagcggtcgcaacctcgtggaaggcgacagcctatccccaaggctcgccggcccgagggctgggcctgggcacaacccgggtacccttggcccctctatggcaatgagggcttggggtgggcaggatggctcctgtcaccccgtggctcccgccctagttggggccccatagacccccggcgtaggtcgcgtaatttgggtaaggtcatcgataccctcacatgcggcttcgccgacctcatgggatacattccgctcgtcggcgcccccttagggggcgctgccagggccctggcgcatggcgtcagggttctggaggacggcgtgaactatgcaacagggaaccttcccggttgctctttctctatcttcctcttggctttgctgtcttgtttgaccatcccagcttccgcttatgaagtgcgcaacgcgtccggggtgtaccatgttacgaacgactgctccaactcaagcattgtgtatgaggcagcggacataatcatgcacacccccggatgcgtaccctgcgttcgggagaacaactcttcccgctgctgggtagcgctcactcccacgctcgcggccaggaacctcagcgtccccaccacgacaatacgacgccatgtcgatttgctcgttggggcggctgctttctgctccgctatgtacgtgggggatctttgcggatccgttctactcgtctcccagctgttcaccctctcgcctcgccagcatgagacagtacaagattgcaattgctcactttatcccggccacgtaacaggtcaccgcatggcttgggatatgatgatgaattggtcgcctacaacagccctagtgttatcgcagatactccggatcccacaaactatcgtggacatggtggcgggggcccactggggagtcctggcgggcattgcctactattccatggtggggaactgggctaaggttttggttgtgatgctactctttgctggcgttgacgggcacacccaagtgatgggggggtcgcaagcctctaccatcaacacgctcacgggaattttctcccccggggcgaaacagaagattcagctcataaacaccaacggcagttggcacatcaacaggactgccctgaactgcaatgactccctcaacactgggttccttgccgcgctgttctacacccacagcttcaactcgtccggatgcctagagcgtatggccagctgccgccccattgacaagttcgatcaggggtggggtcccattacttatgatgaaggccccgatttagaccagaggccctattgctggcactacgcaccccggtcgtgcggtattgtgcccgcgtcgcaggtgtgtggcccagtgtattgtttcaccccaagccctgtcgtggtggggacgaccgatcgtaccggtgcccccacgtatagatggggggagaatgagacggacgtgctgatcctcaacaacacgcggccgccgcagggcaactggttcggctgcacatggatgaatagcactgggttcaccaagacatgcgggggccccccatgtaacatcgggggggctggtaacaacaccttggtctgccccacggactgcttccggaaacaccccgaggctacttacaccaaatgcggttcgggaccctggttgacacctaggtgcatggttgactacccatacaggccttggcactacccctgtactgtcaactttaccattttcaaggttaggatgtatgtggggggcgtagagcacaggctcaacgctgcacgcaactggactcgaggagagcgttgtgacttggaggacagggatagatcagagcttagcccgctgctgctgtctacgacagagtggcagatactgccttgctccttcaccactctaccggctctgtccactggcttgatccacctccatcagaacatcgtggacgtgcagtatctgtacggtatagggtcagtggttgtctccctcgtgatcaaatgggagtatgtcttgctgtccttcttcctcctggcggacgcgcgcgtctgtgcctgtttgtggatgatgctgctgatagcccaggctgaggccgccttagagaacctggtggtcctcaatgcggcgtccgtggccggagcgcatggcatcctcaccttccttgtgttcttctgtgctgcctggtacatcaagggcaggctggtccctggggcggcatatgctttttacggcgtgtggccgctgctcctgctcttgctggcgctgccaccacgagcgtacgctatggaccgggagatggctgcatcgtgcggaggcgcggttttcataggtctggtactcctgaccctgtcaccacactataaagtgttccttgctaggctcatatggtggttgcagtactttaccaccagagccgaggcaattttgcacgtgtgggtcccccctctcaacgtccgagggggccgtgatgccgtcattctcctcacgtgcgcggtccacccagacctaatctttgacatcaccaaactcttgctcgctgtgctcggtccgctcatggtgtttctggccggcataacaagggtgccatacttcgtgcgcgcccaaggcctcattcgtgcgtgcgcgttagcgcggaaggtcgctgggggtcattatatccaaatggctctcatgaagctggccgcgctgacaggcacgtatctttacgaccatcttactccactgcgggactgggcccatgcgggcctgcgagaccttgcggtagcagtcgagcctgtcgtcttttctgacatggagaccaagatcatcacctggggggcagacaccgcagcgtgtggggacatcatcctgggtctgcctgtctccgctcgaagggggagggagatacttttgggaccagccgatagtcttgaagggcaggggtggcgactccttgcgcctattacggcctactcccagcagacgcggggcctacttggctgcatcatcactagtctcacaggtcgggacaagaaccaggtcgagggggaggttcaagtggtttccaccgcaacacagtctttcctagcgacctgcgtcaacggcgtgtgttggactgtcttccatggtgccggctcaaaaaccttagccggtccaaaggggccaattactcaaatgtacaccaacgtggaccaggacctcgtcggctggcaggcgccccccggggcgcgttccttgacaccatgcacctgcggcagctcggacctttacctggtcacgaggcacgctgacgtcattccggtgcgccggcggggcgacaacagagggagcctactctcccccaggcccgtctcctacttaaagggctcttcgggtggtccactcctctgcccctcggggcatgccgtaggcatcttccgggccgccgtatgcacccggggggttgcgaaggcggtggactttatacccgttgagtctatggagactaccatgcggtccccggtcttcacagacaattcatcccccccggccgtaccgcagacattccaagtggctcatctacacgctcccactggcagcggtaagagcactaaggtgccggctgcgtatgcagcccaagggtacaaggtacttgtcctgaacccgtccgtggccgctaccttagggttcggaacgtatatgtctaaggcatatggtgtcgatcctaacatcagaaccggggtaaggaccatcaccacgggcgcccccatcacgtactccacttacggcaagtttcttgccgacggtggttgctccgggggagcctacgacatcataatgtgtgatgaatgccactcaactgactcaactactgtcttgggcatcggcacagtcctggaccaagcggagacggctggagcgcggcttgtcgtgctcgccaccgctacgcctccgggatcggtcaccgtgccacatcccaatattgaggagatcgctctatccaacactggagagatccccttctatggcaaagccatccccattgagaccatcaagggggggaggcatctcattttctgccattccaagaagaaatgtgacgagctcgctgcaaagttgtcgggcctcggacttaacgctgtagcgtattaccggggccttgatgtgtccgttataccaactagcggagacgtcgttgtcgtggcaacagacgctctaatgacgggctttaccggcgattccgactcagtgatcgactgtaatacatgtgtcacccagacagttgatttcagcttggaccctaccttcaccattgagacgacgaccgtgccccaagacgcggtgtcgcgctcgcagcggcgaggcaggactggtaggggtagggggggcatctacaggtttgtgactccaggagaacggccctcgggcatgttcgattcttcggtcctgtgtgagtgctatgacgcgggctgtgcttggtacgagctcacgcccgccgagacctcagttaggttgcgggcttacctgaatacaccagggttacccgtctgccaggaccatctggagttctgggagagtgtcttcacaggcctcacccacatagacgcccacttcttgtctcagactaagcaggcaggagacaacttcccctacctggtagcgtaccaggctacagtgtgcgccagagcgcaggctccacctccatcatgggatcaaatgtggaagtctctcatacggctaaagcctacactgcacgggccaacacccctgctatataggctagggaccgtccaaagcgagattaccctcacacacccagtgacaaaatacatcatggcatgcatgtcggctgacctggaggtcgtcacgagcacctgggtgctagtgagcggagtcctcgcagccctggccgcgtactgcttgacaacaggcagcgtggtcattgtgggcaggatcatcttgtccgggaagcctgctgttattcccgacagggaagttctttaccgggagttcgatgagatggaggagtgcgcctcacacctcccttacatcgaacaggggatgcagctcgctgagcagttcaaacaaaaggcgcttgggctgctgcaaacggccaccaagcaagcggaggctgctgctcccgtggtggagtccaagtggcgggcccttgaggccttttgggcgaagcacatgtggaacttcatcagcggaatacagtacctggcaggcttgtccactctgcatggcaatcccgcaatagcatcactgatggcatttacagcctctatcaccagcccgctcaccacccaacacaccctcctgtttaacatcttggggggatgggtggccgcccaacttgctccccctagtgctgcttcggctttcgtaggtgccggcatcgctggtgcagccgtcggcagcataggtctcgggaaggtgctcgttgacgtcctggcgggttatggagcaggcgtggcaggcgcacttgtggcctttaaggttatgagtggcgaggtgccctccaccgaggacctggtcaatttgctccctgccgtcctctctcctggtgccctggtcgtcggggtcgtgtgcgcagcaatactgcgtcggcacgtgggcccaggagagggggctgtgcagtggatgaaccggctgatagcgttcgcttcgcggggtaaccatgtttcccccacgcactatgtgcctgaaagcgacgccgcagcacgtgtcactcaaatcctctccagcctcaccgtcacccaactgttgaggaggctccaccaatggattaatgaggattgctccacgccgtgctccggttcctggctgagagatgtttgggactggatatgtacggtgctgactgacttcaagacctggctccaatccaaactcctgccgcggttaccaggagtcccctttttctcgtgtcaacgcgggtacaggggagtctggcggggagacggcatcatgcagaccacctgcccatgtggagcacaaatctctggacatgtcaaaaatggttccatgaggatcgttgggcctagatcctgcagcaacacgtggcatggaacattccccattaatgcgtacaccacgggcccctgcacgcccgccccggcgccaaactactccagggcactgtggcgggtggctgctgaggagtacgtggaggtcacgcgggtgggggatttccactacgtgacaggcatgaccactgacaacgtaaagtgcccatgtcaggttccagcccccgaattcttcacagaggtggatggagtgcggctgcacaggtacgctccggcgtgcaaacccctcctacgggaggaggtcacattccaggtcgggctcaaccagtacttggttgggtcacagctcccgtgtgagcccgagccggacgtagcagtgctcacctccatgcttaccgatccttctcacatcacagcagagacggctaagcgtaggctggatagggggtctcccccctccttggccagttcttcagccagccagttatctgcgccttctttgaaggcgacttgcactacccgtcacgactccccagacgccggcctcattgaggccaatctcctgtggcggcaggagatgggcgggaacatcactcgcgtggagtcagagaacaaggtagtgattctggactctttcgagccgcttcgagcggaagaggatgagagggaagtatccgttccggcggaaatcctgcgaaaatccaggaaattccccagagcgatgcccatatgggcacgcccggattacaatcctccactgctagagtcctggaagaacccggactacgtccctccggtggtacacgggtgcccattgccgcccatcaagggccccccaataccacccccacggagaaagaggacggttgtcctaacagaatccaccgtgtcttctgccttggcggagctcgccacaaagaccttcggcagctccggatcatcggctgtcgacagcggtacagcgagcgccccccctgaccagccctctgacaacggcgacgcgggatccgacgctgagtcgtactcctccatgcccccccttgaaggggagccgggggaccccgatctcagcgacgggtcttggtctaccgtgagcgaggaggccagtgaggacgtcgtctgctgctcgatgtcctacacgtggacaggcgctctgatcacaccatgcgctgcggaggagagcaaattacccatcaatgcgctgagcaactccttgctgcgtcaccacaacatggtctatgccacaacatcccgcagtgccagtcagcgacagaagaaggttacctttgacagactgcaagtcctggacgaccactaccgggacgtgcttaaggagatgaaggcgaaggcgtccacagtcaaggccaagcttctatccgtagaagaagcctgtaagctgacgcccccacactcggccaaatccaaatttggctacggggcaaaggacgtccggaacctgtccagcaaggccgttaaccacatccgctccgtgtggaaggacttgctggaagacactgagacaccaatagacaccaccatcatggcaaagaacgaggtcttctgcgtccagccagagaagggaggccgcaagccagctcgccttatcgtgttcccggatttgggggtccgtgtgtgcgagaaaatggccctttacgacgtggtctccaccctccctcaggccgtgatgggctcctcatacggattccagtactctcctggacagcgggtcgagttcctggtgaatgcctggaaatcaaagaaaagccccatgggcttcgcatatgacacccgctgttttgactcaacggtcactgagagtgacatccgtgttgaggagtcaatttaccaatgttgtgacttagtccccgaagctagacaggccataaggtcgctcacagagcgactttatgtcgggggtcctctgactaattcaaaagggcagaactgcggttatcgccggtgccgcgcgagcggcgtgctgacgactagctgcggtaacacccttacatgttacttgaaggcctctgcagcctgtcgagctgcaaagctccaggactgcacgatgctcgtgtgcggagacgaccttgtcgttatctgtgaaagcgcgggaacccaagaggacgcggcgagcctacgagtctttacggaggctatgactaggtattccgccccccccggggacccgccccaaccagaatacgacttggagctgataacatcgtgctcctccaatgtgtcggtcgctcacgatgcatctggcaaaagagtgtactacctcacccgtgaccccaccaccccccttgcgcgggctgcgtgggagacagctagacacactccagtcaactcctggctaggcaacatcattatgtacgcacccactttgtgggcaaggatgattctgatgactcacttcttctccatcctcctagcccaggagcaacttgaaaaagccctagattgtcaaatctacggggcctactactccattgagccacttgacctacctcagatcattgaacgactccacggtcttagcgcattttcgctccatagttactctccaggcgagatcaatagggtggcttcatgcctcagaaaacttggggtaccacccttgcgagcctggagacatcgggccaggagtgtccgcgctaagctgctgtctcaggggggaagggccgccacttgtggcaaatacctcttcaactgggcagtaaagaccaagctcaaactcactccaattccggctgcgtcccagttggacttgtccggctggttcgttgctggctacggcgggggagacatatatcacagcctgtctcgcgcccgaccccgctggttcatgttgtgcctacccctactctctgtaggggtaggcatcaacctgctccccaaccggtgaatggggagctaaacactccaggccaataggccaacctgttttttttttttttttttttttttttccttttttttttttttttttttttttttttttttttcctttttttctttttttttttttttttccttccttttggtggctccatcttagccctagtcacggctagctgtgaaaggtccgtgagccgcatgactgcagagagtgctgatactggcctctctgcagatcatgt

SEQ ID NO: 711 - DNA, 9361 bp, Hepatitis C Virus
  misc_feature 577: n = A,T,C or G
atcactcccctgtgaggaactactgtcttcacgcagaaagcgcctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacttgttgccgcgcaggggccccaggttgggtgtgcgcscgactaggaagacttccgagcggtcacaacctcgtggaaggcgacaacctatccccaaggttcgccgacccgagggcagagcctgggctcagcccgggtatccttggcccctctatggcaatgagggcntggggtgggcaggatggctcctgtcaccccgtggctcccggcctagttggggccccacagacccccggcgtaggtcgcgtaatctgggtaaggtcatcgataccctcacatgcggcttcgccgacctcatggggtatattccgcttgtcggcgcccccctagggggcgctgccagggccctggcgcatggcgtccgggttctggaggacggcgtgaactatgcaacagggaatctgcccggttgctctttctctatcttcctcttggctctgttatcttgtctgaccatgcctgcttccgcttatgaggtgcgcaacgtgtccggggcgtaccatgtcacgaacgactgctccaactcaagcatagtgtatgaggcagcggacatgatcatgcacacccccgggtgcgtgccctgcgttcgggagaacaactcctcccgctgctgggtggcgctcactcccacgcttgcggctaggaatggtagcgtccccactacggcaatacgacgccatgtcgatttgctcgttggggcggctaccttctgctccgctatgtacgtgggggatctctgcggatctgttttccttgtttcccagctgttcaccttctcgcctcgccggcatgagacagtgcaggactgcaactgttcaatctatcccggccacgtatcaggtcaccgtatggcttgggatatgatgatgaactggtcacccacaacagctctagtggtgtcgcagttactccggatcccacaagccatcatggacatggtggcgggggcccactggggagtcctggcgggccttgcctactactccatggtggggaactgggctaaggttttgattgtcatgctactctttgccggcgtcgacggggatacctatgtgacaggagggacgagcggccgcgccaccgccgggttcgtgtccctctttgcatccggaccaactcagagaatccagcttgtaaacaccaacggtagctggcacatcaataggaccgccctcaactgcaacgagtccctcaacaccgggttccttgccgcgctgttctatacacacaagttcaatgcgtccggatgcccggagcgcatggccagctgccgccccatcgacaagttcgctcagggatggggtcctatcacctacaccgagcccgaggacctggaccagaggccttactgctggcactacgcacctagaaagtgcggcatcatacccgcggcggaggtgtgcggcccagtatactgcttcaccccgagccctgtcgtggtggggacaaccgatcggttcggcgttcctacgtatagatggggggagaacgagacggacgtgctgctcctcaacaacacgcggccaccgcaaggcaactggttcggctgtacatggatgaatagcactgggttcaccaagacgtgcgggggccccccctgtaacatcgggggggccggcaacaacaccttgctatgccccacggattgcttccggaagcaccccgacgccacatacaccaaatgcggttcagggccttggttgacacctaggtgcatggttgactacccatacagactctggcattacccctgcactgtcaactttaccgtcttcaaggtgaggatgtacgtggggggcgtggaacacaggctcagcgctgcatgcaattggactcggggagagcgttgcgacttggaggacagggacagatcggagctcagcccgctgctgctgtctacaacagagtggcaagtgttgccctgttccttcaccaccttgcccgccctgtccactggtttgatccatctacatcagaacatcgtggacgtgcagtacctgtacggtatagggtcggcggttgtctcctttgccatcaaatgggagtatatcctgctgctcttcctcctcctggcgtacgcgcgagtctgcgcttgcctgtggatgatgctgctgatagcccaggctgaggccgccctagagatcctggtggtcctcaatgcggcgtccgtggccggggcacacggcattctctccttccttgtgttcttctgtgctgcctggtacatcaagggcaggctggtccctggggcggcatacgccctctacggcgtgtggccgctgctcctgctcctgctggcgttaccaccgcgagcatatgccatggaccgggagatggctgcatcatgtggaggcgcggttttcataggtctggcaattttgaccttgtcaccgcactataaggtgctcctagcaaaacttatatggtggtcacaatactttatcaccagggccgaggcgcatgtgcaagtgtggaccccccccctcaacgttcgggggggccgtgatgccatcatcctcctcacttgcgcggtccacccagagctaatctttgaaatcaccaagattttgctcgccgtgctcggtccgctcatggtactccaggctggcataaccagagtgccgtactttgtgcgcgctcagggcctcattcgtgtgtgcatgttggtgcggaaagccgctgggggtcattacgtccaaatggccctcatgaggttgggcgccctgacaggcacgtacctttatgaccatcttactccactgcgggactgggcccacgcgggcctgcgggacctcgcggtggcagttgagcccgtcatcttctctgacatggagaccaaggtcatcacctggggggcagacaccgcggcgtgtggggacatcatctcgggcctacccgtctccgcccgaagggggagggagatacttctaggaccggccgatagctttaaggggcagggatggcgactccttgcgcctattacggcctactcccagcagacgcggggcctacttggctgcatcatcactagcctcacaggccgggataagaaccaggtcgagggggaagtccaagtggtttccaccgcaacccagtctttcctagcaacctgtgtcagcggcgcgtgttggactgtctaccatggtgccggctcaaagaccctagctggcccgaaaggaccaatcacccaaatgtacaccaatgtagaccaggatctcgtcggctggccggcgccccctggggcgcgctccttgacgccatgcacctgcggcagctcggacctttacttggtcacgaggcatgccgatgtcattccggtgcgccggcggggcgacagcagggggagcctgctctctcccaggcccatctcctatttaaagggttcttcgggtggaccactgctctgcccctcggggcacgctgtgggcatcttccgggctgctgtgtgcacccggggggttgccaaggcggtggactttgtacccgttgagtccatggaaaccactatgcggtctccggtcttcacggacaactcgtcccccccggccgtaccgcagacattccaagtggcccatctgcacgctcccactggcagcggtaagagcactaaggtgccggctgcatacgcagcccaagggtacaaggtactcgtcctgaacccgtccgttgccgctaccttaagtttcggggcgtatatgtccaaggcacatggtgtcgaacccaacattagaactggggtaaggaccgtcaccacgggcgccggcattacgtattccacctacggcaagttccttgctgatggcggttgctctggaggcgcctatgacatcataatatgtgatgagtgccactcaactgactcgactaccatcttgggcatcggcacggtcctggaccaagcggagacggctggagcgcgactcgtcgtgctcgccaccgctacgcctccgggatcggtcaccgtgccacatcccaacattgaggaggtggccctgtccaacactggagagatccccttctatggcaaagccatccccgttgaggtcatcaaggggggaaggcatctcattttctgccactccaagaagaaatgtgacgagctcgccgcaaaactgtcgggcctcggactcaatgctgtagcgtattaccggggccttgatgtgtccgtcataccgaccagcggagacgtcgttgtcgtagcaactgacgctctaatgacgggctttactggcgactttgactcagtgatcgactgtaacacgtgtgtcacccaaacagtcgatttcagcctggaccccaccttcaccatcgaaacgacgaccgtgccccaggacgcagtgtcgcgctcgcagcggcggggcaggactggcaggggcagggcaggcatctacaggtttgtgactccgggagaacggccttcgggcatgttcgactcttcggtcctgtgcgagtgctatgacgcgggctgtgcatggtacgagcttacgcccgccgagacctcagttagggtacgggcttacctaaatacaccagggttgcccgtctgccaggaccacttggagttctgggaaagcgtctttacaggccttacccacatagatgctcacttcttgtcccagactaagcaggcaggagacaacttcccctatctggtagcataccaggctacggtgtgcgccagggcccaggccccacctccatcatgggatcaaatgtggaagtgcctcatacggctaaaacctacgctgcacggaccaacgcccctgctgtataggatgggagccgtccaaaacgaggtcaacctcacacaccccgtaaccaaatacatcatggcatgcatgtcggctgacctggaggtcgtcaccagcacctgggtgcttgtaggcggggtcctcgcggctctggccgcatattgtttgacaacaggcagcgtggtcattgtgggcaggatcatcttgtccggaaagccggcaatcattcccgacagggaagctctctaccaggcgttcgatgagatggaggagtgcgcctcacacctcccttacatcgaacagggaatgcaactcgccgagcaattcaagcagaaggcgctcgggttgttgcaaacagcgaccaaacaagcggaggccgctgctcccgtggtggagtccaagtggcgggcccttgagaccttctgggcgaagcacatgtggaacttcattagcgggatacagtacttagcaggcttgtccactctgcctgggaaccccgcaatagcatcactgatggcattcacagcctctatcactagcccgctcaccactcaacacaccctcctgtttaatatcttggggggatgggtagccgcccaactcgcgccccccagcgccgcttctgccttcgtgggcgccggcattgcaggtgcggctgttggcagtataggccttgggaaagtgcttgtggacatcctggcgggctatggagcgggggtggcaggcgcgctcgtggcctttaaggtcatgagtggcgagatgccctctacagaggatctggtcaacttactccctgctatcctctctcctggtgccctggtcgtcggagtcgtgtgcgcagcaatactgcggcggcatgtgggcccaggagagggggcggtacaatggatgaaccggctgatagcgttcgcttcacggggtaaccacgtttcccccacgcactacgtgcctgagagcgacgctgcagcgcgtgtcactcagatcctctctagccttaccatcactcagctgctgaagaggctccaccagtggattaatgaggactgctccacgccgtgttccggctcgtggctaagggacatctgggactggatatgcacggtgttgtctgacttcaagacctggctccagtccaagcttctgccgcggttaccgggagtccccttcttctcatgccaacgtgggtataagggagtctggcgcggagacggcatcatgcacaccacctgttcatgtggggcacagatcaccggacatgtcaaaaacggttccatgaggatcgttgggccaaaaacctgcagtaacacgtggcatggaacatttcccatcaacgcgtacaccacgggcccttgcacaccctccccagcgccaaactatactagggcgctgtggagggtggccgcagaggagtacgtggaggttacgcgggtgggggatttccactacgtgacgggcatgaccaccgacaacgtcaagtgcccatgccaggttccggcccccgaattcttcacagaagtggatggggtgcggctgcataggtacgctccggcgtgcaaacccctcctacgggaggaggtcacattccaggtcgggctcaaccagtatctggtcgggtcgcagcttccgtgtgagcccgagccggacgtgacaacgctcacctccatgctcatcgacccctcccacatcacagcagagactgctaagcgtaggttggccagagggtctcccccctccttggccagctcctcagctagccagttatctgcgccttccctgaaggcgacatgcaccactcaccatgactccccagacgctgacctcattgaggccaacctcctgtggcggcaggagatgggcggaaacatcacccgcgtggagtctgagaacaaggtagtaatcctggactctttcgacccgcttcgagcggaggaggacgaaagggaagtgtccgttccagcggagatcctgcggaaatccaggagattcccttcagcgatgcccgtgtgggcacgcccagattacaaccctccattgctagagtcttgggagaacccggactacgtccctccagtggtacacgggtgcccattgccacctactaaggccccaccaataccacctccacggaggaagaggacggttgtcctgacagaatccaccgtgtcttccgccctggcggagcttgctactaagaccttcggtagctccggatcgtcagccgttgacagcggcacggcgaccgcccctcccgaccagtcccccgacgacggcgacgcagggtctgacgctgggtcgtactcctccatgcccccccttgagggggagccgggggatcccgatctcagcgacgggtcctggtctaccgtgagcgaggaggctagtgaggacgtcgtttgctgctcgatgtcctacacatggacaggcgccctgatcacgccatgcgccgcggaggagagcaagctgcccatcaatgcgctgagcaactctttgctgcgtcaccataacatggtgtacgccacaacatcccgcagcgcaagtcagcggcagaagaaggtcacctttgacagactgcaggtcctggatgaccattaccgggacgtgcttaaggagatgaaggcggaggcgtccacagttaaggctaaacttctatccgtggaagaagcctgcaagctgacgcccccacactcggccaagtctaaatttggctatggggcaaaggacgtccggaacctatccagcaaggccgttaaccacatccgctccgtgtgggaggacctgctggaagacactgagacaccaatcgagaccgtcatcatggcaaaaaatgaggttttctgcgtcaaaccaraaatgggaggccgcaagccagctcgcttaatcgtgttcccagacttgggggttcgtgtatgcgagaaaatggccctctacgacgtggtctccacccttcctcaggccgtgatgggctcctcatatggattccagtactctcctgcacagcgggtcgagttcctggtgaatgcctggaaatcaaagaaaaaccctatgggtttctcgtatgacacccgctgttttgactcgacggttactgagaatgacatccgtgttgaggagtcaatttatcaatgttgtgacttgacccccgaagccagacaggctataaggtcgctcacggagcggctttacatcgggggccccatgaccaattcaaaagggcagaactgcggttatcgccggtgccgcgcgagcggcgtgctgacgactagctgcggtaataccctcacatgttacttgaaagcctctgcggcctgtcgagctgcaaagctccagagctgcacgatgctcgtgaacggagacgacctcgtcgttatctgtgagagcgcgggaacccaagaggacgcggcgagcctacgagtcttcacggaggctatgactaggtactctgccccccccggggacctgccccaaccagaatacgacttggagttgataacatcatgctcctccaatgtgtcagtcgcgcacgatgcatctggcaaaagagtatactacctcacccgcgaccccaccaccccccttgcacgggctgcgtgggagacagctagacacactccagttaactcctggctaggcaacatcatcatgtacgcgcccaccatatgggcaaggatgattctgatgactcacttcttttccatccttctagtccaggagcaacttgagaaagccctagattgtcagatctacggggcctattactccattgagccacttgacctacctcagatcattcaacgactccatggtcttagcgcattctcactccacagttaccctccaggtgagatcaatagggtggcttcatgcctcaggaaacttggggtaccgcccttgcgagtctggagacatcgggccagaagtgtccgcgctaagctactgtctcagggggggagggctgccacatgtggtagatacctcttcaactgggcagtaaggaccaagctcaaactcactccaattccggctgcatctcggttggacttgtccggctggtttgttgctggttacagcgggggagacatatatcacagcctgtctcgtgcccgaccccgctggtttatgttgtgcctcttcctactttccgtaggggtaggcatctatctgctccccaaccgatgaacggggagccaaccactccagg

SEQ ID NO: 712 - DNA, 9424 bp, Hepatitis C Virus
gccaaccccctgatgggggcgacactccaccatgaattactcccctgtgaggaactactgtcttcacgcaaaaagcgtctagccatggcgttagtatgagtgtcgtgcagcctccaggaccccccctcccgggagagccatagtggtctgcggaaccggtgagtacaccggaattgccaggacgaccgggtcctttcttggataaccccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcgcgtcggcccgagggcaggacctgggctcagcccgggtacccttggcccctctatggcaacgagggctgcggttgggcgggatggctcctgtctccccgcggctctcggcctagctggggccccacagacccccggcgtaggtcgcgcaatttgggtaaggtcatcgatacccttacgtgcggcttcgccgacctcatggggtacataccgctcgtcggcgctcctcttggaggcgctgccagggccctggcgcatggcgtcagggttctggaagacggcgtgaactatgcaacagggaatcttcctggttgctctttctctatcttccttctggccctgctctcttgtttgaccgtgcccgcttcggcctaccaagtgcgcaactccacggggctctaccatgtcaccaacgattgccctaattcgagtattgtgtacgaggcagccgacgctatcctgcacactccggggtgtgtcccttgcgttcgcgagggtaacgtctcgaggtgttgggtggcgatcacccccacggtggccaccaaggacggcaaactccccacaacgcagcttcgacgtcacatcgatctgcttgtcgggagcgccaccctctgttcggccctctacgtgggggacctgtgcgggtctgtctttcttgtcggtcaactgttcaccttctctcccaggcgccattggacaacgcagggctgcaattgctccatctatcccggccatataacgggtcaccgcatggcatgggatatgatgatgaactggtcccctacgacggcgttggtggtggctcaactgctccggatcccacaagccatcttggacatgatcgctggtgcccactggggagtcctggcgggcatagcgtatttctccatggtggggaactgggcgaaggttctggtggtgctgctgctatttgccggcgtcgacgcggaaaccgtcgtcaccgggggaaatgtcgcccgcactacagctggatttgctggtctcttctcaccaggcgcccagcagaaaatccagttggtcaacaccaacggcagttggcacatcaatagtacggccttgaactgcaatgacacccttcaaaccggctggttagcggggcctttctatcaccacaaattcaatgcttcaggctgtcccgagaggttggccagctgccggcgccttactgattttgaccagggctggggccctatcagtcatgccaacggaagcggccccgaccaacgcccctactgctggcactactccccaaaaccttgtggtattgtgcccgcaaggagcgtgtgtggcccagtgtactgcttcactcccagccccgtggtagtgggaacgaccgacagggcgggcgtgcctacctacagctggggtgaaaatgagacggacgtcttcgtccttaacaacaccaggccaccgctgggcaattggttcggttgcacctggatgaactcaactggattcaccaaagtgtgcggagcgcccccctgtgtcatcggaggggtgggcaacaacaccttgcactgccccactgattgcttccgcaagcatccggaagccacatactctcgatgcggctccggtccctggattactcctaggtgcctggtcaactacccgtataggctttggcattatccttgtaccatcaactacaccatattcaaagtcaggatgtacgtgggaggggtcgagcacaggctggaagctgcctgcaactggacgcggggcgaacgttgcgatctggaagacagggacaggtccgaactcagcccgttgctgctgtccaccacacaatggcaggtccttccgtgttccttcacgaccctgccagccttgtccaccggcctcatccacctccaccagaacatcgtggacgtgcagtatttgtacggggtggggtcaagcatcgcgtcctgggccattaagtgggagtacgtcgtcctcctgttccttctgcttgcagacgcgcgcgtctgctcctgcttgtggatgatgctactcatatcccaagcggaggcggctttggagaacctcgtgatactcaatgcagcatccctggccgggacacacggtctcgcatccttcctcgtgttcttctgctttgcgtggtatctgaagggtaggtgggtgcccggagcggtctacgccctctacgggatgtggcctctcctcctgctcctgttggcgttgccccaacgggcgtacgcgctggacacggaggtggccgcgtcgtgtggcggcgttgttcttgtcgggttaatggcgctgactctgtcaccatattacaagcactatatcagctggtgcttatggtggcttcagtattttctgaccagagtagaagcgcaactgcacgtgtggattccccccctcaacgtccgaggggggcgtgacgccatcatcttactcatgtgtgctgtacacccgtctctggtatttgacatcaccaaactgctgctggccgtcttcggacccctctggattcttcaagccagtttgcttaaagtgccctactttgtgcgcgtccaaggccttctccggatctgcgcgctggcgcggaagatggccggaggccattacgtgcaaatggctgtcatcaagttaggggcgctcactggcacctatgtctatgaccatctcacccctcttcgggactgggcgcataacagcctgcgggatttagccgtggccgtagagccagtcgtcttctcccaaatggagaccaagctcatcacgtggggggcagacaccgccgcgtgcggtgacatcatcaatggcttgcccgtctccgcccgcaggggccgggagatactgctcgggccagccgatggaatggtctccaagggctggagattgctggcgcccatcacggcgtacgcccagcagacaaggggcctcctagggtgtataatcaccagcctaactggccgggacaaaaaccaagtggagggtgaggtccagattgtgtcaacagctgcccaaaccttcctggcaacgtgcatcaatggggtatgttggactgtctaccatggggccggaacgaggaccatcgcgtcacccaagggtcctgttatccagatgtataccaatgtagaccaagaccttgtaggctggcccgctcctcaaggtgcccgttcattgacaccctgcacctgcggctcctcggacctttacctggtcacgaggcacgccgatgtcattcccgtgcgccggcggggcgatagcaggggcagcctgctttcgcctcggcccatttcttacttgaagggctcctcggggggtccgctgttgtgccccgcagggcacgccgtgggcatattcagggccgcggtgtgcacccgtggagtggctaaggcggtggactttatccctgtggaaaacctagagacaaccatgaggtccccggtgttcacggacaactcctctccaccagcagtgccccagagcttccaggtggcccacctgcatgctcccacaggcagccgcaagagcaccaaggtcccggctgcatatgcagctcagggctataaggtgctagtgctcaacccctctgtcgctgcaacactgggctttggtgcttacatgtccaaggctcatgggatcgatcctaacatcaggaccggggtgagaacaattaccactggcagccccattacgtactccacctacggcaagttccttgccgacggcgggtgctcagggggcgcttatgacataataatctgtgacgagtgccactccacggatgccacatccatcttgggcatcggcactgtccttgaccaagcaaagactgcgggggcgagactggttgtgctcgccaccggcacccctccgggctccgtcactgtgccccatcccaacatcgaggaggttgctctgtccactaccggagagatccctttttatggcaaggctattcccctcgaagcaatcaagggggggagacatctcattttctgccactcaaagaaaaagtgcgacgagctcgccggaaaactggtcgcattgggcatcaatgccgtggcctattaccgcggccttgacgtgtccgtcatcccgaccagcggcgatgttgtcgtcgtggcaactgatgccctcatgaccggctataccggcgacttcgactcggtgatagactgcaacacgtgtgtcacccagacagtcgatttcagccttgaccctaccttcaccattgagacaaccacgcttccccaggatgccgtctcccgcactcaacgtcggggcagaactggcagggggaagtcgggcatctacagatttgtggcaccgggggagcgcccctccggcatgttcgactcgtccgtcctctgtgagtgctatgacgcaggctgtgcttggtatgagctcacgcccgccgagactacagttaggctacgagcgtacatgaacaccccggggcttcccgtgtgccaggaccatcttgaattttgggagggcgtctttacaggcctcactcatatagatgcccacttcctatctcagacaaagcagagcggggagaactttccttacctggtagcgtaccaagccaccgtgtgcgctagggctcaggcccctcccccatcgtgggaccagatgtggaagtgtttgacccgcctcaaacccactctccatgggccaacacccctgctatacagactgggcgccgttcagaatgaagtcaccctgacgcacccaatcaccaaatacatcatgacatgcatgtcggctgacctggaggtcgtcacgagcacctgggtgctcgttggcggcgtcctagctgctttggctgcgtattgcctgtcaacgggctgcgtggtcatagtgggcagggtcgtcttgtccgggaagccggcaatcatacctgacagggaagttctctaccgggagttcgatgagatggaagagtgctctcagcacctaccgtacatcgagcaagggatgatgctcgccgagcagttcaagcagaaggccctcggcctcctgcagaccgcgtcccgccaggcagaggttatcgtccctgaagtccagaccaactggcaaaaactcgaggccttttgggcgaagcatatgtggaatttcatcagtgggatacaatacttagcaggcttgtcaacgttgcctggtaaccccgccattgcttcattgatggcttttacagctgctgtcaccagcccactaaccactagccaaaccctcctcttcaatatattgggggggtgggtggctgctcaactcgccgcccccggtgccgctaccgcctttgtgggcgctggcttagctggcgccgccatcggcagtgttggactggggaaggtcctcgtggacattcttgcagggtatggcgcgggcgtggcaggggctctcgtggcattcaagatcatgagcggtgaggtcccctccacagaagaccttggtcaatttaatgcccgccatcctttcgcctggagcccttgtggtcggtgtggtctgtgcagcaatactgcgccggcacgttggcccgggcgagggggcagtgcaatggatgaaccggctaatagccttcgcctcccgggggaaccatgtttcccccacgcactatgtgccggagagcgatgcagctgcccgcgtcactgctatactcagcagcctcactgtaacccagctcctgaggcgactgcaccagtgggtaagctcggagtgtaccactccttgctccggttcctggctaagagacatctgggactggatatgcgaggtgctgagcgactttaagacctggctaaaagccaagctcatgccacaactgcctgggattccctttgtgtcctgccagcgcgggtataagggggtctggcgaggggacggcattatgcacactcgctgccactgtggagctgagatcactggacatgtcaaaaacgggacgatgaggatcgtcggtcctaagacctgcaggaacatgtggagtgggaccttccccattaacgcctacaccacgggtccctgtaacccccttcccgcgccgaactacacgttcgcgctgtggagggtgtctgcagaggaatacgtggaggtaaggcaggtgggggacttccactacgtaacgggtatgactactgacaatcttaaatgcccgtgccaggtcccatcgcccgaatttttcacagagttggacggggtgcgcctacataggttcgcgcccccctgcaagcccttgctgcgggaggaggtatcattcagagtaggactccacgagtacccggtggggtcgcaattaccttgcgagcccgaaccggacgtggccgtgttgacgtccatgctcactgatccctcccatataacagcagaggcggccgggagaaggttggcgaggggatcacccccctcgttggccagctcctcggctagccagctgtctgctccatctctcaaggcaacttgcaccgccaatcacgactcccctgacgccgagctcatagaagctaacctcctatggaggcaggagatgggcggcaacatcaccagggttgagtcagagaacaaagtggtgattctggactctttcgatccgcttgtggcggaggaggacgagcgggagatctccgtacccgcagaaatcctgcggaagtctcggagattcgcccaggccctgcccgtttgggcgcggccggactataaccccccgctgttggagacgtggaaaaagcctgactacgaaccacctgtggtccatggctgtccgcttccacctccacggtcccctcctgtgcctccgcctcggaagaagcggacggtggtcctcaccgaatcaaccgtatccactgccttggccgagctcgccaccaaaagttttggcgactcctcaacttccggcattacgggtgacaatacgacaacatcctctgagcctgcctcttctggctgccccccagactccgacgctgagtcctattcttccatgccccccctggagggggagcctggggatccggatcttagcgacgggtcatggtcgacggtcagtagtgaggccggcacggaagatgtcgtgtgctgctcgatgtcttattcctggacaggcgcactcgtcactccgtgcgccgcggaagaacagaaactgcccatcaatgcactgagcaactcgttgctacgccaccacaatatggtgtattctaccacctcacgcagtgcttgccaaaggcagaagaaagtcacatttgacagactgcaagttctggacagccattaccaggacgtgctcaaggaggttaaagcagcggcgtcaacagtgaaggctaacttgctatccgtagaggaagcttgcagcctgacgcccccccactcagccaaatccaagtttggctatggggcaaaaaacgtccgttgccatgccagaaaggccgtaaaccacattaactccgtgtggaaagaccttttggagacaagtgtaacaccaatagacccttccctcttgggtaagaacgaagttttttgcgttcaacctgagaaggggggtcttaagccaacttgtctcttcttgtcccccgacctgggtgtgcgcgtgtgcgagaagatggccctggacgacgtggttccaaagctcccccaggacgtgatgggaagctcctacggattccaatactcaccaggacagcgggttgagtttcttgtgcaagcgtggaagtccaaaaggaccccaaaggggttctcgtatgatacccgctgttttgactccacagtcactgagagtgatatccgtacggaggaggcaatctaccaatgttgtgacctggacccccaagcccgcgtggccatcaagtctctcactgagaggctttatgttgggggccctcttaccaattcaaagggggagaactgcggctaccgcaggtgccgcgcgagcggcgtactgacgactagctgtggtaacaccctcacttgctacatcaaggcccgagcagcctgtcgagccgcagggctccaggactgcaccatgctcgtgtgtggcgacgacttagtcgttatctgtgaaagtgcgggagtccaggaggacgcggcgagcctgagagccttcacggaggctatgaccaggtactccgccccccctggggaccccccacaaccagaatacgacttggagctcataacatcatgctcctccaacgtgtcggtcgcccacgacggcgctggaaagagggtctactaccttacccgtgaccctacaacccccctcgcgagagccgcgtgggagacagcaagacacactccagtcaattcctggctaggcaacataattatgtttgcccccacactgtgggcgaggatgatactgatgacccacttatttagcgtcctcatagccagggatcaacttgtacaggcccttgattgcgaaatctacggagcctgctactccatagaaccactggatctacctccaattattcaaagactccatggcctcagcgcgttttcactccacagttactctccaggtgaaatcaatagggtggccgcatgcctcagaaaacttggggttccgcccttgcgagcttggagacaccgggcccggagcgtccgcgctagacttctgtccagaggaggcagggctgccatatgtggcaagtacctcttcaactgggcagtaaaaacaaagctcaaactcactccaatagcggccgctggccggctggacttgtctggctggttcacggctggctacagcgggggagacatttatcacagcgtgtctcatgcccggccccgctggttctggtttagcctactcctgctcgctgcaggggtaggcatctacctcctccccaaccgatgaaggttggggtaaacactccggcctcttaggccatttcctgtgtctc

SEQ ID NO: 713 - DNA, 9426 bp, Hepatitis C Virus
accagccccctgatgggggcgacactccaccatgaatcactcccctgtgaggaactactgtcttcacgcagaaagcgtctagccatggcgttagtatgagtgtcgtacagcctccaggaccccccctcccgggagagccatagtggtctgcggaaccggtgagtacaccggaattgccaggacgaccgggtcctttcttggatcaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacgattcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcacgtcggcccgagggcaggacctgggctcagcccgggtacccttggcccctctatggcaatgagggctgcgggtgggcgggatggctcctgtctccccgtggctctcggcctagttggggccccacagacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttctggaagacggcgtgaactatgcaacagggaatcttcctggttgctctttctctatgttccttctggccctgctctcttgcctggctgtgcccgcgtcagcctaccaagtacgcaactcctcgggcctctaccatgtcaccaatgattgccccaactcgagtattgtgtacgagacggccgataccatccttcactctccggggtgtgtcccttgcgttcgcgggggtaacgcctcgaagtgttgggtggcggtggcccccacggtggccaccagggacggcaaactccccacaacgcagcttcgacgtcacatcgatctgcttgtcgggagtgccaccctctgctcggccctctatgtgggggacttgtgcgggtctgtcttccttgtcggccaactgttcaccttctcccccaggcgccactggacaacgcaggactgcaactgttctatctaccccggccacataacgggtcaccgtatggcatgggatatgatgatgaactggtcccctacaacagcgctggtagtcgctcagctgctcagggtcccgcaagccatcttggacatgatcgctggtgcccactggggagtcctagcgggcatagcgtatttctccatggtggggaactgggcgaaggtcgtagtggtgctgttgctgttcgctggcgtcgatgcacacacctacaccaccggggggagtgctgctcggaccacgtttggcatcgccagttttctcgatcgtggccccaagcagaatgtccagctgatcaacaccaacggcagttggcacatcaatcgtacggccttgaattgtaatgcgagcctcgacactggatgggtggcggggctcttctattaccacaaattcaactcttcaggctgccccgagaggatggccagctccagaccccttgccgatttcgaccaggggtggggccccatcagacacgccaacggaagcggccccgaacaccgtccctactgctggcactaccccccaaagccttgtggtatcgtgccggcacagagtgtgtgtggcccagtgtattgcttcacccccagccctgtggtggtgggaacgaccgacaaattgggcgcgcctacctacacctggggtagcaatgacacggacgttttcgtccttaataacaccaggccaccgtcgggcaattggttcggttgcacctggatgaattcatctggatttaccaaagtgtgcggagcgcctccttgtgtcatcggaggggtgggcaacaacaccttacactgccccactgactgtttccgcaagcatccggaagccacatactctcggtgtggctccggtccctggatcacgcccaggtgcctggtcaactacccgtataggctctggcattatccttgtaccatgaactacaccatatttaaggtcaggatgtacgtgggaggggtcgagcacaggctggaagctgcctgcaactggacgcggggtgagcgttgtgatctggaagacagggacaggtccgagctcagcccgttgctgctgtccaccacacagtggcaggtccttccgtgttccttcacgaccctgccagccttgtccaccggcctcatccacctccaccagaacattgtggacgtgcagtacttgtacggggtggggtcaagcatcgcgtcctgggccattaagtgggagtacgtcgttctcctgttccttctgcttgcagacgcgcgcgtctgctcctgcttgtggatgatgctactcatatcccaagtggaggcggctttggagaacctcgtagtactcaatgcagcatccctggccgggacgcacggtcttgtatccttcctcatgttcttctgccttgcatggtatctgaagggtaaagtgggtgcccggagcggcctacgccttctacgggatgtggcctctcctcctgctcctgttggcgttgccccagcgggcatacgcgctggacacggaggtggccgcgtcgtgtggcggcgttgtgcttgtcgggttaatggcgctaactctgtcaccgtattacaagcactatgtcagctggtgcttatggtggctccagtattttctgaccagagcagaagcgcaactgcacgtgtgggttccccccctcaacgtccgaggggggcgtgacgccatcatcttactcatgtgtgctgtacacccgtctctggtatttgacatcaccaaactgctgctggccgtcttcggacccctctggattcttcaagccagtttgcttaaagtgccctactttgtgcgcgtccaaggccttctccggatttgcgcgctggcgcggaagatggccggaggccattacgtgcaaatggctgtcatcaagttaggggcgctcactggcacctatgtctatgaccatctcacccctcttagggactgggcgcacaacagcctgcgggatttagccgtggccgtagagccagtcgtcttctcccaaatggagaccaagctcatcacgtggggggcagacactgctgcgtgcggtgacatcatcgatggcttgcccgtttccgcccgcaggggccgggaaatactgctcggaccagccgacggaatggtctctaaggggtggaggttgctggcgcccatcacggcgtacgcccagcagacaaggggcctcctagggtgcataatcaccagcctaactggccgggacaaaaaccaagtggagggtgaggcccacattgtgtcaactgctacccaaactttcctggcaacgtgcatcaatggggtatgctggactgtctaccacggggccggaacgaggaccatcgcatcacccaagggtcctgttatccagatgtataccaatgtagacggagacctcgtgggctggcccgctcctcaaggtgcccgctcattgacaccctgcacctgcggctcctcggacctctacctggtcacgaggcacgccgatgtcattcccgtgcgccggcggggtgatagcaggggcagcctgctctcgccccggcccatttcctacctgaaaggctcctcggggggtccgctgttgtgccccgcgggacacgccgtgggcatattcagggccgcggtgtgcacccgtggagtggctaaggcggtggactttatccctgtagagaacctagagacaaccatgaggtccccggtgttcacggacaactcctccccaccagcagtgccccagagcttccaggtagcccacctgcatgctcccacaggcagcggcaagagcaccaaggtcccggctgcatacgcggctcagggctataaggtgctagtgctcaacccctctgtcgctgcaacactgggctttggcgtttacatgtccaaggcccatggggtcgatcctaacatcaggaccggggtgagaacaattaccactggcagccccatcacatactccacctacggcaagttccttgccgacggcgggtgctcagggggcgcctatgacataataatttgtgacgagtgccactccacggatgccacatccatcttgggcatcggcactgttcttgaccaagcagagactgcgggggcgagactagttgtgctcgccaccgctacccctccgggctctgttactgtgccccaccccaacatcgaggaggctgctctgtccaccaccggagagatccctttttacggcaaggctattcccctcgaagtaatcaagggggggagacatctcatcttttgtcactcaaagaagaagtgcgacgagctcgccgcaaagctggtcgcactgggcatcaatgccgtggcctactaccgcggtcttgacgtgtctgtcatcccgaccagcggcgacgttgtcgtcgtggcaactgatgccctcatgaccggctataccggcgactttgactcggtgatagactgcaacacgtgtgtcacccagacagtcgacttcagccttgaccctaccttcaccattgagacaaccacgcttcctcaggatgctgtctcccgcactcaacgtcggggcaggactggccgggggaagccgggcatctacagatttgtggcaccgggggagcgcccctccggcatgttcgactcgtccgtcctctgtgagtgctatgacgcgggctgtgcttggtacgagctcacgcccgccgagactacagttaggctacgagcgtacatgaacaccccggggcttcccgtgtgccaggaccatcttgaattttgggaaggcgtctttacaggcctcactcatatagatgcccacttcctgtcccagacaaagcagggcggggagaactttccttacctggtagcgtaccaagccaccgtgtgcgctagggctcaagcccctcccccatcgtgggaccagatgtggaagtgcttgatccgcctcaaacccacccttcatgggccaacacccctgctatacagactgggtgctgttcagcatgaaatcaccctgacgcacccagtcaccaaatacatcatgacatgcatgtcggccgacctggaggtcgtcacgagcacctgggtgctcgttggtggcgtcctggctgctttggccgcgtattgcctgtcgacaggctgcgtggtcatagtgggcagggttgtcttgtccgggaagccggcaatcatacctgacagggaagtcctctaccgggagttcgatgagatggaagagtgttctcagcacttaccgtacatcgagcaagggatgatgctcgccgagcagttcaagcagaaggcccttggcctcctgcaaaccgcgtcccgccaggcagaggtcatcgcccctgctgtccagaccaactggcaaaaactcgagaccttttgggcgaagcatatgtggaacttcatcagtgggatacaatatttggcgggcctgtcaacgttgcctggcaaccccgccatagcttcattgatggcttttacagctgctgtcaccagcccactaaccactagccaaaccctcctcttcaatatattgggggggtgggtggctgctcagctcgccgcccccggtgccgctaccgcctttgtgggcgctggcttggccggcgccgccatcggcagtgttggactggggaaggtcctcgtggacattcttgcagggtatggcgcgggcgtggcgggagctcttgtggcattcaagatcatgagcggtgaggtcccctccacggaggacctggtcaatctactgcccgccatcctctcgcctggagcccttgtagtcggtgtggtctgtgcagcaatactgcgccggcatgttggcccgggcgagggggcagtgcaatggatgaaccggctaatagccttcgcctcccgggggaaccatgtttcccccacgcactacgtgccggagagtgatgcagccgcccgcgtcactgccatactcggtagcctcactgtaacccagctcctgaggcgactgcaccagtggataagctcggagtgcaccactccgtgctccggttcctggataagggacatctgggactggatatgcgaggtgttgagcgactttaagacctggctaaaagccaagctcatgccacaactgcctgggatccccttcgtatcgtgccagcgcgggtataggggggtctggcgaggggacggcatcatgcacactcgctgccactgtggggctgagatcactggacatgtcaaaaacgggacgatgaggatcgtcggtcctaagacctgcaggaacatgtggagtgggaccttccccattaacgcctacaccacgggtccctgtaacccccttcccgcgccgaactacacgttcgcgctgtggagggtgtctgcagaggaatacgtggagataaggcaagtgggggacttccactacgtgacgggtatgactactgacaatcttagatgcccgtgtcaggtcccatcgcccgaattcttcacagaactggacggggtgcgcctacataggtttgcgcccccctgcaagcccttgctgcgggaggaggtaacattcagggtaggactccacgagtacccggtggggtcgcaattaccttgcgagcccgaaccggacgtggccgtgttgacgtccatgctcactgatccctcccatataacggcagaggcggccaagagaaggttggagaggggatcacccccttctttggccagctcctcggctagccagctgtccgccccatctctcaaggctacttgcaccgccaaccatgactcccctgacgccgagctcatagaggctaacctcctatggaggcaggagatgggcggcaacatcaccagggttgagtcagagaacaaagtggtgatcctggactccttcgatccgctcacggcagaggaggacgagcgggagatctccgtacccgcagaaatcctgcggaagtctggaagattcgcccaggccctgcccgtttgggcgcggccggactataaccccccgcttctagagacgtggaaaaagcctgactacgaaccacctgtggtccatggctgtccgcttccacctccacagtcccctcctgtgcctccgcctcggaagaagcggacggtggtcctcaccgaatcaaccgtatccactgccttggccgagcttgccaccaaaagttttggcagctcctcaacttccggcattacgggcgacaatacagcaacatcctctgagcccgccccttctggctgctccccagactccgacgctgagtcctattcttccatgccccccctggagggggagcctggggatccggatctcagcgacgggtcatggtcgacggtcagtagcgaggctggcacggaggacgtcgtgtgctgctcaatgtcttatacctggacaggcgcactcgtcaccccgtgcgccgcggaggagcagaaactgcccattaacgcactgagcaactcgttgctacgtcaccacaatctggtgtattccaccacctcacgcagtgcttgccaaaggcagaagaaagtcacatttgacagactgcaagttctggacagccactaccaggacgtgctcaaggaggttaaagcagcggcgtcaaaagtgaaggctaacttgctatccgtagaggaagcttgcagcctgacgcccccacattctgccaaatctaagtttggctacggggcgaaggacgtccgctgccatgccagaaaggccgtagcccacatcaactccgtgtggaaggaccttctggaagacaatgtaacaccaatagacactaccatcatggctaagaacgaggttttctgcgttcagcctgagaaggggggtcgtaagccagctcgtctcatcgtgttccccgacctgggtgtgcgcgtatgcgagaagatggccctatacgacctggtcagcaagctccccctggccgtgatgggaggctcctacggattccaatactcaccaggacagcgggttgaattcctcgtgcaagcgtggaaatccaagaggaccccaatggggttctcgtatgatacccgttgttttgactctacagtcaatgagagcgacatccgtacggaggaggcaatttaccaatgttgtgacctggacccccaagcccgtgtggccatcaagtccctcactgagaggctttatgttgggggccctcttaccaattcaaggggggagaactgcggctaccgcaggtgccgcgcgagcggcgtgctgacaactagctgtggtaacaccctcacttgttacatcaaggcccgggcagcctgtcgagccgcagggctccaggactgcaccatgctcgtgtgtggcgacgacttagtcgttatctgtgaaagtgcgggggtccaggaggacgcggcgagcctgagagccttcacggaggctatgaccaggtactccgccccccccggggatcccccacaaccggagtacgacttggagctcataacatcatgctcctccaacgtgtcagtcgcccacgacggcgctggtaagagggtctactacctaacccgtgaccctacaacccccctcgcgagagccgcgtgggagacagcaagacacactccagtcaattcctggctaggcaacataatcatgtttgcccccacactgtgggcgaggatgatactgatgacccatttctttagcgtccttatagccagggatcagcttgaacaggcccttgattgcgagatctaaggagcctgctactccatagaaccactggatctacctccaattattcaaagactccatggcctcagcgcgttttcactccacagttactctccaggtgaaatcaatagggtggccgcatgcctcagaaaacttggggttccggccttgcgagcttggagacaccgggcccggagcgtccgcgctagacttctgtccagagtaggcagggctgccatatgtggcaagtacctcttcaactgggcagtaagaacaaagctcaaactcactccaatagcggccgctggccagctggacctgtccggctggttcacggctggttacagcgggggagacatttatcacagcgtgtctcgtgcccggccccgctggttctggttttgcctactcctgcttgccgcaggggtaggcatctacctcctccccaaccgatgaaggttggggtaaacactccggccttttaggccatctctgttttttctc

SEQ ID NO: 714 - DNA, 9395 bp, Hepatitis C Virus
accatgaatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggatgaccgggtcctttcttggataaacccgctcaatgcctggagatttgggcgtgcccccgcaagactgctagccgagtagtgttgagtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcacaacctcgaggtagacgtcagcctatccccaaggcacgtcggcccgagggcaggacctgggctcagcctgggtacccttggcccctctatggcaatgagggctgcgggtgggcgggatggctcctgtctccccgtggctctcggcctagctggggccccacagacccccggcgtaggtcgcgcaatctgggtaaagtcatcgatacccttacgtgcggcttcgccgacctcatggggtacataccgctcgtcggcgcccctcttggaggcgctgccagggccctggcgcatggcgtccgggttctggaagacggcgtgaattatgcaacagggaaccttcctggttgctctttctctatcttccttctggccctgctctcttgcctgaccgtacccgcttcagcctaccaagtgcgcaactccacggggctttaccatgtcaccaatgattgccctaattcgagcattgtgtacgaggcggtcgatgccatcctgcacgccccggggtgtgtcccttgcgttcgcgagggcaacgcctcgaggtgttgggtggcggtgacccctacggtggccaccagggacggcaaactccccacaacgcagcttcgacgtcatatcgatctgcttgttggaagtgccaccctctgttcggccctctacgtgggggacctgtgcgggtctgtctttcttgtcggtcaattgttcaccttctctcccaggcgccactggacgacacaaggctgcaattgttctatctatcccggccatataacgggtcaccgcatggcatgggatatgatgatgaactggtcccctacggcggcgctggtaatggctcagctgctccggataccacaagccatcatggacatgatcgctggtgctcactggggagtcctggcgggcatagcgtacttctccatggtggggaactgggcgaaagtcctggtggtgctgctgctatttgccggcgtcgacgcggaaacccacgtcaccggggggagtgccgctcgctccacgctcgcactcactagcctcttcacaccaggccccagccagaacatccagctggtcaacagcaacggcagttggcacatcaacagcacggccttgaactgcaatgattcccttaccaccggctggctagcagggcttttctattacaacaaattcaacttttcaggttgtcccgagaggttggccagctgccgacccctcattgactttgaccagggctggggccctatccgtcacgccaatggaagtggccccgaccatcggccctattgctggcactaccctccaaaaccttgcggtatcgtgcccgcaaagagcgtgtgtggcccggtatattgcttcactctcagccccgtggtggtgggaacgaccgacaggtcgggcgcgcctacctacagctggggtgaaaatgatacggacgttttcgtccttaacaacaccaggccgccgctgggcaattggttcggctgtacctggatgaactcaactggattcaccaaagtgtgcggagcacctccttgtgtcatcggaggggggggcaacaacaccttgcactgccctactgactgtttccgcaagcatccggaagccacatattctcggtgcggctccggtccctggattacacccagatgcctggtcaactacccgtataggctttggcactatccctgtaccatcaactacaccatattcaaagtcaggatgtacgtgggaggggtcgagcacaggctggacgctgcctgcaactggacacggggcgaacgctgtgatctggaagacagggacaggtccgagctcagcccgttgctgctgtccaccacacagtggcaagtcctcccgtgttcattcacgaccctgccagccttgtccaccggcctcatccacctccaccaaaacattgtagacgtgcagtacttgtacggggtggggtcaagcatcgcgtcctgggccattaagtgggagtacgtcgttctcctgttccttctgcttgcagacgcgcgcgtctgctcctgcttgtggatgatgctactcatatcccaagcggaggcagctttagagaacctcgtaatactcaatgcagcatccctggccgggacgcaaggtcttgtatccttcctcgtgttcttctgctttgcgtggtatctgaagggtaggtgggtgcccggagcggtctacgccctctacgggatgtggcctctcctcctgctcctgttggcgttgccccagcgggcatacgcgttggacacggaggtggccgcgtcgtgtggtggcgttgttctcgtcgggttaatggtgctgactctgtcaccatattacaagcgctatatcagctggtgcttatggtggcttcagtattttctgaccagagtagaagcgcacttgcacgtgtgggttccccccctcaacgctcgaggagggcgagacgccgtcatcttactcatgtgtgttgtacacccgactttggtatttgacatcaccaaactcctactggccgtcttcggacccctctggattcttcaagccagtttgctcaaagtaccctacttcgtgcgcgtccaaggcctcctccggatttgcgcgatagcgcggaagatggccggaggccattacgtgcaaatggctatcatcaagataggggcacttactggcacctatatttataaccatcttactcctcttcgggactgggcgcacagcggcctacgagatctggccgtggctgtagagccagtcgtcttctcccaaatggagaccaagctcatcacgtggggggcggacaccgccgcgtgcggtgacatcatcaacaacttgcccgtctccgcccgtaggggccaggagatactgctcggaccagccgatggaatggtctccaaggggtggaggttgctggcccccatcacggcgtacgcccagcagacaaggggcctcctagggtgtataatcaccagcctaactggccgggacaaaaaccaagtggagggtgaggtccagattgtatcaactgctgcccaaacttttctggcaacgtgcatcaatggggtatgctggactgtctaccatggggccggaacgaggactatggcaacacccaagggtcccgtcatccagatgtataccaatgtagaccaagaccttgtaggctggcccgctccccaaggcgcccgctcattggtaccctgcacctgcggctcctcggacctttacctggtcacgaggcacgccgacgtcattcccgtgcgccggaggggtgatagcaggggcagcctgctttcgccccggcccatttcctacttgaagggttcctcggggggtccgctgttgtgccccgcgggacacgccgtgggcatattcagggccgcggtgtgcacccgtggagtggctaaggcggtggactttattcccgtggagaacctagagacaaccatgaggtccccggtgttcacggacaactcctctccaccagcagtgccccagagcttccaggtggcccacctgcatgctcccacaggcagcggcaagagcaccaaggtcccggctgcatacgcagcccagggctataaggtgctagtgctcaacccctctgttgccgcaacactgggctttggtgcttatatgtccaaagcccacgggatcgatcctagtatcaggaccggggtgaggacaattaccactggcagccccatcacgtactccacctacggcaagttccttgccgacggcgggtgctcggggggtgcctatgacataataatttgtgacgagtgccattctacggatgccacatccatcttgggcatcggcactgtccttgaccaggcagagaccgcgggggcgaggctggttgtgctcgccactgctacccctccgggctccgtcactgtgccccatcctaacatcgaggaggttgctctgtccaccaccggagagatccctttttacggcaaggctatccccctcgaagtaatcaagggggggagacacctcattttctgtcactcaaagaagaagtgcgacgagctcgccgcaaagctggtcgcattgggcatcaatgccgtggcctactaccgcggtcttgacgtgtctgtcatcccgaccagcggcgatgttgttgtcgtggcaactgatgctctcatgaccggcttcaccggcgacttcgactcggtgatagactgcaacacgtgtgtcacccagacagtcgactttagccttgaccctaccttcaccattgagacaaccacgcttccccaggacgctgtctcccgcactcaacgtcggggcaggactggcagggggaagccaggcatctacagatttgtggcaccgggggaacgcccttccggcatgttcgactcgtccgtcctctgtgagtgctatgacgcgggctgcgcttggtacgagctcacgcccgccgagactacagttaggctacgagcgtacatgaacacccccgggcttcccgtgtgccaggatcaccttgaattttgggagggcgtctttacaggcctcactcatatagatgcccacttcctatcccagacaaagcagagtggggagaattttccttacctggtagcataccaagccaccgtgtgtgctagggctcaagcccctcccccatcgtgggaccagatgtggaagtgtttgatccgcctcaaacccactctccatgggccaacacccctgctatacagactgggtgctgttcagaatgaagtcaccctgacgcatccagtcaccaaatacattatgacatgcatgtcagccgacctggaggtcgtcacgagcacctgggtgctcgttggcggcgtcctggctgctctagccgcgtattgcctgtcgacaggcagcgtggtcatagtgggcagggttgtcttgtccgggaagccggcaatcatacctgacagggaagttctctaccgggagtttgatgagatggaagagtgctctcagcacttgccatacatcgaacaagggatggcgctcgccgagcagttcaagcagaaggcccttggcctcctgcagactgcgtcccgccaggcagaggttatcgctcctgctgtccagaccaactggcaaaaactcgaggccttttgggcgaagcatatgtggaacttcatcagcgggatacaatacttggcgggcctgtcaacgttgcctggcaaccccgccatagcttcattgatggcttttacagctgctgtcaccagcccactaaccactagccaaaccctcctcttcaatatattgggggggtgggtggctgctcagctcgccgcccccggtgccgctaccgcctttgtgggcgctggcttgaccggcgccggcattggcagtgatggactggggaaggtcctcgtggacattcttgcagggtatggcgcgggcgtggcgggagctcttgtggcattcaagatcatgagcggtgaggtcccctccacggaggacctggtcaatctactgcccgccatcctctcgcctggagcccttgtagtcggtgtggtctgtgcagcaatactgcgccggcatgttggcccgggcgagggggcagtgcaatggatgaaccggctaatagccttcgcctcccgggggaaccatgtttcccccacgcactacgtgccggagagtgatgcagccgcccgcgtcactgccatactcggtagcctcactgtaacccagctcctgaggcgactgcaccagtggataagctcggagtgcaccaccccgtgctccggttcctggctaagggacatctgggactggatatgcgaggtgttgagcgactttaagacctggctaaaagccaagctcatgccacaactgcctgggatccccttcgtatcgtgccagcgcgggtataggggggtctggcgaggggacggcatcatgcacactcgctgccactgtggggctgagatcactggacatgtcaaaaacgggacgatgaggatcgccggtcctaagacctgcaggaacatgtggagtgggaccttacccattaacgcctacaccacggggccctgtaccccccttcccgcgccgaactacacgttcgcgctgtggagggtgtctgcagaggaatacgtggagataaggcaggtgggggacttccactacgtgacgggtatgaccactgacaacctcaaatgcccgtgccaggtcccatcgcccgaatttttcacagaattggacggggtgcgcctacataggtttgcgcccccctgcaagcccttgctgcgggaggaggtatcattcagagtaggactccacgagtacccggtggggtcgcaattaccttgcgagcccgaaccggacgtggccgtgttgacgtccatgctcaccgatccctcccatataactgcagaggcagccgggagaaggctggcgaggggatcacccccctctgaggccagctcctcggcaagccagctgtccgctccatctctcaaggcaacttgcaccgccaaccatgactcccctgacgccgagctcatagaggctaacctcctatggaggcaggagatgggcggcaacatcaccagggttgagtcagagaacaaggtggtgattctggactccttcgatccgcttgtagcggaggaggacgagcgggagatctctgtacccgcagaaatcctgcggaagtctcggagattcgcccaggccctgcctgtttgggcgcggccggactataaccccccgctgatagagtcgtggaaaaagcctgactacgaaccacctgtggtccatggctgtccgcttccacctccaaagtcccctcctgtgcctccgcctcggaagaagcggacggtggtcctcaccgaatcaaccgtatctactgccttggccgagctcgccaccaaaagttttggcagctcctcaacttccggtattacgggcgacaatacgacaacatcctctgaggccgccccctctggctgcccgccagactccgacactgagtcctactcttccatgccccccctggagggggagcctggggatccggatctcagcgacgggtcatggtcgacggtcagtagtgaggctggcacggaggatgtcgtgtgctgctcaatgtcttactcctggacaggcgcactcgtcaccccgtgcgccgcggaagaacagaaactgcccattaatgcactgagcaactcgttgctacgtcaccacaatttggtgtactccaccacctcacgcagtgcttgccaaaggcagaagaaagtcacatttgacagactgcaagttctggatagccactaccaggacgtgctcaaggaggttaaagcagcggcgtcaaaagtgaaggctaacttgctgtccgtagaggaagcttgcagcctgacgcccccacactcagctaaatccaagtttggctatggggcaaaagacgtccgttgccatgccagaaaggccgtaaaccacatcaactccgtgtggaaagaccttctggaagatagtgtaacaccaatagacactaccatcatggctaagaacgaggttttctgtgttcagcctgagaaggggggtcgtaagccagctcgtctcatcgtgttccccgatctgggtgtgcgcgtgtgcaaaaagatggccctgtacgacgtggttaggaagctccccctggccgtgatgggaagctcctacggattccaatactcaccagggcagcgggttgagttcctcgtgcaagcgtggaagtccaagaaaaccccaatggggttctcgtatgatacccgctgctttgactctacagtcactgagagcgacatccgtacggaggaggcaatctaccaatgttgtgacctggacccccaagcccgtgtggccatcaagtccctcattgagaggctttatgttgggggccctcttaccaattcaaagggggaaaactgtggctatcgcaggtgccgcgcaagcggcgtactgacaactagctgcggtaacaccctcacatgctacattaaggcccgggcagcctgtcgagccgcaaggctccgggactgcaccatgctcgtgtgtggcgacgacctagtcgttatctgtgaaagtgcgggggtccaggaagacgcggcgagcctgagagccttcacggaggctatgaccaggtactccgccccccccggggaccccccacaaccagaatacgacttggagctcataacatcatgctcctccaatgtgtcagtcgcccacgacggcgctggaaagagggtctactacctcacccgagaccctacaacccccctcgcgagagctgcgtgggagacagcaagacacactccggtcaattcctggctaggcaacataattatgtttgcccccacactgtgggcgaggatgatactgatgactcacttctttagcgtccttatagccagggatcagcttgaacaggcccttgatggcgaaatctacggagcctgctactccatagaaccactggatctacctgcaattattcaaagactccatggcctcagcgcgttttcactccacagttactctccaggtgaaatcaatagggtggccgcatgcctcagaaaacttggggttccgcccttgcgagcttggagacaccgggcccggagcgtccgcgctagacttctgtccagaggaggcagggctgccatatgtggcaagtacctcttcaactgggcagtaagaacaaagctcaaactcactccaatagcggccgctggccagctggacttgtccggctggttcacggctggctacagcgggggagacatttatcacagcgtgtctcgtgcccggccccgctggttctggttttgcctactcctgcttgctgcaggggtaggcatctacctcctccccaaccgatgaaggttggggtaaacactccggcctcttaggccatttcctgtgtctc

SEQ ID NO: 715 - DNA, 9379 bp, Hepatitis C Virus
ggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgtccacaggacgtcaagttcccgggcggtggtcagatcgttggtggagtttacctgttgccgcgcaggggccccaggttgggtgtgcgcgcgctcaggaagacttccgagcggtcgcaacctcgtggaaggcgacaacctatccccaaggctcgccgacccgagggcagggcctgggctcagcccgggtacccttggcccctctatggcaatgagggcatggggtgggcaggatggctcctgtcaccccgtggttctcggcctagttggggcccctcagacccccggcgtaggtcgcgtaatttgggtaaggtcatcgatacccttacatgcggcttcgccgacctcatggggtacattccgctcgtcggcgcccctctagggggcgccgccagggccctggcgcatggcgtccgggttctggaggacggcgtgaactatgcaacagggaatttgcccggttgctctttctctatcttcctcttgggtttgctgtcttgtttgaccatcccagcttccgcttatgaagtgcgcaacgtgtccggggtgtaccatgtcacgaacgactgctccaacgcaagcattgtgtatgaggcagcggacatgatcatgcacgtccccgggtgcgtgccctgcgttcgggtggacaactcctcccgttgctgggtagcgctcacccccacgcttgcggccaggaacgctagcgtccctactacggcaatacgacgccacgtcgatttgctcgttggggcggctactttctgttccgctatgtacgtgggggatctctgcggatctgttttcctcgtcgcccagctgttcaccttctcgccccgccggcatgagacggtacaggactgcaattgttcaatctatcccggccacataacgggtcaccgcatggcttgggatatgatgatgaactggtcacccacagcagccctagtcgtatcgcagttactccggatcccacaagctatcgtggatatggtggcgggggcccactggggagtcctggcgggcctcgcctactattccatggtggggaactgggctaaggttttgattgtgatgctactctttgccggcgttgacggggacacccacacgacggggggggtggcgggccgcgacacgctgcgcttcacggggttcttttcattggggccgaaacaaaagatccagcttgtaaacaccaacggcagctggcacatcaacaggactgccctgaactgcaatgactccctcaacactgggtggctcgccgcgctgttctacacacacagcttcaacgcgtctggatgcccagagcggatggccagctgccaccccatcgacgagttcgctcaggggtggggtcccattacttacgctgaacatagcagctcggaccagaggccctactgttggcactacgcacctcagccgtgcggtattgtacccgcgtcggaggtgtgtggtccagtgtattgcttcaccccaagccctgttgtggtggggacaaccgatcgtcacggcgtccctacgtatagctggggggagaatgggacggacgtgctgcttctcaacaacacgcggccgccgcaaggcaactggttcggctgtacatggatgaacggcactgggttcaccaagacgtgcgggggccccccgtgtaacatcgggggggtcggcaacaacaccctgacctgccccacggactgcttccggaagcaccccgaggccacttacaccaaatgcggctcggggccttggttgacacctaggtgcatggttgactacccatacaggctctggcactacccctgcactgtcaacttcaccatctttaaggttaggatgtatgtggggggcgtggaacacaggctcagcgccgcatgcaattggactcgaggagagcgttgtgacctggaggacagggatagatcagagcttagcccgctgctgctgtccacaacagagtggcaggtgctgccctgttccttcaccaccctaccggctctgtccactggtttgatccatctccaccagaacatcgtggacgtgcaatacttgtacggtatagggtcggtggttgtctcctttgcaatcaaatgggagtatgtcgtgttgctcttccttctcctggcagacgcgcgcgtctgtgcctgcttgtggatgatgctgctgatagcccaagctgaggccgccttagagaacctggtggtcctcaatgcagcgtccgtggccggagcacatggcattctctccttccttgtgtttttctgtgctgcctggtacatcaagggcaggctggtccctggagcggcatatgctatctatggcgtatggccgctactcctgctcctgctggcgctaccaccacgggcatacgccttggaccgggagatggctgcatcgtgcggaggcgcggttttcgtaggtctggtactcttgaccttgtcaccacactataaagagttcctcgccaggcttatatggtggttgcaatactacatcaccagagccgaggcgctactgcaagtgtggatcccccccctcaatgttcgggggggccgcgacgccatcatcctcctcacgtgtgtggtccacccagagctaatttttgacatcaccaagctcttgctcgccatgctcggcccgcccatggtgctccaggctgtcataaccaaggtgccgtactttgtgcgcgctcaagggctcattcgtgcatgcatgttggtgcggaaagtcgctgggggccattacgtccaaatggctctcatgaagctggccgggttgacaagcacgtacgtttatgaccatcttactccgttgcaggactgggcccacggcggcctacgagacctcgcggtggcagttgagcccgttgttttttctgacatggagaccaagatcatcacctggggggcggacactgcggcgtgtggtgacatcatctcggggttacctgtctccgcccgaagggggagggagatactcctgggaccggccgatagtcttaaagagcagggatggcgactccttgcacccatcacggcttactcccaacagacgcggggcctacttggttgcatcatcactagcctcacaggccgggacaagaaccaggtcgagggggaggttcaagtggtctccaccgcaacacaatctttcctggcgacctgtgtcaacggcgtgtgttggactgtgtatcatggcgccggctcaaagaccctagccggcccaaaaggtccagtcacccaaatgtacaccaatgtagaccaggacctcgtcggctggcccgcgccccccggggcgcgttccttgacaccatgcacctgtggcagctcggacctttacttggtcacgagacatgccgatgtcatcccggtgcgccggcggggcgacagcaggggaagcctactctcccccaggcccgtctcctacttgaagggctcttcgggtggtccattgctctgcccctcggggcacgctgtgggcatcttccgggctgctgtgtgcacccggggggtcgcgaaggcggtggactttgtgcccgttgagtctatggaaactactatgcggtctccggtcttcacggacaattcatctcccccggccgtaccggagacattccaggtggcccatctacacgctcccaccggtagcggcaagagcactaaggtgccggctgcatatgcagctcaagggtacaaggtactcgtcctgaacccgtccgttgccgccaccctgggctttggggcgtacatgtccaaggcacatggtaccgaccccaacatcagaactggggtaaggaccatcaccacgggcgctcccattacgtactccacctatggcaagttcctcgccgatggtggttgttctgggggcgcctatgacattataatatgtgatgagtgccactcaactgactcgactaccatcctgggcattggcacagtcctggaccaagcggagacggctggagcacggctcgtcgtgctcgccaccgctacgcctccgggatcggtcaccgtgccgcatcccaacatcgaggaggtggccctgtccaacattggagagatccccttctatggcaaagccatccccattgaaaccatcaaggggggaagacacctcattttctgccattccaagaagaagtgtgacgagctcgctgcaaagctgtcgggcctcggactcaacgctgtagcgtattaccggggccttgacgtgtccgtcataccgaccagcggagacgtcgttgtcgtagcaacagacgctctaatgacgggctttaccggcgactttgactcagtgatcgactgtaacacatgtgtcacccaaacagtcgatttcagcttggaccctaccttcaccattgagacgacgaccgtgccccaagacgcagtgtcgcgctcgcaacggcgaggcaggactggtaggggcaggagaggcatctacaggtttgtgactccgggagagcggccctcgggcatgttcgattcctcggtcctgtgtgagtgctatgacgcgggctgtgcttggtatgagctcacgcccgccgagacttcggttaggttgcgggcttacctaaacacaccagggttgcccgtctgccaagaccacctggagttctgggagagcgtcttcacaggcctcacccacatagacgcccacttcttgtcccagaccaaacaagcgggagagaacttcccctacctgacagcgtaccaggccacagtgtgtgccagggctcaggctccacctccatcgtgggatcaaatgtggaagtgtctcatacggctaaagcctacgctgcacgggccaacacccctgctgtataggctaggagccgtccaaaacgaggtcgtccttacacaccccataaccaaatacatcatggcatgcatgtcggctgacctagaggtcgtcacgagcacctgggtgctagtgggcggagtcctcgcagccctggctgcgtattgcctgacaacgggcagcgtggtcattgtgggcaggattatcttgtccgggaggccggctatcattcccgacagggaagtcctttaccaggagttcgatgagatggaagagtgcgcctcacaccttccttacatcgaacagggaatgcagctcgccgaacaattcaaacagaaggcgctcgggttgctgcagacagccactaagcaagcggaggctgctgttcccgtggtggaatccaagtggcaagcccttgaggctttttgggcgaagcacatgtggaacttcatcagcgggatacagtacttagcaggcttgtccactctgcctgggaacctcgcaatagcatcactgatggcattcacagcctccatcaccagcccgctcaccacccaacataccctcctgtttaacatcttggggggatgggtggctgcccaactcgctccccccagcgccgcctcagctttcgtaggcgccggcatcgccggtgcggccgttggcagcataggccttgggaaggtgcttgtggacatcctggcgggctatggagcaggagtggctggcgcgctcgtggcctttaaagtcatgagcggcgagatgccctccaccgaggacctggtcaacttactccctgccatcctctctcctggcgccctggtcgtcggggtcgtgtgcgcagcaatactgcgtcggcatgtgggccctggggagggggctgtgcagtggatgaaccggctgatagcgttcgcttcgcggggtaaccacgtgtcccccacgcactatgtgcctgagagcgacgccgcagcgcgtgtcactcagatcctctccagccttaccatcacccagctgttgaagaggctccaccagtggattaacgaggactgctccacgccatgctccggttcgtggctaagggatgtttgggactggatatgcacggtgttgactgacttcaagacctggctccagtccaagctcctgccacggttaccgggaatccctttttactcatgccagcgtgggtacaagggagtatggcggggagacggcatcatgcaaaccacctgcccatgtggagcacagatcactggacatgtcaaaaacggttccatgaggatcgttgggcctaaaacctgcagcaacacgtggcacggaacattccccatcaacgcatacaccacgggcccctgcacaccctccccggcgccaaactattctagggcgctgtggcgggtggctgctgaggagtatgtggaggttacgcgggtgggggatttccactacgtgacgggcatgaccactgacaacgtaaaatgcccatgccaggttccggctcccgaattcttcacggaggtggatggggtgcggctgcacaggtacgccccggcgtgcaaacccctcctacgggatgaagtcacattccaggtcgggctcaaccaatacgtggttgggtcacaactcccatgcgagcccgaaccggatgtagtggtggtcacttccatgcttaccgacccctcccacattacagcagagacggctaagcgtaggctggacagggggtctcccccctccttggccagctcttcagctagccagttgtctgcgccttccttgaaggcgacatgcactacccgtcacgactccccagacgctgacctcattgaggccaacctcctgtggcggcaggagatgggcggaaacatcacccgcgtggagtctgaaaacaaggtagtaattctggactctttcgacccgcttcgagcggaggaggatgagagggaagtatccgtcgcggcggagattctgcggaaatccaggagattcccccgagcgatgcccatatgggcacggccggattacaaccccccactgctagagtcctggaaggatccggactacgtccctccggtggtgcacgggtgcccattaccacctaccaaggcccctccaataccacctccacggaaaaagaggacggttgtcctgacagagtccaccgtgtcttctgccttggcggagcttgctacaaagaccttcggcagctccgaatcgtcggccgtcgacagcggcacggcgaccgcccctcctgaccagccccccgacaacgacgacacaggatccgacgttgaatcgtgctcctccatgcccccccttgagggggagccgggggatcccgatctcagcgacgggtcttggtctaccgtgagcgaggaggctagtgaggacgtcgtctgctgttcgatgtcctacacgtggacgggcgctctgatcacaccatgcgccgcggaagaaagcaagctgcccatcaatgcgttgagcaactctttgctgcgtcatcacaacatggtgtacgccacaacctcccgcagcgcaagccagcggcagaagaaggtcacttttgacagactgcaagtcctggacgaccactaccgggacgtgctcaaggagatgaaggcgaaggcgtccacagttaaggctaaacttctatccgtagaagaagcctgcaagctgacacccccacattcggccagatctaaatttggctacggggcgaaggacgtccggaacctatccagcaaggccgttaaccacatccgctccgtgtggaaggacttgctggaagacactgaaacaccaattgatactaccatcatggcaaagaatgaggtcttctgcgtccaaccagaaaaaggaggccgcaagccagctcgccttatcgtgttcccagacttgggggtgcgcgtatgcgagaagatggctctttatgacgtggtctccacccttcctcaggccgtgatgggcccctcgtacggatttcagtactctcctggacagcgggtcgagttcctggtaaatgcctggaaatcaaagaagtgtcctatgggcttcgcatatgacacccgctgttttgactcaacggtcactgagagtgacatccgtgttgaggagtcaatttaccaatgttgtgacttggcccccgaagccagacaggccataaagtcgctcacagagcggctttacatcgggggtcccctgactaattcaaaagggcagaactgcggttatcgccgatgccgcgcaagcggcgtgctgacgactagctgcggtaatacccttacatgttacttgaaggcctctgcggcctgtcgagctgcaaagctccaggactgcacgatgctcgtgtgcggagacgacctcgtcgttatctgtgaaagcgcgggaacccaagaggacgcggcgagcctacgagtcttcacggaggccatgactaggtactctgccccccccggggacccgccccaaccagaatacgacctggagctgataacatcatgctcctcgaatgtgtcggtcgcgcacgatgcatccggcaagagagtatactacctcacccgtgaccccaccaccccccttgcgcgggctgcgtgggagacagctagacacactccagttaactcctggctaggcaacatcatcatgtatgcgcccactttgtgggcgaggatgattctgatgacacacttcttctccatccttctagctcaggaacaacttgaaaaagccctagattgtcagatctacggggcctgttactccatagagccacttgacctacctcaaatcattcagcgactccatggtcttagcgcattttcactccacagttactccccaggtgagatcaatagggtggcttcatgcctcaggaaacttggggtaccgcccttgcgagcctggagacatcgggccagaagtgtccgcgctaagctactgtcccaggggggaagggctgccacttgtggccgctacctcttcaactgggcagtaaagaccaaacttaaactcactccaattccggctgcgtcccagttggacttgtccaactggttcgttgctggttacagcgggggagacatatatcacagcctgtctcgtgcccgaccccgctggttcatgtggtgcctactcctactttctgtaggggtaggcatctacctgctccccaaccgatgaacggggagctaaccactccagg

SEQ ID NO: 716 - DNA, 9418 bp, Hepatitis C Virus
gccagcccctgttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggtagggcctgggctcagcccgggtacccttggcccctctatggcaacgagggcctggggtgggcaggatggctcctgtcaccccgcggctcccggcctagttggggccccacagacccccggcgtaggtcgcgtaatttgggtaaggtcatcgataccctcacatgcggcttcgccgacctcatggggtacattccgctcgtcggcgcccccttagggggcgctgccagggccctggcgcatggcgtccgggttctggaggacggcgtgaattatgcaacagggaatctgcccggttgctctttctctatcttcctcttggctttgctgtcctgtttgaccatcccagcttccgcttatgaagtgcgcaacgtgtccggggtgtaccatgtcacgaacgactgctccaactcaagcattgtgtatgagacagcggacatgatcatgcacacccccgggtgcgtgccctgcgttcgggaggataactcctctcgctgctgggtagcgctcacccccacgctcgcggctaggaatggcagtgtccccaccacggcgatacgacgccacgtcgatttgctcgttggggcggctgctttctgctccgctatgtacgtgggggatttttgcggatctgttttcctcgtctcccagctgttcaccctctctcctcgccggcatgagacagtacaggaatgtaattgctcaatttaccccggccacgtgacaggtcaccgcatggcttgggatatgatgatgaactggtctcctacaacggccctagtggtatcgcagctactccggatcccacaagctgtcgtggacatggtggcgggggcccactggggcgtcctggcgggcctcgcctactattcgatggtggggaactgggctaagcttttgattgtgatgctactctttgctggcgttgacggcggtggacccacccgcacgataggcgggtcgcaagcccaggccgctagcgggctcgtgtccatgttctcagttgggccgtctcagaaaatccagcttataaacaccaacggcagctggcacatcaacagaactgccctaaactgcaatgactctctcaacactgggtttcttgccgctctgttctacgcacataagttcaactcgtccggatgcccagagcgcatggccagctgccgccccattgacaggtttgcacaggggtggggtcccatcacctacgctgagcctggcagcttggaccagaggccctactgctggcactacgcgcctcaaccgtgtggtattgtacccgcgtcggaggtgtgtggtccagtgtactgcttcaccccgagccctgttgtagtggggacgaccgaccgttctggcgtccctacgtatcgctggggggacaatgagacggacgtgctgctccttaacaacacgcggccgccgcagggcaactggttcggctgtacatggatgaataccactgggtttaccaagacgtgcgggggccccccatgtaacatcggggggctcggcaacaacaccttgatttgccccacggactgcttccggaagcattccgaggccacctacaccaaatgcggttcggggccttggttgacacccaggtgcatagttgactacccatacaggctttggcactacccctgcaccgtcaactttaccatcttcaaggttaggatgtatgtggggggcatagagcacaggctcagcgccgcgtgcaattggactcgaggagagcgttgcaacctggaggacagggatagatcagagctcagtccgctgctgctgtctacaacagagtggcagatactgccctgttccttcactaccctaccggctccgtccactggtttgatccatctccatcagaacatcgtggacgtgcaatacctgtacggtatagggtcagtgctcgtctccttcgcaatcaagtgggagtatatcctgttgctcttccttctcctggcggacgcgcgcgtctgtgcctgcttgtggatgatgctgctgatagctcaggctgaggccgccttggagaacctggtggtcctcaatgcggcgtccttggccggagcgcatggtattctctccttccttgtgttcttctgtgctgcctggtacatcaagggcaggctggttcctggggcggcatatgctctttatagcgtatggccgctgctcctgctcctgttggcactaccaccacgagcatacgccatggaccgggagatggccgcatcgtgcggaggcgcggttttcgtaggtctggtactcttgaccttgtcaccatactataaagtgttcctcgctaagctcatatggtggttgcaatattttatcaccagagccgaggcgcatttgcaagtgtggatcccccctcttaacgttcgagggggccgcgatgccatcatccttctcacgtgcgcggtccacccagagctaatctttgacatcaccaagctcttgcttgccatactcggtccgctcatggtgctccaggccggcataattagagcgccgtacttcgtgcgcgctcaagggctcattcgtgcatgcatgttggtgcggaaggttgctgggggccattatgtccagatggcttttatgaagctggccgcactgacgggtacgtacgtctacgaccaccttaccccactgcgggactgggcccatgcgggcctacgagaccttgcggtggcggttgagcccgtcgtcttttccgacatggagaccaagatcatcacctggggggcggacactgcagcgtgtggggacatcatcttgggtctacccgtctccgcccgaagggggaaggagatacttctgggaccagccgatagtcttgaggggcaagggtggcgacttctcgcgcctatcacggcctattcccaacagactcggggcctacttggctgtatcatcactagtctcacaggccgggacaagaaccaggtcgaaggggaggttcaagtggtttccaccgcaacacaatctttcctggcgacctgtgtcaatggcgtttgctggactgtctaccatggcgccggctcaaagaccctagccggcccaaagggtccgatcacccaaatgtacaccaatgtagaccaggacctcgtcggctggccagcgccctccggagcgcgttctttgacaccttgcacctgcggcagctcggacctctacttggtctcgaggcatgctgatgtcattccggtgcgccggcggggcgacagccgggggagcctactttcccccaggcccgtctcctacttgaagggttcctcgggtggcccactgctctgcccctcggggcatgtcgtgggcatcttccgggctgctgtgtgcacccggggggttgcgaaggcggtggactttgtgcccgttgagtctatggaaaccaccacgcggtccccggtcttcacggacaactcatccccaccggctgtaccgcagacatttcaagtggcccatctgcacgctcccactggcagcggcaagagcactaaggtgccagctgcgtatgcagcccaagggtataaggtacttgtcctgaacccgtccgttgccgccacattaagctttggggcgtatatgtctaaggcacatggtgtcgaccctagcatcagaactggggtaaggaccatcaccacgggcgcccccatcacatattctacctacggcaagttccttgccgacggtggttgctctgggggcgcctatgacatcataatatgtgatgagtgccactcaactgactcgacctccatcttgggcatcggcacggtcctggaccaagcggagacggctggagcgcggctcgtcgtgctcgccaccgctacgcctccgggatcggtcaccgtgccacatcccaacatcgaggaggtggctctgtccaacactggagagatccccttctatggcaaagccatccccatcgagaccatcagggggggaaggcacctcattttctgccactccaagaagaaatgtgacgagctcgccgcacagttgtcgggcctcgggattaatgctgtagcatattaccggggccttgatgtgtccgtcataccaactagcggagacgtcgttgtcgtggcaacagacgctctgatgacgggctttaccggcgactttgactcagtgatcgactgtaatacgtgtgtcacccagacagttgatttcagcttagaccctaccttcaccattgagacgacgaccgtaccccaagatgcggtgtcgcgctcgcagcggcgaggcaggactggtaggggcaggagaggcatttacaggtttgtgaccccaggagaacggccctcgggcatgtttgactcctcggtcctgtgcgagtgctatgacgcgggctgtgcttggtacgagctcacgcccgccgagacctcggtcaggctgcgggcctacctaaatacaccagggttgcccgtctgccaggaccatctggagttctgggagagcgtcttcacaggcctcacccacatagacgctcacttcttgtcccagaccaagcaggcaggagacaacttcccctacctggtagcctaccaggctacggtgtgcgccagagctcaggctccacctccatcatgggatcagatgtggaagtgtctcatacggctaaagcctacgctgcacgggccaacacccctgttgtataggctgggagccgtccaaaacgaggtcaccctcacacaccccgtaaccaagtacatcatggcatgcatgtcggccgacctggaggtcgtcaccagcacctgggtgctggtaggcggggtccttgcagctctggccgcgtattgcctgacaacaggcagcgtggtcattgtgggcaggatcatcttatccgggaagccggccattgttcccgacaggggagttctctatcgagagttcgatgagatggaagagtgcgcctcacacctcccttacatcgaacagggaatgcaactcgccgagcaattcaagcagaaggcgctcgggttgctgcaaacagccaccaagcaagcggaggctgctgctcccgtggtggagtccaagtggcgagcccttgaggccttttgggcgaagcacatgtggagcttcatcagcgggatacagtacctagcaggcttgtccactctgcctgggaaccccgcaatagcatcactgatggcattcacagcctctgtcaccagcccgctcaccacccaacataccctcctgtttaacatcttaggggggtgggtggccgcccaactcgctccccccagcgctgcttcagccttcgtgggcgccggcattgccggtgcggctgttggcagtataggccttgggaaggtgctcgtggacatcctggcgggctatggagcaggggtggcaggcgcactcgtggcctttaaggtcatgagcggcgagatgccctccactgaggatctggtcaacttacttcctgccatcctctccccaggcgccctggtcgtcggggtcgtgtgcgcagcaatactgcgtcggcatgtgggcccgggggagggggctgtgcagtggatgaaccggctgatagcgttcgcttcgcggggcaaccacgtttcccccacgcactatgtgcctgagagcgacgctgcagcgcgagtcactcaaatcctctccagccttaccatcactcagctgttgaagaggctccaccagtggattaatgaggactgctccacgccatgctctggctcgtggctaagggatgtctgggactggatatgcacggtgttgacggacttcaagacctggctccagtccaagctcctgccgcggttaccgggagtccctttcttctcatgtcaacgtggttacaagggagtctggcggggagacggcatcatgcagaccacctgcccatgtggggcacaaatcaccggacatgtcaaaaacggttccatgaggatcgttgggcccagaacctgcagcaacacgtggcatggaacgttccccatcaacgcatacaccacgggtccctgcacaccctccccggcgccaaactactttagggcgctgtggcgggtggctgcagaggagtacgtggaggttacgcgggtgggggatttccactacgtaacgggcatgaccactgacaacgtaaagtgcccatgccaggttccggcccccgaattcttcacggaagtggatggggtgcggctgcacaggtacgctccggcatgcaaacccctccttcgggaggaggtcacgttccaggtcgggctcaaccaatacctggtcgggtcacaactcccgtgcgagcccgagccgggcgtaacagtgctcacttccatgctcaccgacccctcccacattacagcagagacggctaagcgtaggttggacagggggtctcccccctccctggccagctcttcagctagtcagttgtctgcgccttccttgaaggcgacatgcactacccgtcatgactccccagatgctgacctcatcgaggccaatctcctgtggcgacaggagatgggcgggaacatcacccgcgtggagtcagagaataaggtagtaattctggactctttcgatccgcttcgagcggaggaggatgagagggaaatatccgtcccggcggagatcctgcggagatccaggaagttcccccgggcgatgcccatatgggcgcgcccggattacaaccctccactgttagagtcctggaaggacccagactacgtccctccggtggtgcacgggtgcccattgccacccgccaaggcacccccggtaccacctccacggaggaagaggacggttgtcttaacagaatctactgtgtcttctgccttggcagagcttgccacaaagaccttcggcagctccgaatcgtcggccgtcgacagcggcacagcgaccgctcctcctggccagccttccgacggtggcgacacagggtccgacgctgagtcgtgttcctccatgcccccccttgagggagagccgggggaccccgatctcagcgacgggtcttggtctaccgtaagcgaggaggccagtgaggacgtcgtctgctgctcgatgtcctacacatggacaggtgccctgatcacgccgtgcgctgcggaggaaagcaagctgcccatcaatgcgttgagcaactctttgctgcgacaccataacatggtttatgccacaacatcccgcagcgcaagccagcggcagaagaaggttacttttgacagactgcaagtcctagacgaccactactgggacgtgctcaaggagatgaaggcgaaggcgtccacagttaaggccaggcttctatccgtggaagaagcctgcaagctgacgcccccacattcggccaaatctaagtttggctatggggcaaaggacgtccggaacctgtccagcaaggccattaaccacatcaactccgtgtgggaggacttgctggaagacactgaaacaccaattgacactaccatcatggcgaaaaatgaggttttctgcgttcaaccagagaaaggaggccgcaagccagctcgccttatcgtgttcccagatttgggagttcgtgtatgcgagaaaatggccctttacgacgtggtctccacccttcctcaggccgtgatgggctcctcatacggatttcagtactcccctgggcagcgggtcgaattcctggtgaaagcctggagctcaaagaaaaaccctatgggcttcgcatatgacacccgctgttttgactcaacagttactgagaatgacatccgtgttggggagtcaatttaccaatgctgtgacttggcccccgaagccagacaggccataaggtcgctcacggagcggctgtacatcgggggtcccctgaccaattcaaaagggcagaactgcggttatcgccgatgccgcgcaagcggcgtgctgacgactagctgcggtaataccctcacatgttacttgaaagcctctgcggcctgtcgagctgcgaagctccaggactgcacgatgctcgtgtgcggggacgacctcgtcgttatctgtgaaagcgcgggaacccaggaggacgcggcgagcctacgagtcttcacggaggctatgactaggtactctgccccccccggggacccgccccaaccagaatacgacttggagctaataacatcatgctcctccaacgtgtcggtcgcgcacgatgcatctggcaaaagggtgtactacctcacccgtgaccccaccaccccccttgcacgggctgcgtgggagacagctagacacactccagtcaactcctggctaggcaacatcatcatgtatgcgcccaccttatgggcaaggatggttctgatgattcacttcttctctatccttctagctcaggaacaacttgaaaaagccctggattgtcagatctacggggcctgttactccattgaaccacttgacctacctcagatcattcagcgactccatggtcttagcgcattttcactccatagttactctccaggagagatcaatagggtggcttcatgcctcaggaaacttggggtaccgcccttgcgagtctggagacatcgggccagaagtgtccgcgctaagctactgtcccggggggggagggccgctacttgtggcaagtacctcttcaactgggcggtaaggaccaagctcaaactcactccaattccggctgcgtcccggctggacttgtccggctggttcgttgctggttacagcgggggagacatatatcacagcctgtctcctgcccgaccccgctggttcatgtggtgcctactcctactttctgtaggggtaggcatctacctgctccccaaccgatgaacggggagctaaacactccaggccaataggccattccct

SEQ ID NO: 717 - DNA, 9533 bp, Hepatitis C Virus
gccagcccctgttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggtagggcctgggctcagcccgggtacccttggcccctctatggcaacgagggcctggggtgggcaggatggctcctgtcaccccgtggctcccggcctagttggggccccacagacccccggcgtaggtcgcgtaatttgggtaaggtcatcgataccctcacatgcggcttcgccgacctcatggggtacattccgctcgtcggcgcccccttagggggcactgccagggccctggcgcatggcgtccgggttctggaggacggcgtgaattatgcaacagggaatttgcccggttgctctttctctatcttcctcttggctttgctgtcctgtttgaccattccagcttccgcttatgaagtgcgcaacgtgtccggggtgtaccatgtcacgaacgactgttccaactcaagcattgtgtatgagacagcggacatgatcatgcacacccccgggtgcgtgccctgcgttcgggaggataacttcactcgctgctgggtagcgctcacccccacgctcgcggccaggaatggcagcgtccccactacggcgatacgacgccacgtcgatttgctcgttggggcggctgctttctgctccgctatgtacgtgggggatctttgcggatctgttttcctcgtctcccagctgttcaccttctctcctcgctggcatgagactgtacaggaatgtaattgctcaatttaccccggccacgtgacaggtcaccgcatggcttgggacatgatgatgaactggtcacctacaacagccctagtggtatcgcagttactccggatcccacaagctgtcgtggacatggtggcgggggcccactggggcgtcctggcgggcctcgcctactattccatggtggggaactgggctaaggtcttgattgtgacgctacttttcgctggcgttgacggcaacacccacacgataggggggaagcaagcccaggccactggcggcttcgtggcctggttggcgcgtgggccgtctcaggaaatccagcttataaacaccaacggcagctggcacatcaacagaactgccctaaactgcaatgactctctcaaaactgggtttattgccgctctgttctacgcacataggttcaactcttccggatgcccagagcgcatggccagctgccgccccattgacaagtttgcacaggggtggggtcccatcacctatgctaagcctgacagcttggaccagaggccctactgctggcactacgcgcctcaaccgtgtggtattgtacccgcgtcggaggtgtgtggcccagtgtactgcttcaccccgagccctgttgtagtggggacgaccgatcgttctggcgtccctacgtatcgctggggggagaatgagacggacgtgctgctccttaacaacacgcggccgccgcagggcaactggttcggctgtacatggatgaatgccactgggtttaccaagacgtgcgggggccccccatgtaaaatcggggggctcggcaacaacaccttgacttgccccacggactgcttccggaagcatcccgaggccacctacaccaaatgcggttcggggccttggttgacacccaggtgcatagttgactacccatacaggctttggcactacccctgcaccgtcaactttaccatcttcaaggttaggatgtatgtggggggtatagagcacaggctcagcgccgcgtgcaattggacccgaggagagcgttgcgacctggaggacagggataggtcagagctcagtccgctgctgctgtctacaacagagtggcagatactgccctgctccttcactaccctaccggctctgtccactggtttgatccatcttcatcagaacaccgtggacgtgcaatacctgtacggtgtagggtcagtgctcgtctccttcgcaatcaagtgggagtatatcctgttgttcttccttctcctggcggacgcgcgtgtctgtgcctgcttgtggatgatgctgctgatagctcaggccgaggccgccttggagaacctggtggtcctcaatgcggcgtccttggtcggagcgcatggcattctctccttccttgtgttcttctgtgctgcctggtacgtcaagggcaggttggttcccggggcggcatatgctctttatggcgtatggccgctgctcctgctcctgctggcactaccaccgcgagcatacgccatggaccgggagatggccgcatcgtgcggaggcgcggttttcataggtctggcactcctgaccttgtcaccatactataaagtgttcctcgccaagctcatatggtggttgcaatactttatcaccagagccgaggcgcatttgcaagtgtggatcccccctcttaatgttcgagggggccgcgatgccatcatccttcttacgtgcgcggtccacccagagctaatctttgacatcaccaagctcttgctcgctatactcggcccactcatggtgctccaggccggcataattagagcgccgtacttcgtgcgcgctcaagggctcattcgtgcatgcatgttggtgcggaaggttgctgggggccattatgtccagatggctcttatgaagctggccgcactgacgggtacgtacgtctacgaccaccttaccccactgcgggactgggcccacgcgggcctacgagaccttgcggtggcggttgagcccgtcgtcttttccgacatggagaccaagatcatcacctggggggcagacactgcagcgtgcggggacgtcatcttgggcctacccgtctccgcccgaagggggaaggagatatttctgggaccagccgatagccttgaggggcaagggtggcgactcctcgctcccatcacggcctattcccaacagacgcggggcctgcttggctgtatcatcaccagtcttacaggccgggacaagaaccaggtcgagggggaggttcaagtggtttccaccgcaacacaatctttcctggcgacctgtgtcaatggtgtttgctggactgtcttccatggcgctggctcaaagaccctagccggcccaaagggtccaatcacccaaatgtacaccaatgtagaccaggacctcgtcggctggccggcgccccccggagcgcgctccttgacaccttgcacctgcggcagctcggacctctacttggtctcgaggcatgctgatgtcatcccggtgcgccggcggggcgacagccgggggagcctactttcccccaggcccgtctcctacttgaagggttcctcgggtggcccactgctctgcccctcggggcatgtcgcgggcatcttccgggctgctgtgtgcacccggggggttgcgaaggcggtggactttgtgcccgttgagtctatggaaaccaccacgcggtccccggtcttcacggacaactcatccccacctgctgtaccgcagacatttcaagtggcccatctgcacgcccccactggcagcggcaagagcactaaggtgccagccgcatatgcagcccaagggtataaggtacttgtcctgaacccgtccgttgccgccacattaagttttggggcgtatatgtctaaggcacatggtgtcgaccctagcatcagaactgggacaaggaccatcaccacgggcgcccccatcacatattccacctacggcaagttccttgccgacggtggttgctctgggggcgcctatgacatcataatatgtgatgagtgccactcaactgactcgacctccatcttgggcatcggcacagtcctggaccaagcggagacggctggagcgcggctcgtcgtgctcgccaccgctacgcctccgggatcggtcaccgtgccacatcccaacatcgaggaggtggccttgtccaacactggagagattcctttctatggcaaagccatccccatcgaggccatcagggggggagggcacctcattttctgccactccaagaagaaatgtgacgagctcgccgcacagttgtcgagcctcggggtcaatgctgtagcatattaccggggccttgatgtatccgtcataccaaccagcggagacgtcgttgtcgtggcaacagacgctctaatgacgggctttaccggcgactttgactcagtgatcgactgtaatacgtgtgtcacccagacagttgatttcagcttggatcctaccttcaccattgagacgacgaccgtaccccaagatgcggtgtcgcgctcgcagcggcgaggcaggactggtaggggcaagaggggtatttataggtttgtgactccaggagaacggccttcgggcatgtttgactcctcggtcctgtgcgagtgctatgacgcgggctgtgcttggtacgagctcacgcccgccgagacctcggtcagactgcgggcttacctaaatacaccagggttgcccgtctgccaggaccatctggagttctgggagagcgtcttcacaggcctcacccacatagatgctcacttcttgtcccagaccaaacaggcaggagacaacttcccctacctggtagcataccaggctacggtatgcgccagagctcaggctccacctccatcgtgggaccaaatgtggaagtgcctcatacggctgaagcctacgctgcacgggccgacacccctgctgtacaggctaggagccgtccaaaacgaggttaccctcacacaccccgtaaccaaatacatcatggcatgcatgtcggctgacctggaggtcgtcactagcacctgggtgctggtaggcggggtccttgcagctctggccgcgtattgcctaacaacgggcagcgtggtcattgtgggcaggatcatcttgtccgggaagccggccattattcccgatagggaagttctctaccgagagttcgatgagatggaagagtgcgcctcacacctcccctacatcgaacagggaatgcaactcgccgagcaattcaagcagaaagcgctcgggttgctgcaaacagccaccaagcaagcggaggctgctgcccccgtggtggagtccaagtggcaagcccttgaggccttctgggcgaacgacatgtggaatttcatcagcggggtacaatacctagcaggcttgtccactctgcctggaaaccccgcaatagcatcactgatggcattcacagcttctatcaccagcccgcttaccacccaacataccctcctgtttaacatcttaggggggtgggtggccgcccagctcgccccccccagcgctgcttcggccttcgtgggcgccggcatcgccggtgcagctgttggcagcataggccttgggaaagtgctcgtggacatcctggcgggctatggagcaggggtggcaggcgcactcgtggcctttaaggtcatgagcggcgagatgccctccactgaggatctggtcaacttactccctgccatcctctccccaggcgccctggtcgtcggggtcgtgtgcgcagcaaaactgcgtcggcatgtgggcccgggggagggggctgtgcagtggatgaaccggctgatagcgttcgcttcgcggggcaaccatgtttcccccacgcactatgtgcctgagagcgacgctgcagcgcgtgtcacccaaatcctctccagccttaccatcactcagctgttaaagaggctccaccagtggatcagtgaggactgctctacgccatgctctggctcgtggctgagggatgtctgggactggatatgcacggtgttgacggacttcaagacctggctccagtccaagctcctgccgcggttaccgggagtccctttcttctcatgtcaacgtggttacaagggagtctggcggggagacggcatcatgcagaccacctgcccatgtggggcacaaatcaccggacatgtcaaaaacggttccatgaggatcgttgggcccagaacctgcagcaacacgtggcatggaacattccccatcaacgcatacaccacgggtccctgcacaccctccccggcgccaaactactctagggcgctgtggcgggtggctgcagaggagtacgtggaggttacgcgggtgggggatttccactacgtaacgggcatgaccaccgacaacgtaaagtgcccatgccaggtcccggcccccgaattcttcacggaagtggatggggtacggctgcacaggtacgctccggcatgcagacctctccttcgagacgaggtcacgttccaggtcgggctcaaccaatatctggtcgggtcacaactcccgtgcgagcccgagccggacgtaacagtgctcacttccatgctcaccgacccctcccacattacagcagaggcggctaagcgtaggttggccagggggtctcccccctccctggccagctcttcagctagtcagttgtctgcgccttccttgaaggcaacatgcactacccgtcatgactccccagatgctgacctcatcgaggccaacctcctgtggcgacaggagatgggcgggaacatcacccgcgtggagtcagagaataaggtagtaattctggactctttcgatccgctccgagcggaggaggatgagagggaaatatccgtcccggcggagatcctgcggaaatccaggagcttcccccgggcgatgcccatatgggcgcgcccggattacaaccctccgctgttggagtcctggaaggacccagactacgtccctcccgtggtacacgggtgcccattgccacctaccagggcccctccaataccaccaccacggaaaaagaggacggttgtcttaacagaatccaccgtgtcatctgccttggcagagctggccacaaagaccttcggcagctccgggtcgtcggccgtcgacagcggcacagcgaccgctcctcctgaccaaccctccgacggcggcgacacaggatccgacgttgagtcgtactcctccatgccccctcttgagggagagccgggggaccccgatctcagcgacgggtcttggtctaccgtaagcgaggaggccagtgaggacgtcgtctgctgctcgatgtcctacacatggacaggtgccctgatcacgccatgcgctgcggaggaaagcaagctgcccatcaatgcgttgagcaactctttgctgcgccaccataacatggtttatgccacaacatcccgcagtgcaagccagcggcagaagaaggttacttttgataggctgcaggtcctggatgatcactaccgggacgtgctcaaggagatgaaggcgaaggcgtccacagttaaggccaggcttctatccgtggaagaagcctgcaagctgacgcccccacattcggccaaatctaagtttggctatggggcaaaggacgtccggaacctgtccagcaaggccattaaccacatcaactccgtgtgggaggacttgctggaagacactgagacaccaattgacactaccatcatggcaaaaaatgaggttttctgcgttcaaccagagaaaggaggccgcaagccagctcgccttatcgtgttcccagatttgggagttcgtgtatgcgagaaaatggccctttacgacgtggtctccacccttcctcatgccgtgatgggctcctcatacgggtttcagtactcccccgggcagcgggtcgaatacctggtgaaagcctggagctcaaagaaaaaccctatgggcttcgcatatgacacccgctgttttgactcaacagttactgagaatgacatccgtgttgaggagtcaatttaccaatgctgtgacttggcccccgaagctagacaggccataaggtcgctcacagagcggctttatattgggggtcccctgaccaattcaaaagggcagaactgcggttatcgccgatgccgcgcaagcggcgtgctgacgactagctgcggtaataccctcacatgttacttgaaggcctctgcggcctgtcgagctgcgaagctccaggactgcacgatgctcgtgtgcggggacgacctcgtcgttatctgtgaaagcgcgggaacccaggaggacgcggcgagcctacgagtcttcacggaggctatgactagatactctgccccccccggggacccgccccaaccagaatacgacttggagctgataacatcatgctcctccaatgtgtcggtcgcgcacgatgcatctggcaaaagggtgtactacctcacccgtgaccccaccaccccccttgcacgggccgcgtgggagacagctagacacactccagtcaactcctggctaggcaacatcatcatgtatgcgcccaccttatgggcaaggatggttctgatgactcatttcttctctatccttctagctcaggaacaacttgaaaaagccctggattgtcagatctatggggcctgttactccattgaaccacttgacctacctcagatcattcagcgactccatggtcttagcgcattttcactccatagttactctccaggagagatcaatagggtggcttcatgcctcaggaaacttggggtaccacccttgcgagtctggagacatcgggccaggagtgtccgcgctaagctactgtcccggggggggagggccgctacttgtggcaagtacctcttcaactgggcggtaaggaccaagctcaaactcactccaattccggctgcatcccggctggacttgtccggctggttcgttgctggttacagcgggggagacatatatcacagcctgtctcctgcccgaccccgctggttcatgtggtgcctactcctactttctgtaggggtaggcatctacctgctccccaaccggtgaacggggagctaaacactccaggccaataggccatcctgttttttttttttttttctttctttggtggctccatcttagccctagtcacggctagctgtgaaaggtcggtgagccgcatgaccgcagagagtgctgatactggcctctctgcagatcatgt

SEQ ID NO: 718 - DNA, 9605 bp, Hepatitis C Virus
gccagcccccgattgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgtcggtggagtttacctgttgccgcgcaggggccccaggttgggtgtgcgcgcgactaggaagacttccgagcggtcgcaacctcgtggaaggcgacaacctatccccaaggctcgccagcccgagggtagggcctgggctcagcccgggtacccctggcccctctatggcaatgagggcttggggtgggcaggatggctcctgtcaccccgtggctctcggcctagttggggccccacggacccccggcgtaggtcgcgcaatttgggtaaggtcatcgataccctcacgtgcggcttcgccgatctcatggggtacattccgctcgtcggcgcccccctagggggcgctgccagggccctggcgcatggcgtccgggttctggaggacggcgtgaactatgcaacagggaatctgcccggttgctccttttctatcttccttttggctttgctgtcctgtttgaccatcccagcttccgcttatgaagtgcgcaacgtatccggagtgtaccatgtcacgaacgactgctccaacgcaagcattgtgtatgaggcagcggacatgatcatgcatacccccgggtgcgtgccctgcgttcgggagaacaactcctcccgctgctgggtagcgctcactcccacgctcgcggccaggaacgctagcgtccccactacgacgatacgacgccatgtcgatttgctcgttggggcggctgctctctgctccgctatgtacgtgggagatctctgcggatctgttttcctcgtcgcccagctgttcaccttctcgcctcgccggcacgagacagtacaggactgcaattgctcaatatatcccggccacgtgacaggtcaccgtatggcttgggatatgatgatgaactggtcacctacagcagccctagtggtatcgcagttactccggatcccacaagctgtcgtggatatggtggcgggggcccattggggagtcctagcgggccttgcctactattccatggtggggaactgggctaaggttctgattgtgatgctactctttgccggcgttgacgggggaacctatgtgacaggggggacgatggccaaaaacaccctcgggattacgtccctcttttcacccgggtcatcccagaaaatccagcttgtaaacaccaacggcagctggcacatcaacaggactgccctgaactgcaatgactccctcaacactgggttccttgctgcgctgttctacgtgcacaagttcaactcatctggatgcccagagcgcatggccagctgcagccccatcgacgcgttcgctcaggggtgggggcccatcacttacaatgagtcacacagctcggaccagaggccttattgttggcactacgcaccccggccgtgcggtatcgtacccgcggcgcaggtgtgtggtccagtgtactgcttcaccccaagccctgtcgtggtggggacgaccgaccggttcggcgtccctacgtacagttggggggagaatgagacggacgtgctgcttcttaacaacacgcggccgccgcaaggcaactggtttggctgtacatggatgaatagcactgggttcaccaagacgtgcgggggccccccgtgtaacatcggggggatcggcaataaaaccttgacctgccccacggactgcttccggaagcaccccgaggccacttacaccaagtgtggttcggggccttggttgacacccagatgcttggtccactacccatacaggctttggcactacccctgcactgtcaactttaccatcttcaaggttaggatgtacgtggggggagtggagcacaggctcgaagccgcatgcaattggactcgaggagagcgttgtaacctggaggacagggacagatcagagcttagcccgctgctgctgtctacaacggagtggcaggtattgccctgttccttcaccaccctaccggctctgtccactggtttgatccatctccatcagaacgtcgtggacgtacaatacctgtacggtatagggtcggcggttgtctcctttgcaatcaaatgggagtatgtcctgttgctcttccttcttctggcggacgcgcgcgtctgtgcctgcttgtggatgatgctgctgatagctcaagctgaggccgccctagagaacctggtggtcctcaacgcggcatccgtggccggggcgcatggcattctctccttcctcgtgttcttctgtgctgcctggtacatcaagggcaggctggtccctggggcggcatatgccctctacggcgtatggccgctactcctgctcctgctggcgttaccaccacgagcatacgccatggaccgggagatggcagcatcgtgcggaggcgcggttttcgtaggtctgatactcttgaccttgtcaccgcactataagctgttcctcgctaggctcatatggtggttacaatattttatcaccagggccgaggcacacttgcaagtgtggatcccccccctcaacgttcgggggggccgcgatgccgtcatcctcctcacgtgcgcgatccacccagagctaatctttaccatcaccaaaatcttgctcgccatactcggtccactcatggtgctccaggctggtataaccaaagtgccgtacttcgtgcgcgcacacgggctcattcgtgcatgcatgctggtgcggaaggttgctgggggtcattatgtccaaatggctctcatgaagttggccgcactgacaggtacgtacgtttatgaccatctcaccccactgcgggactgggcccacgcgggcctacgagaccttgcggtggcagttgagcccgtcgtcttctctgatatggagaccaaggttatcacctggggggcagacaccgcggcgtgtggggacatcatcttgggcctgcccgtctccgcccgcagggggagggagatacatctgggaccggcagacagccttgaagggcaggggtggcgactcctcgcgcctattacggcctactcccaacagacgcgaggcctacttggctgcatcatcactagcctcacaggccgggacaggaaccaggtcgagggggaggtccaagtggtctccaccgcaacacaatctttcctggcgacctgcgtcaatggcgtgtgttggactgtctatcatggtgccggctcaaagacccttgccggcccaaagggcccaatcacccaaatgtacaccaatgtggaccaggacctcgtcggctggcaagcgccccccggggcgcgttccttgacaccatgcacctgcggcagctcggacctttacttggtcacgaggcatgccgatgtcattccggtgcgccggcggggcgacagcagggggagcctactctcccccaggcccgtctcctacttgaagggctcttcgggcggtccactgctctgcccctcggggcacgctgtgggcatctttcgggctgccgtgtgcacccgaggggttgcgaaggcggtggactttgtacccgtcgagtctatggaaaccactatgcggtccccggtcttcacggacaactcgtcccctccggccgtaccgcagacattccaggtggcccatctacacgcccctactggtagcggcaagagcactaaggtgccggctgcgtatgcagcccaagggtataaggtgcttgtcctgaacccgtccgtcgccgccaccctaggtttcggggcgtatatgtctaaggcacatggtatcgaccctaacatcagaaccggggtaaggaccatcaccacgggtgcccccatcacgtactccacctatggcaagtttcttgccgacggtggttgctctgggggcgcctatgacatcataatatgtgatgagtgccactcaactgactcgaccactatcctgggcatcggcacagtcctggaccaagcggagacggctggagcgcgactcgtcgtgctcgccaccgctacgcctccgggatcggtcaccgtgccacatccaaacatcgaggaggtggctctgtccagcactggagaaatccccttttatggcaaagccatccccatcgagaccatcaagggggggaggcacctcattttctgccattccaagaagaaatgtgatgagctcgccgcgaagctgtccggcctcggactcaatgctgtagcatattaccggggccttgatgtatccgtcataccaactagcggagacgtcattgtcgtagcaacggacgctctaatgacgggctttaccggcgatttcgactcagtgatcgactgcaatacatgtgtcacccagacagtcgacttcagcctggacccgaccttcaccattgagacgacgaccgtgccacaagacgcggtgtcacgctcgcagcggcgaggcaggactggtaggggcaggatgggcatttacaggtttgtgactccaggagaacggccctcgggcatgttcgattcctcggttctgtgcgagtgctatgacgcgggctgtgcttggtacgagctcacgcccgccgagacctcagttaggttgcgggcttacctaaacacaccagggttgcccgtctgccaggaccatctggagttctgggagagcgtctttacaggcctcacccacatagacgcccatttcttgtcccagactaagcaggcaggagacaacttcccctacctggtagcataccaggctacggtgtgcgccagggctcaggctccacctccatcgtgggaccaaatgtggaagtgtctcatacggctaaagcctacgctgcacgggccaacgcccctgctgtataggctgggagccgttcaaaacgaggttactaccacacaccccataaccaaatacatcatggcatgcatgtcggctgacctggaggtcgtcacgagcacctgggtgctggtaggcggagtcctagcagctctggccgcgtattgcctgacaacaggcagcgtggtcattgtgggcaggatcatcttgtccggaaagccggccatcattcccgacagggaagtcctttaccgggagttcgatgagatggaagagtgcgcctcacacctcccttacatcgaacagggaatgcagctcgccgaacaattcaaacagaaggcaatcgggttgctgcaaacagccaccaagcaagcggaggctgctgctcccgtggtggaatccaagtggcggaccctcgaagccttctgggcgaagcatatgtggaatttcatcagcgggatacaatatttagcaggcttgtccactctgcctggcaaccccgcgatagcatcactgatggcattcacagcctctatcaccagcccgctcaccacccaacataccctcctgtttaacatcctggggggatgggtggccgcccaacttgctcctcccagcgctgcttctgctttcgtaggcgccggcatcgctggagcggctgttggcagcataggccttgggaaggtgcttgtggatattttggcaggttatggagcaggggtggcaggcgcgctcgtggcctttaaggtcatgagcggcgagatgccctccaccgaggacctggttaacctactccctgctatcctctcccctggcgccctagtcgtcggggtcgtgtgcgcagcgatactgcgtcggcacgtgggcccaggggagggggctgtgcagtggatgaaccggctgatagcgttcgcttcgcggggtaaccacgtctcccccacgcactatgtgcctgagagcgacgctgcagcacgtgtcactcagatcctctctagtcttaccatcactcagctgctgaagaggcttcaccagtggatcaacgaggactgctccacgccatgctccggctcgtggctaagagatgtttgggattggatatgcacggtgttgactgatttcaagacctggctccagtccaagctcctgccgcgattgccgggagtccccttcttctcatgtcaacgtgggtacaagggagtctggcggggcgacggcatcatgcaaaccacctgcccatgtggagcacagatcaccggacatgtgaaaaacggttccatgaggatcgtggggcctaggacctgtagtaacacgtggcatggaacattccccattaacgcgtacaccacgggcccctgcacgccctccccggcgccaaattattctagggcgctgtggcgggtggctgctgaggagtacgtggaggttacgcgggtgggggatttccactacgtgacgggcatgaccactgacaacgtaaagtgcccgtgtcaggttccggcccccgaattcttcacagaagtggatggggtgcggttgcacaggtacgctccagcgtgcaaacccctcctacgggaggaggtcacattcctggtcgggctcaatcaatacctggttgggtcacagctcccatgcgagcccgaaccggacgtagcagtgctcacttccatgctcaccgacccctcccacattacggcggagacggctaagcgtaggctggccaggggatctcccccctccttggccagctcatcagctagccagctgtctgcgccttccttgaaggcaacatgcactacccgtcatgactccccggacgctgacctcatcgaggccaacctcctgtggcggcaggagatgggcgggaacatcacccgcgtggagtcagaaaataaggtagtaattttggactctttcgagccgctccaagcggaggaggatgagagggaagtatccgttccggcggagatcctgcggaggtccaggaaattccctcgagcgatgcccatatgggcacgcccggattacaaccctccactgttagagtcctggaaggacccggactacgtccctccagtggtacacgggtgtccattgccgcctgccaaggcccctccgataccacctccacggaggaagaggacggttgtcctgtcagaatctaccgtgtcttctgccttggcggagctcgccacaaagaccttcggcagctccgaatcgtcggccgtcgacagcggcacggcaacggcctctcctgaccagccctccgacgacggcgacgcgggatccgacgttgagtcgtactcctccatgcccccccttgagggggagccgggggatcccgatctcagcgacgggtcttggtctaccgtaagcgaggaggctagtgaggacgtcgtctgctgctcgatgtcctacacatggacaggcgccctgatcacgccatgcgctgcggaggaaaccaagctgcccatcaatgcactgagcaactctttgctccgtcaccacaacttggtctatgctacaacatctcgcagcgcaagcctgcggcagaagaaggtcacctttgacagactgcaggtcctggacgaccactaccgggacgtgctcaaggagatgaaggcgaaggcgtccacagttaaggctaaacttctatccgtggaggaagcctgtaagctgacgcccccacattcggccagatctaaatttggctatggggcaaaggacgtccggaacctatccagcaaggccgttaaccacatccgctccgtgtggaaggacttgctggaagacactgagacaccaattgacaccaccatcatggcaaaaaatgaggttttctgcgtccaaccagagaaggggggccgcaagccagctcgccttatcgtattcccagatttgggggttcgtgtgtgcgagaaaatggccctttacgatgtggtctccaccctccctcaggccgtgatgggctcttcatacggattccaatactctcctggacagcgggtcgagttcctggtgaatgcctggaaagcgaagaaatgccctatgggcttcgcatatgacacccgctgttttgactcaacggtcactgagaatgacatccgtgttgaggagtcaatctaccaatgttgtgacttggcccccgaagccagacaggccataaggtcgctcacagagcggctttacatcgggggccccctgactaattctaaagggcagaactgcggctatcgccggtgccgcgcgagcggtgtactgacgaccagctgcggtaataccctcacatgttacttgaaggccgctgcggcctgtcgagctgcgaagctccaggactgcacgatgctcgtatgcggagacgaccttgtcgttatctgtgaaagcgcggggacccaagaggacgaggcgagcctacgggccttcacggaggctatgactagatactctgccccccctggggacccgcccaaaccagaatacgacttggagttgataacatcatgctcctccaatgtgtcagtcgcgcacgatgcatctggcaaaagggtgtactatctcacccgtgaccccaccaccccccttgcgcgggctgcgtgggagacagctagacacactccagtcaattcctggctaggcaacatcatcatgtatgcgcccaccttgtgggcaaggatgatcctgatgactcatttcttctccatccttctagctcaggaacaacttgaaaaagccctagattgtcagatctacggggcctgttactccattgagccacttgacctacctcagatcattcaacgactccatggccttagcgcattttcactccatagttactctccaggtgagatcaatagggtggcttcatgcctcaggaaacttggggtaccgcccttgcgagtctggagacatcgggccagaagtgtccgcgctaggctactgtcccagggggggagggctgccacttgtggcaagtacctcttcaactgggcagtaaggaccaagctcaaactcactccaatcccggctgcgtcccagttggatttatccagctggttcgttgctggttacagcgggggagacatatatcacagcctgtctcgtgcccgaccccgctggttcatgtggtgcctactcctactttctgtaggggtaggcatctatctactccccaaccgatgaacggggagctaaacactccaggccaataggccatcctgtttttttccctttttttttttcttttttttttttttttttttttttttttttttttctcctttttttttcctctttttttccttttctttcctttggtggctccatcttagccctagtcacggctagctgtgaaaggtccgtgagccgcttgactgcagagagtgctgatactggcctctctgcagatcaagt

SEQ ID NO: 719 - DNA, 9033 bp, Hepatitis C Virus
atgagcacgaatcctaaacctcaaagaaaaaccaaacgtaacaccaaccgccgcccacaggacgtcaagttcccgggcggtggtcagatcgtcggtggagtttacctgttgccgcgcaggggccccaggttgggtgtgcgcgcgactaggaagacttccgagcggtcgcaacctcgtggaaggcgacaacctatccccaaggctcgccagcccgagggtagggcctgggctcagcccgggtacccctggcccctctatggcaatgagggcttggggtgggcaggatggctcctgtcaccccgtggctctcggcctagttggggccccacggacccccggcgtaggtcgcgcaatttgggtaaggtcatcgataccctcacgtgcggcttcgccgatctcatggggtaccttccgctcgtcggcgcccccctagggggcgctgccagggccctggcgcatggcgtccgggttctggaggacggcgtgaactatgcaacagggaatctgcccggttgctccttttctatcttccttttggctttgctgtcctgtttgaccatcccagcttccgcttatgaagtgcgcaacgtatccggagtgtaccatgtcacgaacgactgctccaacgcaagcattgtgtatgaggcagcggacatgatcatgcatacccccgggtgcgtgccctgcgttcgggagaacaactcctcccgctgctgggtagcgctcactcccacgctcgcggccaggaacgctagcgtccccactacgacgatacgacgccatgtcgatttgctcgttggggcggctgctctctgctccgctatgtacgtgggagatctctgcggatctgttttcctcgtcgcccagctgttcaccttctcgcctcgccggcacgagacagtacaggactgcaattgctcaatatatcccggccacgtgacaggtcaccgtatggcttgggatatgatgatgaactggtcacctacagcagccctagtggtatcgcagttactccggatcccacaagctgtcgtggatatggtggcgggggcccattggggagtcctagcgggccttgcctactattccatggtggggaactgggctaaggttctgattgtgatgctactctttgccggcgttgacgggggaacctatgtgacaggggggacgatggccaaaaacaccctcgggattacgtccctcttttcacccgggtcatcccagaaaatccagcttgtaaacaccaacggcagctggcacatcaacaggactgccctgaactgcaatgactccctcaacactgggttccttgctgcgctgttctacgtgcacaagttcaactcatctggatgcccagagcgcatggccagctgcagccccatcgacgcgttcgctcaggggtgggggcccatcacttacaatgagtcacacagctcggaccagaggccttattgttggcactacgcaccccggccgtgcggtatcgtacccgcggcgcaggtgtgtggtccagtgtactgcttcaccccaagccctgtcgtggtggggacgaccgaccggttcggcgtccctacgtacagttggggggagaatgagacggacgtgctgcttcttaacaacacgcggccgccgcaaggcaactggtttggctgtacatggatgaatagcactgggttcaccaagacgtgcgggggccccccgtgtaacatcggggggatcggcagtaaaaccttgacctgccccacggactgcttccggaagcaccccgaggccacttacaccaagtgcggttcggggccttggttgatacccagatgcttggtccattacccatacaggctttggcactacccctgcactgtcaactttaccatcttcaaggttaggatgtacgtggggggagtggagcacaggctcgaagccgcatgcaattggactcgaggagagcgttgtaacctggaggacagggacagatcagagcttagcccgctgctgctgtctacaacggagtggcaggtattgccctgttccttcaccaccctaccggctctgtccactggtttgatccatctccatcagaacgtcgtggacgtacaatacctgtacggtatagggtcggcggttgtctcctttgcaatcaaatgggagtatgtcctgttgctccttcttcttctggcggacgcgcgcgtctgtgcctgcttgtggatgatgctgctgatagctcaagctgaggccaccctagagaacctggtggtcctcaacgcggcatccgtggcaggggcgcatggcattctctccttcctcgtgttcttctgtgctgcctggtacatcaagggcaggctggtccctggggcggcgtatgccctctacggcgtatggccgctactcctgctcctgctggcgttaccaccacaagcatacgccatggaccgggagatggcagcatcgtgcggaggcgcggttttcgtaggcctgatactcttgaccttgtcaccgcactataaatttttcctcactaggcccatatggtggttacaatattttatcaccagggccgaggcacacttgcaagtgtggatcccccctctcaacgttcgggggggccgcgatgccgtcatcctcctcacgtgcgcgatccacccagagctaatctttaccatcaccaaaatcttgctcgccatactcggtccactcatggtgcttcaggctggtataaccaaagtgccgtacttcgtgcgcgcacacgggctcattcgtgcatgcatgttggtgcggaaggttgcagggggtcattatgtccaaatggctctcatgaagttggccgcactgacaggtacgtacgtttatgaccatctcaccccactgcgggactgggcccacgcgggcctacgagaccttgcggtggcagtagagcccgtcgtcttctctgacatggagaccaaggttatcacctgggggccagacaccgcggcgtgtggggacatcatcttgggcctacccgtctccgcccgcagggggagggagatacatctgggaccggcagacagccttgaagggcaggggtggcgactcctcgcgcatattacggcctactctcaacagacgcggggcctacttggctgcatcatcactagcctcacaggccgggacaggaaccaggtcgagggggaggtccaaatggtctccaccgcaacacaatctttcctggcgacctgcgtcaatggcgtgtgttggactgtctatcatggtgccggctcaaagacccttgccggcccaaagggcccaatcacccaaatgtacaccaatgtggaccaggacctcgtcggctggcaagcgccccccggggcgcgttccttgacaccatgcacctgcggcagctcagacctttacttggtcacgaggcatgccgatgtcattccggtgcgccggcggggcgacagcaggggaagcctactctcccccaggcccgtctcctacttgaagggctcttcgggcggtccactgctctgcccctcggggcacgctgtgggcatcttccgggctgccgtgtgcacccgaggggttgcgaaggcggtggactttgtacccgtcgagtctatggaaaccactatgcggtccccggtcttcacggacaactcgtcccctccggccgtaccgcagacattccaggtggcccatctacacgctcccactggcagcggcaagagcaccaaggtgccggctgcgtatgcagcccaagggtataaggtgcttgtcctgaacccgtccgttgccgccaccctaagtttcggggcgtatatgtctaaggcacatggtatcgaccctaacatcagaaccggggtaaggaccaccaccacgggtgcccccatcacgtactccacctatggcaagtttcttgccgacggcggttgctctgggggcgcctatgacatcataatatgtgatgagtgccactcaactgactctaccactatcctgggcatcggcacagtcctggaccaagcggagacggctggagcgcgactcgtcgtactcgccaccgctacgcctccgggatcggtcaccgtgccacatcccaacatcgaggaggtggctctgtccagcactggagaagtccccttttatggcaaagccatccccatcgagaccatcaagggggggaggcacctcattttctgccattccaagaagaaatgtgatgagctcgccgcgaagctgtccggcctcggactcaatgctgtagcatattaccggggccttgatgtatccgtcataccaactagcggagacgtcattgtcgtagcaacagacgctctaatgacgggctttaccggcgacttcgactcagtgatcgactgtaatacatgtgtcacccaaacagtcgacttcagcctggacccgaccttcaccattgagacgacgaccgtgccacaagacgcggtgtcacgctcgcagcggcgaggcaggactggtaggggcagaataggcatttacaggtttgtgactccaggagaacggccctcgggcatgttcgattcctcggttctgtgcgagtgctatgacgcgggctgtgcttggtacgagctcacgcccgccgagacctcagttaggttgcgggcttacctaaacacaccagggttgcccgtctgccaggaccatctggagttctgggagagcgtctttacaggcctcacccacatagacgcccatttcttgtcccagactaaacaggcaggagacaacttcccctacctggtagcataccaggctacggtgtgcgccagggctcaggctccaccaccatcgtgggaccaaatgtggaagtgtctcatacggctaaagcctacgctgcatgggccaacgcccctgctgtacaggctaggagccgttcaaaacgaggttactaccacacaccccataaccaaatacatcatggcatgcatgtcggctgacctggaggtcgtcacgagcacctgggtgctagtaggcggagtcctagcagctctggccgcgtattgcctgacaacaggcagcgtggtcattgtgggcaggatcgtcttgtccggaaagccggccatcattcccgacagggaagtcctctaccgggagttcgatgagatggaagagtgcgcctcacacctcccttacatcgaacagggaatgcagctcgccgaacaattcaaacagaaggcaatcgggttgctgcaaacagccaccaagcaagcggaggctgctgctcccgtggtggaatccaagtggcggaccctcgaagccttctgggcgaagcatatgtggaatttcatcagcgggatacaatatttagcaggcttgtccactctgcctggcaaccccgcgatagcatcactgatggtattcacagcctctatcaccagcccgctcaccacccaacataccctcctgtttaacatcctggggggatgggtggccgcccaactcgctcctcccagcgctgcttctgctttcgtaggcgccggcattgctggtgcggctgttggcagcataggccttgggaaggtgcttgtggacattttggcaggttatggagcaggggtggcaggcgcgctcgtggcctttaaggtcatgagcggcgagatgccctccaccgaggacctggttaacctactccctgctatcctctcccctggcgccctagtcgtcggggtcgtgtgcgcagcaatactgcgtcggcacgtgggcccaggggagggggctgtgcagtggatgaaccggctgatagcgttcgcttcgcggggtaaccatgtctcccccacgcactatgtgcctgagagcgacgctgcagcgcgtgtcactcagatcctctctagtcttaccatcactcagctgctgaagaggcttcaccagtggattaacgaggactgctccacgccatgctccggctcgtggctaagagatgtttgggattggatatgcacggtgttgactgatttcaagacctggctccagtccaagctcctgccgcgattgccgggagtccccttcttctcatgtcaacgtgggtacaagggagtctggcggggcgacggcatcatgcaaaccacctgcccatgtggagcacagatcaccggacatgtcaaaaacggttccatgaggatctttgggcctaggacttgtagtaacacgtggcatggaacattccccattaacgcatacaccacgggcccctgcacgccctccccggcgccaaattattctagggcgctgtggcgggtggctgctgaggagtacgtggaggttacgcgggtgggagatttccactacgtgacgggcatgaccactgacaacgtaaagtgcccgtgtcaggttccggcccttgaattcttcacagaagtggatggggtgcggttgcacaggtacgctccagcgtgcaaacccctcctacgggaggaggtcacattcctggtcgggctcaatcaatacctggttgggtcacagctcccatgcgagcccgaaccggacgtagcagtgctcacttccatgctcaccgacccctcccacattacggcggagacggctaagcgtaggctggccaggggatctcccccttccttggccagctcttcagctagccagctgtctgcgccttccttgaaggcaacatgcactacccgtcatgactccccggacgctgacctcatcgaggccaacctcctgtggcggcaggagatgggcgggaacatcacccgcgtggagtcagaaaataaggtagtaattttggactctttcgagccgctccgagcggaggaggatgagagggaagtatccgttccggcggagatcctgcggaggtccaggaaattccctcgagcgatgcccatatgggcacgcccggattacaaccctccactgttagagtcctggaaggacccggactacgtccctccagtggtacacgggtgtccactgccgcctgccaaggcccctccgataccacctccacggaggaagaggacggttgtcctgtcagaatctaccgtgtcttctgccttggcggagctcgccacaaagaccttcggcagctccgaatcgtcggccgccgacagcggcacggcaacggcccctcctgaccagccctccgacgacggcgacgcggggtccgacgttgggtcgtactcctccatgcccccccttgaaggggagccgggggatcccgatctcagcgacgggtcttggtctaccgtaagcgaggaggctggtgaggacgtcgtctgctgctcgatgtcctacacatggacaggcgccctgatcacgccatgcgctgcggaggaaaccaagctgcccatcaatgcactgagcaactctttgctccgtcaccacaacttggtctatgctacaacatctcgcagcgcaagcctgcggcagaagaaggtcacctttgacagactgcaggtcctggacgaccactaccgggacgtgctcaaggagatgaaggcgaaggcgtccacagttaaggctaaacttctatccgtggaggaagcctgtaagctgacgcccccacattcggccagatctaaatttggctatggggcaaaggacgtccggaacctatccagcaaggccgttagccacatccgctccgtgtggaaggacttgctggaagacactgagacaccaattgacaccaccatcatggcaaaaaatgaggttttctgcgtccaaccagagaaggggggccgcaagccagctcgccttatcgtattcccagatttgggggttcgtgtgtgcgagaaaatggccctttacgatgtggtctccaccctccctcaggccgtgatgggctcttcatacggattccagtactctcctggacagcgggtcgagttcctggtgaatacctggaaatcgaaaaaatgccctatgggcttcgcatatgacacccgctgctttgactcaacggtcactgagaatgacatccgtgttgaggagtcaatctaccaatgttgtgacttggcccccgaagccagacaggccataaggtcgctcacagagcggctttacatcgggggccccctgactaattcaaaggggcagaactgcggctatcgccggtgccgcgcgagcggtgtactgacgaccagctgcggtaataccctcacatgttacttgaaggccgctgcggcctgtcgagctgcgaagctccaggactgcacgatgctcgtgtgcggagacgaccttgtcgttatctgtgaaagcgcggggacccaagaggacgaggcgagcctacgagccttcacggaggctatgactagatactctgccccccctggggacccgcccaaaccagaatacgacttggagttgataacatcatgctcctccaatgtgtctgtcgcgcacgatgcatctggcaaaagggtgtactatctcacccgtgaccccaccaccccccttgcgcgggctgcgtgggagacagctagacacactccagtcaattcctggctaggcaacatcatcatgtatgcgcccaccttgtgggcaaggatgatcctgatgactcatttcttctccatccttctagctcaggaacaacttgaaaaagccctagattgtcagatctacggggcctgttactccattgagccacttgacctacctcagatcattcaacgactccatggccttagcgcattttcactccatagttactctccaggtgagatcaatagggtggcttcatgcctcaggaaacttggggtaccgcccttgcgagtctggagacatcgggccagaagtgtccgcgctaggctactgtcccagggggggagggctgccacttgtggcaagtacctcttcaactgggcagtaaggaccaagctcaaactcactccaatcccggctgcgtcccagttggatttatccagctggttcgttgctggttacagcgggggagacacatatcgcagcctgtctcgtgcccgaccccgctggttcatgtggtgcctactcctactttctgtaggggtaggcatctacctgctccccaaccggtga

SEQ ID NO: 720 - DNA, 9610 bp, Hepatitis C Virus
gccagccccctgatgggggcgacactccaccatgaatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcatcatgagcacgaatcctaaacctcaaagacaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcacaacctcgaggtagacgtcagcctatccccaaggcgcgtcggcccgagggcaggacctgggctcagcccgggtacccttggcccctctatggcaatgagggctgcgggtgggcgggatggctcctgtccccccgtggctctcggcctagctggggccctacagaccccccgcgcaggtcgcgcaatttgggtaaggtcatcgataccctcacgtgcggcttcgccgacctcatggggtacattccgctcgtcggcgtccctcttggaggcgctgccagggccctggcgcatggcgtccgggttctggaagacggcgtgaactatgcaacagggaaccttcctggttgctctttctctatcttccttttggccctgctctcttgcctgactgtacccgcatcagcttaccacgtgcgcaattcctcgggcctttaccatgtcaccaatcattgccctaactcgagtattgtgtacgagacggccgataccattctacactctccggggtgtgtcccttgcgttcgcgagggtaacgcctcgagatgttgggtggcggtagcccccacggtcgccaccagggacggcaaacttcccacaacgcagcttcgacgtcacatcgatctgcttgtcgggagcgccaccctctgttcggccctctatgtgggggacttgtgcgggtctgtctttcttgtcggccaactgttcactttctctcccaggcgccactggacaacgcaagactgcaactgttctatctaccccggccatataacgggtcaccgcatggcatgggatatgatgatgaactggtcccctacaacagcgctggtagtagctcagctgctcagggtcccgcaagccatcttggacatgatcgctggtgcccactggggagtcctagcgggcatagcgtatttttccatggtggggaactgggcgaaggtcctggtagtgctgctgttgtttgccggcgtcgatgcgaacacctacgtcaccgggggggctgccgctaagggcgcatctacattcgctggactgttcgctccgggctccaggcagaatatccagctgatcaacaccaatggcagttggcacatcaatcgcacggccttgaactgcaacgcgagcctcgaaactggctggctagtggggctcttctattacaacaaattcaactcttcaggctgcaccgagaggatggccagctgtagaccccttgccgatttcgaccagggctggggccccatcacgtacgccaacggaagcggccccgaacaccgcccctactgctggcactaccccccaaagccttgtggtatcgtgccagcacagaacgtatgtggcccagtgtattgcttcacccctagccccgtggtggtgggaacgaccgacaggtcgggagcgcccacctacaactggggtagtaatgacacggacgtcttcgtccttaataacaccaggccaccgttgggcaattggttcggttgcacctggatgaactcatctggatttaccaaagtgtgcggagcgcctccttgtaacatcggaggggtgggcaacaacaccctgcactgccccactgactgtttccgcaagcatccggaagccacatactctcggtgtggctctggtccctggatcacgcccaggtgcctggtcgactatccctacaggctttggcattatccttgcaccctcaactacaccttgttcaaagtcaggatgtacgtggggggggtcgaacacaggctgggagttgcttgcaactggacgcggggcgagcgttgtgatctggacgacagggacaggtccgagctcagcccgctgctgctgtccaccacacagtggcaagtccttccgtgttccttcacgaccttgccagctctgactaccggcctcatccacctccaccagaacatcgtggacgtgcaatatttgtacggggtggggtcgagcattgtgtcctgggccatcaagtgggagtacgtcatcctcctgtttctcctgctcgcagacgcacgcatctgctcctgcttgtggatgatgctactcatatcccaagcggaggcagctctggagaaccttgtgttactcaatgcggcgtctctggccgggacgcgtggtcttgcgtccttcctcgtgttcttctgctttgcatggtatctgaagggtaagtgggtgcccggagcggcctatgccctctatgggatgtggcctctcctcctgctcttgttggcgttgccccaacgagcgtacgcgctggacacggagatggccgcgtcgtgtggcggcgttgttcttgtcgggttaatggcgctgactctgtcaccgtattacaagcgctatatcagctggtgcttttggtggcttcagtatttcctgaccagagtggaagcgcacctgcacgtgtggtttccccccctcaacgttcggggggggcgtgacgctgtcatcctactcatgtgtgttgtacacccgaccttggtattcgacatcaccaagctgctgctggccatcttcggacccctttggattcttcaaaccagtctgctcaaggtgccctacttcgtgcgcgtccaaggccttctccgggtctgcgtcgcctcaccgaagatggccggactgaggtacgtgcagatggccatgatcaaggtgggggcgcttactggcacctatgtgtataaccatctcaccccccttcgggactgggcgcacaacggcctgcgagatctggccgtggctgtagagccagtcgtcttttcccagatggagaccaagctcatcacgtgggggggggacaccgccgcatgcggtgacatcatcaacggcttacccgtctccgcccgtaggggccgagagatactgctcggaccggccgatggaatggtctccaaggggtggaggttgctggcgcccatcacggcgtacgcccagcagacaaggggccttttgggatgcataattaccagcctgaccggccgggacaaaaaccaggtggagggtgaggttcagattgtgtcaactgctgcccagaccttcctggcaacctgcatcaacggggtgtgctggactgtctaccacggggccggaacaaggaccatcgcgtcacccaagggtcccgttatccagatgtataccaatgtagaccaagacctcgtaggctggcccgctccccaaggtgcccgctcattgacaccctgcacttgcggctcctcggacctttacctggtcacgaggcacgccgatgtcattcccgtgcgccggcggggtgatggcaggggcagcctgctttcgccccgacctatctcttacctgaaaggctcctccgggggcccactgctgtgccctgcgggacacgccgtgggcatattcagggccgcggtatgtacccgaggagtggctaaggcggtggaatttgtccctgtagagaacctagagacaaccatgaggtccccggtgttcacagacaactctgccccaccagcagtgccccagagcttccaggtggcccacctgcatgctcccaccggcagcggtaagagcaccaaggtccctgccgcttacgcggctcagggttacaaggtgctggtgctcaacccttccgttgctgcaacactgggctttggtgcctatatgtccaaggcccatgggattgatcctaacatcaggactggggtgaggacaattaccaccggcagccccatcacgtactccacttacggcaagttccttgccgacggcgggtgctcagggggtgcttatgacataataatttgtgacgagtgccactccacggatgcaacatccatcttgggcatcggcactgtccttgaccaagcagagaccgcgggggcgaggctggttgtgctcgccaccgctacccctccgggctccgtcactgtgccccattctaacatcgaagaggttgctctgtccaccaccggggagattcctttttacggcaaggctatccccctcgaggtgatcaagggggggagacatctcatcttctgccactcaaagaagaagtgcgacgacctcgccgcaaaactggtcgcgttgggcatcaatgccgtggcttactaccgcggccttgacgtgtccgtcatcccgaccagtggcgacgttgtcgtcgtggcaacagatgctctcatgaccggctttaccggcgacttcgactcggtgatagattgcaacacatgtgtcacccagacagtcgatttcagcctcgaccctactttcaccattgagacaaccacgcttccccaggatgctgtctcccgcacccaacgtcggggcaggactggcagggggaagccaggcatctacagatttgtggcaccgggggagcgcccctccggtatgttcgactcggccgtcctctgcgagtgctatgacgcgggctgtgcttggtatgagctcacacccgccgagaccacagttaggctacgagcatacatgaacaccccgggacttcccgtgtgccaagaccatcttgaattttgggagggcgtcttcacgggtctcacccatatagacgctcacttcctatcccagacaaagcagagtggggaaaaccttccttacctggtagcgtaccaagccaccgtgtgcgctagagcccaagcccctcccccatcgtgggaccagatgtggaagtgcttgatccgtctcaagcccacccttcatgggtcaacacctctgctatacagactgggcgctgttcagaatgaagtcaccctaacgcacccagtcaccaaatatatcatgacatgcatgtcggctgatctggagatcgtcacgagtacctgggtgctcgttggcggcgttctggctgctttggccgcgtactgtctatccacaggctgcgtggtcatagtaggcaggattgtcttgtccgggaagccgccaatcatacccgaccaggaagtcctctaccgggagttcgatgagatggaagagtgctctcagcacttgccgtacatcgagccagggatgatgctcgccgagcagttcaagcagaaggcccttgcgctcttgcagaccgcgtcccgccaggcagaagtcatcgcccccgctgtccagaccaactggcaaagactcgaggccttctgggcgaagcatatgtggaacttcattagtgggatacaatatctggcgggcctgtcaacgttgcctggtaatcccgctattgcatcgttgatggcttttacagctgctgtcaccagcccactaaccactagccaaactctcctcttcaacatcttggggggatgggtggccgcccagctcgcagcccccggtgctgctaccgcctttgtgggcgctggattagccggcgccgccattggcagtgttggactggggaaggtactcgtggacatcctcgcaggatatggcgcgggcgtggcgggagctctcgtagcattcaagatcatgagcggtgaggtcccctccacagaggatatggtcaatctactgcccgccatcctctcgcccggagccctcgtagtcggtgtggtctgcgcaacgatactacgccggcacgttggcccgggcgagggggcagtgcagtggatgaaccggttgatagccttcgcctcccgggggaaccatgtttcccccacgcactacgtgccggagagcgatgcagctgcccgcgtcactgccatacttagcagcctcaccgtgacccagctcctgaggcgactacaccagtgggtaagctcggagagcaccactccatgctccggttcctggctaagggacatctgggactggatatgcgaggtgctgagcgattttaagacctggctgaaagccaagctcatgccacaactgcctgggattcctcttgtgtcctgccaacgcgggtataggggggtctggcagggagatggcgttatgcacacccgctgccactgtggagctgagatcactggacatgtcaagaacgggacgatgaggatcgttggtcctaagacctgcaggaacatgtggagtgggaccttccccatcaacgcctacaccacgggcccctgtaccccccttcctgcgccgaactatacgttcgcgctgtggagggtgtctgcggaggaatacgtggaaataaggcgggtgggggacttccactacgtgacgggtatgactactgacaacctgagatgcccatgccaggttccatcgcccgaatttttcacagaactggacggggtgcgcctgcataggtttgcgcccccttgcaagcccttgctgcgagatgaggtgtcgttcagagtaggactgcacgattatccggtggggtcgcaattaccttgcgagcctgaaccggacgtggccgtggtgacatccatgctcactgatccctcccatataacagcagaggcggctgggaggaggttagcgaggggatcgcccccctctgtggccagctcttcagccagccagttgtccgctccatctctcaaggcaacttgcaccaccaatcacgactcccctgacgctgagctcatagaggctaacctcctgtggagacaggagatgggcggtaacatcaccagggttgagtcagagaacaaagtggtggttctggactccttcgatccgcttgtggcggaagaggatgaacgggaggtctccgtgcccgcagaaattctgcggaagtcccggagattcgccgaggccctcgccatttgggcacggccggactacaaccccccgttgctggagacgtggaaaaagccggactatgaaccacctgtggtccatggctgccctcttccacctccacagtcccctcctgtgccctcgcctcggaagaagcggacggtggtcctcactgaatcaaccgtatctactgccttggccgagcttgccaccaagagctttggcagctcctcaacttccggcattgtgggcgacagtacaacaacgccctccgagcccgccccctctgtccgctccccagactccgacgcagagtcctgttcttccatgccccccctggagggggagcctggggatccggatctcagcgacgggtcatggtcgacggtcagtagtggggctgacggggaggatgtcgtgtgctgctcaatgtcttattcctggacaggcgcgcttgtcaccccgtgtgctgcggaagaacaaaaattgcctatcaacgcactgagcaactcgttactgcgtcaccacaatctcgtgtattccaccacctcacgcagtgcttgccaaaggcagaagaaagtcacttttgacagactgcaggttctggacaaccattaccaggacgtgctcaaggaggttaaggcggcggcatcaaaagtgaaggctaacttgctatccgtagaggaagcttgcagcctgacgcccccacattcagccagatccaaatttggttatggggcaaaagatgtccgttgccatgccagaaaggccgtaaaccacatcaactccgtgtggaaagaccttctggaagacaatgtaacaccaatagacactaccatcatggctaagaacgaagttttctgcgttcagcctgagaagggaggtcgtaagccagctcgcctcatcgtgttccccgacctgggcgtgcgcgtgtgcgagaagatggcactgtacgacgtggtcagcaagctccctccggccgtgatgggaagctcctacggattccaatactcaccaggacagcgggttgaattcctcgtgcaagcgtggaagtcgaagaagaccccaatggggttttcatatgatacccgctgctttgactccacagtcaccgagagcgatatccgtacggaggaggcaatctaccagtgttgtgacttggacccccaggcccgcgtggccatcaagtccctcaccgagaggctttatgtcgggggccctcttaccaattcaagaggagaaaactgcggctatcgcaggtgccgcgccaggatcgtactgacaactagctgtggtaacaccctcacttgctacatcaaggcccaagcagcctgtcgagccgcagggctccgggactgcaccatgctcgtgtgtggcgacgacttagtcgttatctgtgaaagtcagggagtccaggaggatgcagcgagcctgagagccttcacggaggctatgaccaggtactccgtccccccccgggaccccccccaaccagaatacgacttggagctcataacatcgtgctcctctaacgtgtcagtcgcccacgacggtgctgggaagagggtctattaccttacccgtgaccctacaacccccctcgcgagagctgcgtgggaaacagcaagacacactccaatcaattcctggctaggcaacataatcatgttcgcccctacattgtgggcgaggatgatactgatgacccacttcttcagtgtcctcatggccagggatcagctcgaacaggcccttgattgtgaaatctacggagcctgctactccatagaaccactggacctacctccaatcattcaaagactccatggccttagcgcgttctctctccacagttactctccaggtgaaatcaacagggtggccgcatgcctcaggaaacttggggtcccgcccttgcgagcttggagacaccgggcccggagcgtccgcgctaagcttctgtccagaggaggcagggctgccatatgtggcaaatacctcttcaattgggcagtaagaacaaagctcaaactcactccaatagcggccgctggccagctggacctgtccggctggttcacggctggctacagcgggggagacatttatcacagcgtgtctcgtgcccggccccgctggttctggttttgcctactcctgcttgctgcaggggtatgcatctacctcctccccaaccgatgaacggggagctaaacactccaggccaataggccatcctgttttttttttttttttttttttctttttttttttttttttctttttttttcttctttttctttccttttttttttttttttttttttttcttctttcggtggctggctcttagccctagtcacggctagctgtgaaaggtccgtgagccgcatgactgcagagagtgctgatactggcctctctgcagatcatgt

SEQ ID NO: 721 - DNA, 9408 bp, Hepatitis C Virus
gccagcccccgattgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcatcatgagcacaaatcctaaaccccaaagaaaaaccaaacgtaacaccaaccgccgcccacaggacgtcaagttcccgggtggtggtcagatcgttggtggagtttacctgttgccgcgcaggggccccaggttgggtgtgcgcgcgactaggaagacttccgagcggtcacaacctcgtggaaggcgacaacctatccccaaggctcgccagcccgagggcagggcctgggctcagcccgggtacccttggcccctctatggcaacgagggcatggggtgggcaggatggctcctgtcaccccgcggctcccggcctagttggggccccacggacccccggcgtaggtcgcgtaatttgggtaaggtcatcgataccctcacatgcggcttcgccgacctcatggggtacattccgctcgtcggcgcccccctagggggcgttgccagggccctggcacatggtgtccgggttgtggaggacggcgtgaactatgcaacagggaatttgcccggttgctctttctctatcttcctcttggctctgctgtcctgtttgaccatcccagcttccgcttatgaggtgcgcaacgtatccgggatataccatgtcacgaacgactgctccaactcaagtattgtgtatgaggcagcggacatgatcatgcatacccccgggtgcgtgccctgcgttcgggagggcaactcctcccgttgctgggtggcacttactcccacgctagcggccaggaatgccagcgtccccactacggcaatacgacgccatgtcgatttgctcgttggggcggctgctttctgctccgctatgtatgtgggagatctctgcggatctgttttccttgtctcccagctgttcaccttctcgccccgccggcatgagacaatacaggactgcaattgctcaatctatcccggccacgtgtcaggtcaccgcatggcttgggacatgatgatgaactggtcgcctacaacggccctggtggtgtcgcagttactccggatcccacaagctatcgtggacatggtggcgggggctcactggggtgtcctagcgggccttgcctactattccatggtggggaactgggctaaggtattgattgtgatgctactttttgccggcgtcgacggggagacccgtgtgacaggggggcagatagccagaaatgcctactcgctcacgaccctcttttcatctgggtcggctcagaacatccagctcataaacaccaacggtagctggcacatcaacaggactgccctgaactgcaatgactccctcaacaccgggtttcttgccgcgctgttctacacgcacaagttcaacgcgtccggatgtccagagcgcttggccagctgccgccccattgacaagttcgatcaggggtggggtcccatcacttatgctgagcagggcggccaggaccagaggccttattgctggcactacgcacctaaaccatgtggtattgtatccgcgtcgaaggtgtgtggtccagtgtattgtttcaccccaagcccagttgtagtggggacgaccgatcggttcggtgtccctacgtatagctggggggagaatgagacagacgtgctgctccttaacaacacgcggccgccgcaaggcaactggttcggctgtacgtggatgaacggcactgggttcaccaagacatgcgggggccccccgtgtaacatcggggggggcggcaataacaccttgacctgccctacggactgtttccggaagcaccccgcggccacttacacaaaatgtggttcgggaccttggctgacacccaggtgcttggtagactacccatacaggctctggcactacccctgcactgccaactttaccatcttcaaggttaggatgtatgtagggggcgtggagcacaggctcgatgctgcatgcaattggacccgaggggaacgttgcaacttggaggatagggatagattggagctcagcccgctactgctgtctacaacagagtggcaggtgctgccctgttctttcaccaccctaccggctctgtccactggtttaattcatctccatcagaacatcgtggacgtgcaatacctgtacggtatagggtcggcagttgtttcctttgcaatcaaatgggactatatcgtgatacttttcctcctcctggcggacgcgcgcgtctgtgcctgcttgtggatgatgctgctgatagcccaggccgaggccgccttagaaaacctggtggtcctcaatgcggcgtccgtggccggagcgcatggcattctctccttccttgtgttcttctgtgccgcctggtacatcaagggcaagctggtccccggggcagcatatgctttctatggagtatggccgctgctcctgcttctgctggccttaccaccacgagcttacgctatggagcgggagatggctgcatcgtgcggaggcgcggtgtttgtaggtctggtactcttgactttgtcaccatactataaagagttcctcgccaggctcatatggtggttgcaatattttatcaccagagccgaggcgcacctgcaagtgtggatcccccccctcaacattcgggggggccgcgatgccatcatcctcctcgcgtgtgtagtccacccagagctaatctttgacatcaccaaactcctgctcgccatactcggtccgctcatggtgctccaggctagcataactcaagtgccgtacttcgtacgcgcccaagggctcattcgtgcatgcatgttggtgcggaaggtagccgggggccattatgtccaaatggcctttgtgaagctgaccgcactgacaggtacgtacgtttatgaccatctaactccactgcgggactgggcccacgcgggcctgcgagacctcgcggtggcagtagagcccgttgtcttctctgacatggagaccaaggtcatcacctggggggcagacaccgcagcgtgtggggacattatcttgggtctacctgtctccgcccgaaggggtagggagatacttctggggccggccgatagtcttgaagggcaggggtggcggctccttgctcccatcacggcctattcccaacagacgcggggcctacttggttgcatcatcactagcctcacaggccgggacaaaaaccaagtcgagggggaggttcaagtggtctccaccgcgacacaatccttcctggcgacctgcgtcaatggcgcgtgctggactgtcttccatggtgccggctcaaagaccttagctggcccaaaaggtccaatcacccagatgtacactaatgtagacctggacctcgtcggctggcaggcgccccccgggtcgcgttctctgacaccatgcacctgcggcagctcagacctctatttggtcacgagacatgctgatgtcattccggtgcgccggcggggcgacagtaggggaagcctactctctcccagacctgtctcctacttgaaaggctcctcgggtggtccgctgctctgcccttcgaggcacgctgtgggcatcttccgggctgctgtgtgcacccggggggttgcgaaggcggtggatttcatacccgttgaatcaatggaaactactatgcggtctccggtcttcacggataactcatcccccccggccgtaccgcagacattccaagtggcccatctacacgcccctactggcagcggcaagagcactaaggtgccggctgcatatgcagcccaagggtataaggtgctcgtcctgaacccgtccgttgccgctaccttgggttttggggcgtatatgtctaaggcacatggtatcgaccccaacatcagaactggggtaagggccatcaccacgggcgcccctattacatactccacctacggcaagttccttgccgacggcggttgttccgggggcgcctatgacatcataatatgtgatgagtgccactcaactgactcgactaccatcttgggcattggcacagtcctggaccaagcggagacggctggagcgcggctcgtcgtgctcgccaccgctacgcctccgggatcggtcaccgtgccacaccccaatattgaggaggtggccctgtccaacgctggagaaatccccttctacggcaaagccatccccattgaggtcatcaaggggggaagacatctcattttctgccattccaagaagaagtatgacgagctcgccgcaaagctatcagccctcggacttaatgctgtagcatattatcggggtcttgatgtgtccgtcataccgaccaacggagacgtcgttgtcgtggcaacagacgctctaatgacgggctttaccggcgactttgactcagtgatcgactgtaacacatgtgtcacccagacagtcgatttcagcctggatcccaccttcaccatcgagacgacgaccgtgccccaagacgcagtggcgcgatcacagcggcggggtaggactggtaggggcaggagaggcatctacaggtttgtgactccaggagaacggccctcgggcatgttcgattcctcggtcctgtgtgagtgctatgacgcgggctgtgcttggtacgagctcacgcctgctgagacctcggttaggttgcgggcttacctgaatacaccagggttgcccgtctgccaggaccatctggagttttgggagagcgtctccacaggcctcacccacatagatgcccattttctgtcccagactaaacaggcaggagacaacttcccctacctggtagcataccaagccacagtgtgcgccagagctcaagctccacctccatcatgggatcaaatgtggaagtgtctcatacggctcaaacccacgctgcacgggccaacacccctgctgtataggctaggagccgtccaaaatgagatcaccctcacacaccccatgaccaaattcatcatggcatgcatgtcggctgacctggaggtcgtcactagcacctgggtgctagtaggcggagtccttgcagctctggctgcatattgcttgacaacaggcagtgtggtcattgtgggtaggatcatcttgtccgggaggccggctgttattcccgacagggaagtcctctaccgggagttcgatgagatggaagagtgcgcctcacacctcccttacatcgaacagggaatgcagcttgccgagcaattcaagcagaaggcgctcggattgctgcaaacagccaccaagcaagcggaggctgctgctcccgtggtagaatccaagtggcgagcccttgagaccttctgggcgaagcacatgtggaatttcatcagcgggatacagtacctagcaggcttgtccactctgcctgggaaccccgcgatagcatcactgatggcattcacagcctctatcaccagcccgctctccacccagaataccctattatttaacatctgggggggatgggtggctgcccaactcgccccccccagtgctgcttcggctttcgtgggcgccggtatcgccggtgcggctgtcggcagcataggtcttgggaaggtgcttgtggacatcttggcgggatatggggcaggggtggctggcgcgctcgtagcttttaagatcatgagcggcgaggtgccctccaccgaggacctggttaacttactccctgccatcctctctcccggcgccctagtcgtcggggtcgtgtgcgcagcaatactgcgtcggcacgtgggcccgggagagggggctgtacagtggatgaaccggctgatagcgttcgcctcgcggggtaaccacgtttcccccgcgcactatgtgcctgagagcgacgctgcggcgcgtgttactcagatcctctccggccttaccatcactcagctgctgaagaggcttcaccactggatcaatgaggactgctccacgccatgctccggttcgtggctaagggatgtttgggactggatatgcacggtgttgactgacttcaagacctggctccagtccaagctcctgccgcggttaccgggggtccctttcttctcgtgtcaacgcgggtacaagggagtctggcggggggacggtatcatgcagaccacctgcccgtgtggagcacagatcaccggacatgtcaaaaacggttccatgaggatcgtcgggcctaaaacctgcagcagcacgtggcatggaacgttccccatcaacgcatacaccacaggcccatgcgcaccctccccggcgccaaactattccagggcgctatggcgggtggccgctgaggagtacgtggaggttacgcgggtgggggatttccactacgtgacgggcatgaccactgacaacgtaaagtgcccatgccaggttccggcccctgaattcttcactgaggtggatggagtgcggttgcacaggtacgctccggcgtgcaaacccctcctacgggaggaggtcacattccaggttgggctcaaccaatacctggttgggtcacagctcccatgcgagcccgaaccggatgtagcagtgctaacttccatgcttaccgacccctcccacatcacagcagagacggcaaagcgtaggctggctagggggtctcccccctccttggccagttcttcagctagccagttatctgcgccttccttgaaggcgacatgcactacccatcatgactccccggacgttgacctcatcgaggccaacctcctgtggcggcaggagatgggcgggaacatcacccgcgtggagtcagagaataaggtagtaattttggactctttcgatccgctccgagcggaggaggacgagagggaaccatccgttgcggcggagatcttgcggaaaaccaagaggttccccccggcgatgcccatatgggcacgcccggattacaaccctccgttgctagagtcctggaaagacccggactacgtccctccggtggtacacgggtgcccgctaccacctaccaaagctcctccgataccacccccacggagaaagaggacggtagtcctgacagagtccactgtgtcttctgccttggcggagcttgctactaagacctttggcagctccgggtcgtcggccgtcgacagcggcacggcaactgctcctcccgaccaggcttccgacgacggcgaccaaggatctgacgttgagtcgtattcctccatgccccctcttgagggagagccgggggaccccgatctcagcgacgggtcttggtctaccgtgagcgaggaggccggtgaggacgtcatctgctgctcaatgtcctacacatggacaggcgccttgatcacgccatgcgccgcggaggaaagcaagttgcccatcaacccgttgagcaactctttgttgcgtcaccacaacatggtctatgctacaacatcccgcagcgcaggcctacggcagaagaaggtcacctttgacagactgcaagtcctggacgaccactaccgggacgtgctcaaggagatgaaggcgaaggcgtccacagttaaggctaaactcctatccatagaagaagcctgtaagctgacgcccccacattcggccagatccaaatttggctatggggcaaaggacgtccggaacctatccagcaaggccgttaaccacatccgctccgtgtggaaggacttgctggaagacactgagacaccaattgacaccaccgtcatggcaaaaagtgaggttttctgcgtccaaccagagaaaggaggccgcaagccagctcgccttatcgtattcccagacttgggggttcgtgtatgcgagaagatggccctttatgacgtggtctccacccttcctcaggccgtgatgggctcctcatacggattccagtactcccctggacagcgggtcgagttcctggtgaatgcctggaaatcaaagaaatgccctatgggcttttcatatgacacccgctgttttgactcgacagtcactgagagtgacatccgtgttgaggagtcaatttaccaatgttgtgacttggcccccgaagccagacaggccataaagtcgctcacagagcggctttacattgggggtcccctgaccaattcaaaagggcagaactgtggctatcgccggtgccgcgcgagtggcgtgctgacgaccagctgcggtaatacccttacatgttacttgaaggcctctgcagcctgtcgagctgcaaagctccgggactgcacgatgctcgtgaacggagacgacctcgtcgtcatctgtgagagtgcgggaacccaagaggatgaggcgaacctacgagtcttcacggaggctatgactaggtattctgccccccccggggacccgccccgaccagaatacgacttggagctaataacatcatgttcctccaatgtgtcggtcgcgcacgatgcatctggcaaaagggtatactacctcacccgcgacccctccaccccccttgcacgggctgcgtgggagacagctagacacactccagttaattcctggctaggcaacatcattatgtatgcgcccaccttatgggcaaggatgattctgatgacccatttcttctccatccttctagcccaggagcaacttgaaaaagccctggattgccagatctacggggcctgttactccattgagccacttgacctacctcagatcattgaacgactccatggtcttagcgcattttcactccatagttactctccaggtgagatcaatagggtggcttcatgcctcaggaaacttggggtaccacccttgcgagtctggagacatcgggccagaagtgtccgcgctaagctgctgtcccagggggggagggctgccacttgtggtaagtacctcttcaactgggcagtaaggaccaagctcaaactcactccaatcccggcagcgtcccagttggacttgtccagctggttcgtggctggttacagcgggggagacatatatcacagcctgtctcgtgcccgaccccgctggttcatgttgtgcctactcctactttcagtaggggtaggcatctacctgctccccaaccgataaacggggagctaaacactccaggccaataggccat

SEQ ID NO: 722 - DNA, 9441 bp, Hepatitis C Virus
  misc_feature 9382: n = A,T,C or G
gccagccccctgatgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgacgcccacagaacgttaagttcccgggtggcggccagatcgttggcggagtttgcttgttgccgcgcaggggtcccagagtgggtgtgcgcgcgacgaggaagacttccgagcggtcacaacctcgcggaaggcgtcagcctattcccaaggcccgccgacccgagggcaggtcctgggcgcagcccgggtacccttggcccctctatggcaacgagggctgtgggtgggcaggatggctcttgtccccccgcggctcccggcctagtcggggcccctctgacccccggcgcaggtcacgcaatttgggtaaggtcatcgataccctcacgtgtggcttcgccgacctcatggggtacatcccgctcgtcggtgctcctctagggggcgctgctagggctctggcacatggtgttagggttctagaagacggcgtaaattacgcaacagggaaccttcctggttgctctttttctatcttcttgcttgctcttctctcctgcttgacagtccctgcttcggccgtcgaagtgcgcaactcttcggggatctaccatgtcaccaatgattgccccaatgcgtctgttgtgtacgagacagatagcttgatcatacatctgcccgggtgtgtgccctgcgtacgcgagggcaacgcttcgaggtgctgggtctcccttagtcctactgttgccgctaaggatccgggcgtccccgtcaacgagattcggcgtcacgtcgacctgattgtcggggccgctgcattctgttcggctatgtatgtaggggacttatgcggttccatcttcctcgttggccagcttttcaccctctcccctaggcgccactggacaacacaagactgtaattgctccatctacccaggacatgtgacaggccatcgaatggcttgggacatgatgatgaattggtcacctactggcgctttggtggtagcgcagctactccggatcccacaagccgtcttggatatgatagccggtgcccactggggtgtcctagcgggcccggcatactactccatggtggggaactgggctaaggttttggttgtgctactgctcttcgctggcgtcgatgcaaccacccaagtcacaggtggcaccgcgggccgtaatgcatatagattggctagcctcttctccaccggccccagccaaaatatccagctcataaactccaatggcagctggcacattaacaggactgccctgaattgcaatgacagcctgcacaccggctgggtagcagcgctgttctactcccacaagttcaactcttcggggcgtcctgagaggatggctagttgtcggcctcttaccgccttcgaccaagggtgggggcccatcacttacggggggaaagctagtaacgaccagcggccgtattgctggcactatgccccacgcccgtgcggtatcgtgccggcgaaagaggtttgcgggcctgtatactgtttcacacccagtcccgtggtagtggggacgacggacaagtacggcgttcctacctacacatggggcgagaatgagacggatgtactgctccttaacaactctaggccgccaatagggaattggttcgggtgtacgtggatgaattccactggtttcaccaagacgtgcggggctcctgcctgtaacgtcggcgggagcgagaccaacaccctgtcgtgccccacagattgcttccgcagacatccggacgcaacatacgctaagtgcggctctggcccttggcttaaccctcgatgcatggtggactacccttacaggctctggcactatccctgcacagtcaattacaccatattcaagatcaggatgttcgtgggcgggattgagcacaggctcaccgccgcgtgcaactggacgcggggagagcgctgcgacttggacgacagggatcgtgccgagttgagcccgctgttgctgtccaccacgcaatggcaggtcctcccctgctcattcacaacgctgcccgccctgtcaactggcctaatacatctccaccagaacatcgtggacgtgcagtacctctacgggttgagctcggtagttacatcctgggccataaggtgggagtatgtcgtgctccttttcttgctgttagcagatgcccgcatttgtgcctgcctttggatgatgcttctcatatcccaggtagaggcggcgctggagaacctgatagtcctcaacgctgcttccctggctgggacacacggcatcgtccctttcttcatctttttttgtgcagcctggtatctgaaaggcaagtgggcccctggactcgtctactccgtctacggaatgtggccgctgctcctgcttctcctggcgttgccccaacgggcgtacgccttggatcaggagttggccgcgtcgtgtggggccgtggtcttcatcagcctagcggtacttaccctgtcgccgtactacaaacagtacatggcccgcggcatctggtggctgcagtacatgctgaccagagcggaggcgctcctgcacgtctgggtcccctcgctcaacgcccggggagggcgtgatggtgccatactgctcatgtgtgtgctccacccgcacttgctctttgacatcaccaaaatcatgctggccattctcgggcccctgtggatcttgcaggccagtctgctcagggtgccgtacttcgtgcgcgcccacggtctcattaggctctgcatgctggtgcgcaaaacagcgggcggtcactatgtgcagatggctctgttgaagctgggggcacttactggcacttacatttacaaccacctttccccactccaagactgggctcatggcagcttgcgtgatctagcggtggccaccgagcccgtcatcttctcccggatggagatcaagactatcacctggggggcagacaccgcggcctgtggagacatcatcaacgggctgcctgtttctgctcggagggggagagaggtgttgttgggaccagccgatgccctgactgacaagggatggaggcttttagcccccatcacagcttacgcccaacagacacgaggtctcttgggctgtattgtcaccagcctcaccggtcgggacaaaaatcaagtggagggggaaatccagattgtgtctaccgcaacccagacgttcttggccacttgcatcaacggagcttgctggactgtttatcatggggccggatcgaggaccatcgcttcggcgtcgggtcctgtggtccggatgtacaccaatgtggaccaggatttggtgggctggccagcgcctcagggagcgcgctccctgacgccgtgcacgtgcggtgcctcggatctgtacttggtcacgaggcacgcggatgtcatcccagtgcggcgtcgaggcgataacaggggaagcttgctttctccccggcccatctcatacctaaaaggatcctcgggaggccctctgctctgccccatgggacatgtcgcgggcatttttagggccgcggtgtgcacccgtggggttgcaaaggcggtcgactttgtgcccgttgagtccttagagaccaccatgaggtccccagtgtttactgacaattccagccctccaacagtgccccagagttaccaggtggcacatctacatgcacccactgggagtggcaagagcacgaaggtgccggccgcttacgcagctcaagggtacaaggtacttgtgctgaacccgtctgttgctgccaccttagggttcggtgcttatatgtcaaaggcccatgggattgacccaaacgtcaggaccggcgtgaggaccattaccacaggctcccccatcacctactccacctacgggaaatttttggctgatggcggatgcccaggaggtgcgtacgacatcataatatgtgacgaatgtcactcagtggacgccacctcgattctgggcatagggaccgtcttggaccaagcggagacggcgggggttaggctcactgtccttgccaccgctacaccacctggcttggtcaccgtgccacattccaacatcgaggaagttgcactgtccgctgacggggagaaaccattttatggtaaggccatccccctaaactacatcaagggggggaggcatctcattttctgtcattccaagaagaagtgcgacgagctcgctgcaaagctggtcggtctgggcgtcaacgcggtggccttttaccgtggcctcgacgtatctgtcattccaactacaggagacgtcgttgttgtagcgaccgacgccttgatgactggcttcaccggcgatttcgactctgtgatagactgcaacacctgtgtcgtccagacagtcgacttcagcctagaccctatattctctattgagacttccaccgtgccccaggacgccgtgtcccgctcccaacggaggggtaggaccggtcgagggaagcatggtatttacagatatgtgtcacccggggagcggccgtctggcatgttcgactccgtggtcctctgtgagtgctatgacgcgggttgtgcttggtacgagcttacacccgccgagaccacagtcaggctacgggcataccttaacaccccaggattgcccgtgtgccaggaccacttggagttctgggagagtgtcttcaccggcctcacccacatagatgcccacttcctgtcccagacgaaacagagtggggagaacttcccctacctagtcgcataccaagccaccgtgtgcgctagagctagagctcctcccccgtcatgggaccaaatgtggaagtgcctgatacggctcaagcccaccctcactggggctaccccattactatacagactgggtagtgtacagaatgagatcaccttaacacacccaatcacccaatacatcatggcttgcatgtcggcggacctggaggtcgtcactagcacgtgggtgttggtgggcggcgtcctagccgctttggccgcttactgcctgtccacaggcagcgtggtcatagtgggcaggataatcctaggtgggaagccggcagtcatacctgacagggaggttctctaccgagagtttgatgagatggaggagtgcgccgcccacgtcccctacctcgagcaggggatgcatttggctggacagttcaagcagaaagctctcgggttgctccagacagcatccaagcaagcggagacgatcactcccactgtccgcaccaactggcagaaactcgagtccttctgggctaagcacatgtggaacttcgttagcgggatacaatacctggcgggcctgtcaacgctgcccgggaaccccgctatagcgtcgctgatgtcgtttacggccgcggtgacgagtccactaaccacccagcaaaccctcttctttaacatcttaggggggtgggtggcggcccagcttgcttccccagctgccgctactgcttttgtcggtgctggtattactggcgccgttgttggcagtgtgggcctagggaaggtcctagtggacattattgctggctacggggctggtgtggcgggggccctcgtggctttcaaaatcatgagcggggagacccccaccaccgaggatctagtcaaccttctgcctgccatcctatcgccaggagctctcgttgtcggcgtggtgtgcgcagcaatactacgccggcacgtgggccctggcgagggcgccgtgcagtggatgaaccggctgatagcgtttgcttctcggggtaaccacgtctcccctacacactacgtgccggagagcgacgcgtcggctcgtgtcacacaaattctcaccagcctcactgttactcagcttctgaaaaggctccacgtgtggataagctcggattgcatcgccccgtgtgctagttcttggcttaaagatgtctgggactggatatgcgaggtgctgagcgacttcaagaattggctgaaggccaaacttgtaccacaactgcccgggatcccattcgtatcctgccaacgcgggtaccgtggggtctggcggggcgagggcatcgtgcacactcgttgcccgtgtggggccaatataactggacatgtcaagaacggttcgatgagaatcgtcgggcctaagacttgcagcaacacctggcgtgggtcgttccccattaacgcttacactacaggcccgtgcacgccctccccggcgccgaactatacgttcgcgctatggagggtgtctgcagaggagtatgtggaggtaaggcggctgggggacttccattacgtcacgggggtgaccactgataaactcaagtgtccatgccaggtcccctcacccgagttcttcacagaggtggacggggtgcgcctgcataggtacgcccccccctgcaaacccctgctgcgagaagaggtgacgtttagcatcgggctcaatgaatacttggtggggtcccagttgccctgcgagcccgagccagacgtagctgtactgacatcaatgcttacagacccctcccacatcactgcagagacggcagcgcgtaggctgaagcgggggtctcccccctccctggccagctcttccgccagccagctgtccgcgccgtcactgaaggcaacatgcaccactcaccacgactctccagacgctgacctcatagaagccaacctcctgtggagacaggagatgggggggaacatcactagggtggagtcggagaacaagattgtcgttctggattctttcgacccgctcgtagcggaggaggatgatcgggagatctctattccagctgagattctgcggaagttcaagcagtttcctcccgctatgcccatatgggcacggccagattataatcctccccttgtggaaccgtggaagcgcccggactatgagccacccttagtccacgggtgccccctaccacctcccaagccaactccggtgccgccaccccggagaaagaggacggtggtgctggacgagtctacagtatcatctgctctggctgagcttgccactaagaccttcggcagctctacaacctcaggcgtgacaagtggtgaagcgactgaatcgtccccggcgccctcctgcggcggtgagctggactccgaagctgaatcttactcctccatgccccctctcgagggggagccgggggaccccgatctcagcgacgggtcttggtctaccgtgagcagtgatggtggcacggaagacgttgtgtgctgctcgatgtcttactcgtggacgggcgctttaatcacgccctgtgcctcagaggaagccaagctccctatcaacgcattgagcaactcgctgctgcgccaccacaacttggtgtattccaccacctctcgcagcgctggccagagacagaaaaaagtcacatttgacagagtgcaagtcctggacgaccattaccgggacgtgctcaaggaggctaaggccaaggcatccacggtgaaggctagactgctatccgttgaggaagcgtgtagcctgacgcccccacactccgccagatcaaaatttggctatggggcgaaggatgtccgaagccattccagtaaggctatacgccacatcaactccgtgtggcaggaccttctggaggacaatacaacacccatagacactaccatcatggcaaagaatgaggtcttctgtgtgaagcccgaaaaggggggccgcaagcccgctcgtcttatcgtgtaccccgacctgggagtgcgcgtatgcgagaagagggctttgtatgacgtagtcaaacagctccccattgccgtgatgggagcctcctacgggttccagtactcaccagcgcagcgggtcgacttcctgcttaaagcgtggaaatctaagaaagtccccatggggttttcctatgacacccgttgctttgactcaacagtcactgaggctgatatccgtacggaggaagacctctaccaatcttgtgacctggcccctgaggctcgcatagccataaggtccctcacagagaggctttacatcgggggcccactcaccaattctaagggacaaaactgcggctatcggcgatgccgcgcaagcggcgtgctgaccactagctgcggtaacaccataacctgcttcctcaaagccagtgcagcctgtcgagctgcgaagctccaggactgcaccatgctcgtgtgcggcgacgacctcgtcgttatctgtgagagcgccggtgtccaggaggacgctgcgagcctgagagccttcacggaggctatgaccaggtactccgcccccccgggagacccgcctcaaccagaatacgacttggagcttataacatcctgctcctccaatgtgtcggtcgcgcgcgacggcgctggcaaaagggtctattatctgacccgtgaccctgagactcccctcgcgcgtgccgcttgggagacagcaagacacactccagtgaactcctggctaggcaacatcatcatgtttgcccccactctgtgggtacggatggtcctcatgacccattttttctccatactcatagctcaggagcaccttggaaaggctctagattgtgaaatctatggagccgtacactccgtccaaccgttggacttacctgaaatcatccaaagactccacagcctcagcgcgttttcgctccacagttactctccaggtgaaatcaatagggtggctgcatgcctcaggaagcttggggttccgcccttgcgagcttggagacaccgggcccggagcgttcgcgccacactcctatcccagggggggaaagccgctatatgcggtaagtacctcttcaactgggcggtgaaaaccaaactcaaactcactccattaccgtccatgtctcagttggacttgtccaactggttcacgggcggttacagcgggggagacatttatcacagcgtgtctcatgcccggccccgtttgttcctctggtgcctactcctactttcagtaggggtaggcatctatctccttcccaaccgatagacggntgggcaaccactccgggtctttaggccctatttaaacactccaggcctttaggccccgt

SEQ ID NO: 723 - DNA, 9406 bp, Hepatitis C Virus
cactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggataaacccactctatgtccggtcatttgggcgtgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacacaaaccgccgcccacaggacgtcaagttcccgggtggcggtcagatcgttggcggagtttacttgctgccgcgcaggggccccaggttgggtgtgcgcgcgacaaggaagacttccgagcgatcccagccgcgtgggagacgccagcccatcccgaaagatcggcgctccaccggcaagtcctggggaaagccaggatatccttggcccctgtacggaaacgagggttgcggctgggcaggttggctcctgtccccccgcgggtctcgtccccattggggccccactgacccccggcacagatcacgcaatttgggcaaagtcatcgataccattacgtgtggttttgccgacctcatggggtacatccctgtcattggcgctccggtcggaggcgtcgccagagctctggcacacggtgtcagggtcctggaagacggggtgaattacgcaacagggaatctacccggttgctctttttctatcttcttacttgctctcctgtcgtgcgtcacagtgccagtgtctgcagtggaagtcaggaacattagttctagttactatgccactaatgattgctcgaacaacagcatcacctggcagctcgaaaacgcagttctccaccttcctggatgcgtcccatgtgagaatgataatggcaccttgcgctgctggacacaagtaacacctaatgtggctgtgaaacaccgcggtgcactcactcagaacctgcgaacacacgtcgacgtgatcgtagtggcagctacggtctgctcggccttgtacgtgggagatgtgtgcggggccgtgatgatcgcgtcacaggctctcatagtatcgccagcacgccacaactttacccaagagtgcaactgttccatctaccaaggtcgtatcaccggccaccatatggcgtgggacatgatgctaaactggtcaccaactatcaccatgatcctcgcctacgctgctcgcattcctgagctagtcctcgaagttatcttcggtggccactggggtgtgatgtttggcctggcctatttttccatgcagggagcgtgggccaaggtcattgtcatcctccttcttgtcgcaggagtggatgcaagacaccataccaccggtttgcaagcgggtaaaaccttggcgagggtcactagcctctttagcattggtgccaagcagaacatccagttaatcaacaccaatggcagctggcacataaaccggaccgccctcaattgcaatgacagcttgcagacaggtttcatcgcttccctgttttacgtcaataatatcaacagctctggttgccccgagcgcatgtcttcctgccgcgagctggacgactttcgcatcgggtggggaaccttggagtatgagaccaatgtcaccaacgatgaggacatgaggccttactgctggcattaccctccgaagccttgcggtatcgtcccggccaggacggtttgcgggccggtctactgttttacccctagccctattgtcgtgggcaccactgacaagcagggcgtacccacctatagctggggggaaaatgagaccgatgtcttcctgctaaatagcacaagacccccgcgaggatcttggttcggctgcacttggatgaacggaactgggttcactaagacatgcggagcaccaccttgccgcattaggagagattacaacagcactctcgatctattgtgccctacagactgttttaggaagcacccagatactacctaccttaagtgcgggtcagggccttggttgacccctaaatgcctggtagaatacccttatagactgtggcactatccgtgcaccgtaaattttaccatcttcaaggtgcggatgtatgtaggggcggtggagcatcgattttccgcagcgtgtaacttcacgcgcggagaccgctgcagattggaagatagggataggggtcagcagagtccactgctgcattccaccactgagtgggcggtgttgccatgctccttctccgacctaccggcactatccactggtctattgcacctccaccaaaacatcgtggacgtgcagtacctctatggactcagcccggctattacaagatacatcgtgaagtgggaatgggtggtcctccttttcctgttgttggcagacgccagggtctgtgcatgcctctggatgctcattatattgggccaagccgaggcggcgcttgagaagctcatcatcttgcactccgctagcgctgctagtgccaatgggccgctgtggtttttcatcttctttgcagcggcctggtacttaaagggcagggtggtccccgtggccacgtattctgtcctcggcttgtggtccttcctcctcctagtcctagccctaccacagcaggcttatgccttggacgccactgaccaaggggagctcgggctggtcgtgctagtaatcatatccatctttactctcaccccagcatacaagattctcctgagccgttcattgtggtggctgtcctatatgctggtcttggccgaggcccagattcagcaatgggttccccccctggaggcccgaggggggcgtgacgggatcatctggctggctgtcattctgcacccacgccttgtgtttgagatcacgaagtggctgttagcaattctggggcctgcctacctccttaaaatgtctctgctacgggtgccatactttgtgagggctcatgctctgctacgggtgtgtaccctggtgagacacctcgcaggagctaggtacatccagatgttgctgatcaccataggcagatggactggcacttacatctatgaccacctctcccctttatcaacttgggcagcccagggtttgcgggacctagcagtcgccgtggagcctgtgatattcagtccaatggagaagaaggtcattgtgtggggggctgagacggtggcatgtggggacatcctgcacggcctcccggtttccgcgaggctaggtagggaagtcctgctcggccccgccgatagctacacctcgaaggggtggaagctcctagctcccattactgcttacacccagcagactcgtggtctcctgggtgccatcgtggtcagcctaacgggccgcgacaaaaatgagcaggccggggaggtccaggttctgtcctccgtcacacagtctttcttggggacgtctatttcgggggtcctctggacagtatatcacggggccggtaacaagaccttggctggtcccaagggaccagtcactcagatgtacaccagcgcggacggggacctcgtgggatggcctagtccccccgggactaagtcattagacccctgtacctgcggggccgtggacctctacctggtcacccgaaacgccgatgtcattccggtccggaggaaagatgaccgacggggcgcattactctcgccaaggcctctttcaaccctcaaaggatcatccggcggacccgtgctttgccctaggggacacgccgtgggcttgtttagagcggccgtgtgtgccagaggtgtggccaaatctattgacttcatccctgtcgagtctatcgacatcgccacgcggacgcccagtttttcagacaacagtacaccaccagccgtgccccaatcttaccaggtgggctacttgcatgcaccaacgggcagcgggaagagcaccaaagtccctgccgcatatgccagtcaggggtataaagtacttgtactaaatccctctgtcgcggccacgcttggttttggggcctacatgtccaaagcccacgggatcaaccccaacatcagaaccggagtacggactgtgaccaccggggactctatcacctactccacttatggcaagtttatcgcggacggaggctgctcagctggcgcctatgacgtcatcatatgcgatgagtgccactcagtggacgccactaccatccttggcattggaacagtcctcgaccaggctgagaccgcaggtgctaggctagtggttttagccacagctacgcctcctggtacggtgacaactccccatagtaacatagaagaggtggctcttggtcacgagggcgagatccctttttacggcaaggctattcccctagctttcatcaaggggggcagacacctgatcttctgccattcaaagaagaagtgcgatgagctcgcagcagcccttcggggcatgggtgtcaatgccgttgcctactacaggggtctcgacgtctccgttataccaactcaaggtgacgtggtggtcgtcgccaccgatgccctaatgactggatacaccggtgactttgactctgtcatcgactgcaatgttgcggtcactcagattgttgactttagcctagacccaacctttaccatcaccactcaaaccgtccctcaggacgctgtctcccgtagtcaacgtagagggagaactgggagagggcgactgggcatttacaggtatgtctcgtcaggcgagaggccgtctgggatgttcgacagcgtagtgctctgtgagtgctacgatgccggggcagcctggtacgaacttacgcctgctgagactacggtgagactccgggcttatttcaacacgcccggtttgcccgtgtgtcaagaccacctggagttctgggaagcggtcttcacaggtctcacacacattgatgcccatttcctctctcagacgaagcaaggaggagacaacttcgcgtacctaacggcctaccaggccacggtatgcgctagagcaaaggcccctcctccttcgtgggacgtgatgtggaagtgtctcactaggctcaaacctacactgactggtcctacccccctcctgtaccgcctgggcgctgtgaccaacgaggttaccctgacgcaccccgtgacgaaatatatcgccacgtgcatgcaggctgacctcgagatcatgacaagctcatgggtactggcagggggggtgctagccgccgtggcagcttactgcctggcgaccggctgcgtttccatcattggccgcatacacctgaatgatcgggcggttgtggcccctgacaaggaagtcttatatgaggcctttgatgagatggaagaatgcgcctccaaagccgccctcatcgaggaagggcagcggatggcggagatgcttaaatctaaaatacaaggcctcctacaacaggccacaagacaggcccaagacatacagccagccatacagtcatcatggcccaagcttgagcagttttgggccaaacacatgtggaacttcatcagtggcatacagtacctggcgggactctccacattaccgggaaatcccgcagtggcatcaatgatggctttcagcgccgcattgaccagtccactgcccaccagcaccaccatcctcttgaacatcatggggggatggttggcctcccagattgctccccccgccggagccactggcttcgttgttagtggtctagtgggggcggccgtcggaagcataggcctgggtaagatactggtggacgttttggccgggtacggtgcaggcatttcaggggccctcgtagctttcaaaatcatgagcggcgagaagccctcggtagaagatgttgtgaatctcctgcccgctatcctgtctcctggcgctttggtagtgggagtcatctgtgcagcaatcctgcgccgccacgtcggccagggagagggggcggtccagtggatgaacagactgatcgcctttgcctccagaggaaaccacgttgcccctacccactacgtgacggagtctgatgcatcgcagcgcgtgacgcaggtgctaagctcactcacaatcaccagcttgcttaggagactacatacctggatcactgaagattgtccagtcccatgttcggggtcttggctccaggacatttgggattgggtttgttccattctcacagactttaagaactggctgtcttcaaaattgctccctaagatgcccggccttcccttcatctcttgccaaaagggatacaggggtgtatgggctggcacgggagtcatgactactcggtgtccatgcggagcaaacatttcgggccatgtccgcatgggtaccatgaaaataacaggcccgaagacttgcttgaacttgtggcagggaaccttccccattaattgttacacagaagggccttgcgtgccaaaaccccctcctaattacaagaccgcgatttggagggtggcagcgtcggagtacgttgaggtcacgcaacacggctctttctcgtacgtaacagggctaaccagtgacaaccttaaggtcccttgccaggtaccagctccagaattcttctcttgggtggacggggtgcagatacaccgattcgcccccattccaggtcccttctttcgggatgaggtgacgttcaccgtaggcctcaattcctttgtggtcggctctcagctcccttgcgaccctgagccggacaccgaggtattggcctccatgttgacggacccgtcccacattaccgcggaggcggcagccaggcggttggccaggggatctcccccttcacaggccagctcttcagcgagccagctctccgccccgtccttgaaggccacctgtaccacccataaaatggcatatgattgtgacatggtggatgctaaccttttcatgggaggcgatgtgacccggatcgagtcggactctaaggtgatcgttctcgactccctcgattccatgactgaggtagaggatgatcgtgagccctctgtaccatcagagtacttgatcaggaggaggaagttcccaccggcactacctccttgggctcgcccagactacaaccctcccgtgattgagacgtggaagaggccgggctatgacccacccactgtcctaatctgtgcccttccccccacacctcaagcgccagtgcccccacctcggaggcgccgcgccaaagtcctgactcaggacaatgtggagggggtccttagggagatggcggacaaagtgctcagccctctccaagactacaatgactccggtcactccactggagcggataccggagcagacagcgtccagcagccctctgacgagactgccgcttcagaagcgggatcactgtcctccatgcctccccttgagggagagccgggggaccccgacctggagtttgaaccagcgagatccgcccccccttctgagggggagtgtgagatcattgattcggactctaagtcgtggtccacggtctcagatcaagaggattctgttatctgctgttccatgtcatactcctggacgggagcccttataacaccatgtggccccgaggaggagaagttgccgatcaaccctctgagcaattcgctcatgcgattccataacaaggtgtactccacaacctcgaggagtgcctctctgagggcaaagaaggtgacttttgacagggtgcaggtgctggacacacactatgactcagtcttgcaggacgttaagcgggccgcctccaaggtcagtgcaaggctcctctcagtagaggaagcctgcgcgttgaccccgccccactctgccaaatcacgatacggatttggggcaaaggaggtgcgcagcttatccaggagggccgttaaccacatccggtccgtgtgggaggacctcctggaagaccaacatactccaattgacacaactatcatggccaaaaatgaggtgttctgtgttgatcccactaagggcgggaaaaaaccagctcgcctcatcgtataccccgacctcggggtcagggtgtgcgaaaagatggccctctatgacattgcacaaaagctccccaaggcagtaatggggccatcttatgggttccaatactctccagcagaacgggtcgattttctccctaaagcttggggaagtaagaaggacccaatggggttctcatatgacacccgctgctttgactcaaccgtcacggagagggacataagaacagaagaatccatatatcaggcttgttctctgcctcaagaggccaaaactgtcatacactcgctcactgagagactctacgtaggagggcccatgacaaacagcaaagggcaatcctgcggttacaggcgttgccgcgcaagcggtgttttcactaccagcatggggaataccatgacatgctacatcaaggcccttgcagcgtgcaaagctgcagggatcatggaccccactatgctggtgtgtggagacgacctggtcgtcatctcagagagccagggcaacgaggaggacgagcggaacctgagagctttcacggaggctatgaccaggtattctgcccctcccggtgacattcccagaccggaatatgacttggagcttataacatcctgctcctcaaacgtatcggtagcgctggactctcggggtcgccgccggtacttcctaaccagagaccctaccactccaatcacccgagctgcttgggaaacagtaagacactcccctgtcaattcttggctgggtaacatcattcaatacgcccctacaatctgggtccggatggtcataatgacccatttcttctccatactattggcccaggatactctgaaccaaaatctcaattttgagatgtacggggcagtatattcggtcaatccattagacctaccggccataattgaaaggatacatgggcttgacgccttttcactgcacacatactctccccacgaactctcacgggtggcagcgactctcagaaaacttggagcgcctccccttagagcgtggaagagtcgggcgcgtgctgtgagggcctcgctcatcgcccaaggagggagagcggccatttgcggccgctacctcttcaactgggcggtgaagacaaagctcaaactcactccattgcccgaggcaagccgcctggatctatccgggtggtttaccgtgggcgccggcgggggcgacatttatcacagcgtgtcgcatgcccgaccccgcctattactcctttgcctactcctacttagcgtaggggtaggcatctttttactccccgctcggtag

SEQ ID NO: 724 - DNA, 9406 bp, Hepatitis C Virus
cactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggataaacccactctatgtccggtcatttgggcgtgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacacaaaccgccgcccacaggacgtcaagttcccgggtggcggtcagatcgttggcggagtttacttgctgccgcgcaggggccccaggttgggtgtgcgcgcgacaaggaagacttccgagcgatcccagccgcgtgggagacgccagcccatcccgaaagatcggcgctccaccggcaagtcctggggaaagccaggatatccttggcccctgtacggaaacgagggttgcggctgggcaggttggctcctgtccccccgcgggtctcgtccccattggggccccactgacccccggcacagatcacgcaattttggcaaggtcatcgataccattacgtgtggttttgccgacctcatggggtacatccctgtcattggcgctccggtcggaggcgtcgccagagctctggcacacggtgtcagggtcctggaagacggggtgaattatgcaacagggaatctacccggttgctctttttctatcttcttacttgctctcctgtcgtgcgtcacagtgccagtgtctgcagtggaagtcaggaacattagttctagttactacgccactaatgattgctcgaacaacagcatcacctggcagctcgaaaacgcagttctccaccttcctggatgcgtcccatgtgagaatgataatggcaccttgcgctgctggacacaagtaacacctaatgtggctgtgaaacaccgcggtgcactcactcagcacctgcgaacacacgtcgacgtgatcgtagtggcagctacggtctgctcggccttgtacgtgggagatgtgtgcggggccgtgatgatcgcatcacaggctctcatagtatcgccagaacgccacaactttacccaagagtgcaactgttccatctaccaaggtcgtatcaccggtcaccatatggcgtgggacatgatgctaaactggtcaccaactatcaccatgatcctcgcctacgctgctcgcattcctgagctagtcctggaagttatcttcggtggccactggggtgtgatgtttggcctggcctatttttccatgcagggagcgtggtccaaggtcattgtcatcctccttcttgtcgcaggagtggatgcaagacaccataccaccggtttgcaggtgggtaaaaccttggcgagggtcactagcctctttagcattggtcccaagcagaacatccagttaattaacaccaatggcagctggcacataaaccggaccgccctcaattgcaatgacagcttgcagacaggtttcatcgcttccctgttttacgtcaataatatcaacagctctggttgccccgagcgcatgtcttcctgccgcgagctggacgactttcgcatcgggtggggaaccttggagtatgagaccaatgtcaccaacgatgaagacatgaggccttactgctggcattaccctccgaagccttgcggtatcgtcccggccaggacggtttgcgggccggtctactgttttacccctagccctattgtcgtgggcaccactgacaagcagggcgtacccacctatagctggggggaaaatgagaccgatgtcttcctgctaaatagcacaagacccccgcgaggatcttggttcggctgcacttggatgaacggaactgggttcactaagacatgcggagcaccaccttgccgcattaggagagattacaacagcactctcgatctattgtgccctacagactgttttaggaagcacccagatactacctaccttaagtgcgggtcagggccttggttgacccctaaatgcctggtagaatacccttatagactgtggcactatccgtgcaccgtaaattttaccatcttcaaggtgcggatgtatgtagggggggtggagcatcgattttccgcagcgtgcaacttcacgcgcggagaccgctgcagattggaagatagggataggggtcagcagagtccactgctgcattccaccactgagtgggcggtgttgccatgctccttctccgacctaccggcactatccactggtctattgcacctccaccaaaacatcgtggacgtgcagtacctctatggactcagcccggctattacaagatacatcgtgaagtgggaatgggtggtcctccttttcctgttgttggcagacgccagggtctgtgcatgcctctggatgctcattatattgggccaagccgaggcggcgcttgagaagctcatcatcttgcactccgctagcgctgctagtgccaatgggccgctgtggtttttcatcttctttacagcggcctggtacttaaagggcagggtggtccccgtggccacgtattctgtcctcggcttgtggtccttcctcctcctagtcctagccctaccacagcaggcttatgccttggacgccactgaccaaggggagctcgggctggtcatgctagtaatcatatccatctttactctcaccccagcatacaagattctcctgagccgttcattgtggtggctgtcctatatgctggtcttggccgaggcccagattcagcaatgggttccccccctggaggcccggggggggcgtgacgggatcatctggctggctgtcattctgcacccacgccttgtgtttgagatcacgaagtggctgttagcaattctggggcctgcctacctccttaaaatgtctctgctacgggtgccatactttgtgagggctcatgctctgctacgggtgtgtaccctggtgagacacctcgcaggagctaggtatatccagatgttgctgatcaccataggcagatggactggcacttacatctatgaccacctctcccctttatcaacttgggcagcccagggtttgcgggacctagcagtcgccgtggagcctgtgatattcagtccaatggagaagaaggtcattgtgtggggggctgagacggtggcatgtggggacatcctgcacggcctcccggtttccgcgaggctaggtagggaagtcctgctcggccccgccgatagctacacctcgaaggggtggaagctcctagctcccattactgcttacacccagcagactcgtggtctcctgggtgccatcgtggtcagcctaacgggccgcgacaaaaatgagcaggccgggcaggtccaggttctgtcctccgtcacacagtctttcttggggacgtctatttcgggggtcctctggacagtatatcacggggccggtaacaagaccttggctggtcccaagggaccagtcactcagatgtacaccagcgcggacggggacctcgtgggatggcctagtccccccgggactaagtcattagacccctgtacctgcggggccgtggacctctacctggtcacccgaaacgccgatgtcattccggtccggaggaaagatgaccgacggggcgcattactctcgccaaggcctctttcaaccctcaaaggatcatccggcggacccgtgctttgccctaggggacacgccgtgggcttgtttagagcggccgtgtgtgccagaggtgtggccaaatctattgacttcatccctgtcgagtctatcgacatcgccacgcggacgcccagtttttcagacaacagtacaccaccagccgtgccccaatcttaccaggtgggctacttgcatgcaccaacgggcagcgggaaaagcaccaaagtccctgccgcatatgccagtcaggggtataaagtacttgtactaaatccctctgtcgcggccacgcttggttttggggcctacatgtccaaagcccacgggatcaaccccaacatcagaaccggagtacggactgtgaccaccggggactctatcacctactccacttatggcaagtttatcgcggacggaggctgctcagctggcgcctatgacgtcatcatatgcgatgagtgccactcagtggacgccactaccatccttggcattggaacagtcctcgaccaggctgagaccgcaggtgctaggctagtggttttagccacagctacgcctcctggtacggtgacaactccccatagtaacatagaagaggtggctcttggtcacgagggcgagatccctttttacggcaaggctattcccctagctttcatcaaggggggcagacacctgatcttctgccattcaaagaagaagtgcgatgagctcgcagcagcccttcggggcatgggtgtcaatgccgttgcctactacaggggtctcgacgtctccgttataccaactcaaggtgacgtggtggtcgtcgccaccgatgccctaatgactggatacaccggtgactttgactctgtcatcgactgcaatgttgcggtcactcagattgttgactttagcctagacccaacctttaccatcaccactcaaaccgtccctcaggacgctgtctcccgtagtcaacgtagagggagaactgggagagggcgactgggcatttacaggtatgtctcgtcaggcgagaggccgtctgggatgttcgacagcgtagtgctctgtgagtgctacgatgccggggcagcctggtacgaacttacgcctgctgagactacggtgagactccgggcttatttcaacacgcccggtttgcccgtgtgtcaagaccacctggagttctgggaagcggtcttcacaggtctcacacacattgatgcccatttcctctctcagacgaagcaaggaggagacaacttcgcgtacctaacggcctaccaggccacggtatgcgctagagcaaaggcccctcctccttcgtgggacgtgatgtggaagtgtctcactaggctcaaacctacactgactggtcctacccccctcctgtaccgcctgggcgctgtgaccaacgaggttaccctgacgcaccccgtgacgaaatatatcgccacgtgcatgcaggctgacctcgagatcatgacaagcacatgggtcctggcagggggggtgctagccgccgtggcagcttactgcctggcgaccggctgcgtttccatcattggccgcatacacctgaatgatcgggcggttgtggcccctgacaaggaagtcttatatgaggcctttgatgagatggaagaatgcgcctccaaagccgccctcatcgaggaagggcagcggatggcggagatgctcaaatctaaaatacaaggcctcctacaacaggccacgagacaggcccaagacatacagccagccatacagtcatcatggcccaagcttgagcagttttgggccaaacacatgtggaacttcatcagtggcatacagtacctggcgggactctccacattaccgggaaatcccgcagtggcatcaatgatggctttcagcgccgcattgactagtccactgcccaccagcaccaccatcctcttgaacatcatggggggatggttggcctcccagattgctccccccgccggagccactggcttcgttgttagtggtctagtgggggcggccgtcggaagcataggcctgggtaagatactggtggacgttttggccgggtacggtgcaggcatttcaggggccctcgtagctttcaaaatcatgagcggcgagaagccctcggtagaagatgttgtgaatctcctgcccgctatcctgtctcctggcgctttggtagtgggagtcatctgcgcagcaatcctgcgccgccacgtcggccagggagagggggcggtccagtggatgaacagactgatcgcctttgcctccagaggaaaccacgttgcccctacccactacgtgacggagtctgatgcatcgcagcgcgtgacgcaggtgctaagctcactcacaatcaccagcttgcttaggagactacatacctggatcactgaagattgtccagtcccatgttcggggtcttggctccaggacatttgggattgggtttgttccattctcacagactttaagaactggctgtcttcaaaattgctccctaagatgcccggccttcccttcatctcttgccaaaagggatacaggggtgtatgggctggcacgggagtcatgaccactcggtgtccatgcggagcaaacatttcgggccatgtccgcatgggtaccatgaaaataacaggcccgaagacttgcttgaacttgtggcagggaaccttccccataaattgttacacagaagggccttgcgtgccaaaacctcctcctaattacaagaccgcgatttggagggtagcagcgtcggagtacgttgaggtcacgcaacacggctctttctcgtacgtaacagggctaaccagtgacaaccttaaggtcccttgccaggtaccagctccagaattcttctcttgggtggacggggtgcagatacaccgattcgcccccattccaggtcccttctttcgggatgaggtgacgttcaccgtaggcctcaattcctttgtggtcggctctcagctcccttgcgaccctgagccggacaccgaggtattggcctccatgttgacggacccgtcccacattaccgcggaggcggcagccaggcggttggccaggggatctcccccttcacaggccagctcttcagcgagccagctctccgccccgtccttgaaggccacctgtaccacccataaaatggcatatgattgtgacatggtggatgccaaccttttcatgggaggcgatgtgacccggatcgagtcggactctaaggtgatcgttctcgactccctcgattccatgactgaggtagaggatgatcgtgagccctctgtaccatcagagtacttgatcaggaggaggaagttcccaccggcactacctccttgggctcgcccagactacaaccctcccgtgattgagacgtggaagaggccgggctatgaaccacctactgtcctaggctgtgcccttccccccacacctcaagcgccagtgcccccacctcggaggcgccgcgccaaagtcctgactcaggacaatgtggagggggtccttagggagatggcggacaaagtgctcagccctctccaagactacaatgactccggtcactccactggagcggataccggagcagacagcgtccagcagccctctgacgagactgccgcttcagaagcgggatcactgtcctccatgcctccccttgagggagagccgggggaccccgacctggagtttgaaccagcgagatccgcccccccttctgagggggagtgtgagatcattgattcggattctaagtcgtggtccacggtctcagatcaagaggattctgttatctgctgttccatgtcatactcctggacgggagcccttataacaccatgtggccccgaggaggagaagttgccgatcaaccctctgagcaattcgctcatgcgattccataacaaggtgtactccacaacctcgaggagtgcctctctgagggcaaagaaggtgacttttgacagggtgcaggtgctggacacacactatgactcagtcttgcaggacgttaagcgagccgcctccaaggtcagtgcaaggctcctctccgtagaggaagcctgcgcgttgaccccgccccactctgccaaatcacgatacggatttggggcaaaggaggtgcgcagcttatccaggagggccgttaaccacatccggtccgtgtgggaggacctcctggaagaccaacatactccaattgacacaactatcatggccaaaaatgaggtgttctgtgttgatcccactaagggcgggaaaaaaccagctcgcctcatcgtataccccgacctcggggtcagggtgtgcgaaaagatggccctctatgacattgcacaaaagctccccaaggcagtaatggggccatcttatgggttccaatactctccagcagaacgggtcgattttctcctcaaagcttggggaagtaagaaggacccaatggggttctcatatgacacccgctgctttgactcaaccgtcacggagagggacataagaacagaagaatccatatatcaggcttgttctctgcctcaagaggccaaaactgtcatacactcgctcactgagagactctacgtaggagggcccatgacaaacagcaaagggcaatcctgcggttacaggcgttgccgcgcaagcggtgttttcactaccagcatggggaataccatgacatgctacatcaaggccctcgcagcgtgcaaagctgcagggatcatggaccccactatgctggtgtgtggagacgacctggtcgtcatctcagagagccagggcaacgaggaggacgagcggaacctgagagctttcacggaggctatgaccaggtattctgcccctcccggtgacattcccagaccggaatatgacttggagcttataacatcctgctcctcaaacgtatcggtagcgctggactctcggggtcgccgccggtacttcctaaccagagaccctaccactccaatcacccgagccgcttgggaaacagtaagacactcccctgtcaattcttggctgggtaacatcattcaatacgcccctacaatctgggtccggatggtcataatgacccatttcttctccatactattggcccaggatactctgaaccaaaatctcaattttgagatgtacggggcagtatattcggtcaatccattagacctaccggccataattgaaaggatacatgggcttgacgccttttcactgcacacatactctccccacgaactctcacgggtggcagcgactctcagaaaacttggagcgcctccccttagagcgtggaagagtcgggcgcgtgctgtgagggcctcgctcatcgcccaaggagggagagcggccatttgcggccgctacctcttcaactgggcggtgaagacaaagctcaaactcactccattgcccgaggcaagccgcctggatctatccgggtggtttaccgtgggcgccggcgggggcgacatttatcacagcgtgtcgcatgcccgaccccgcctattactcctttgcctactcctacttagcgtaggggtaggcatctttttactccccgctcggtag

SEQ ID NO: 725 - DNA, 9406 bp, Hepatitis C Virus
cactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggataaacccactctatgtccggtcatttgggcgtgcccccgcaagactgctagcctagtagcgttgggttgcgaacggccttgtggtactgcctgatagggtgcttgcgagtgccccgggaggtctcgtagaccgtgcatcatgagcacaaatcctaaacctcaaagaaaaaccaaaagaaacacaaaccgccgcccacaggacgtcaagttcccgggtggtggtcagatcgttggcggagtttacttgctgccgcgcaggggccccaggttgggtgtgcgcgcgacaaggaagacttctgagcgatcccagccgcgtggacgacgccagcccatcccgaaagatcggcgctccaccggcaagtcctggggaaagccaggatatccttggcccctgtacggaaacgagggttgcggctgggcgggttggctcctgtccccccgcgggtctcgtcctacttggggccccactgacccccggcatagatcacgcaatttgggcagagtcatcgacaccattacgtgtggatttgccgacctcatggggtacatccctgtagttggcgccccagtcggaggcgtcgccagagctctggcacacggtgttagggtcctggaagacgggataaattatgcaacagggaatcttcctggttgctctttttctatcttcttgcttgctcttctgtcgtgcgttacagtgccagtgtctgcagtggaaatcaggaacatcagtactagttactatgccactaacgattgctcgaacaacagcatcacctggcagctcactaacgcagtccttcaccttcccggatgcgtcccgtgtgagaacgataacggcaccttgcgctgctggatacaagtaacacctaatgtggctgtgaaacaccgtggcgcactcactcacaatctgcgaacacatgtcgacgtgatcgtaatggcagctacggtctgctcggccttgtatgtgggagacgtgtgcggggccgtgatgatcgtgtcgcaggctttcataatatcgccacaacaccacaacttcacccaggagtgcaactgttccatctaccaaggtcatatcaccggccaccgcatggcatgggacatgatgctaaactggtcaccaactcttaccatgatccttgcctatgctgctcgtatccccgagctagtccttgaagttgtcttcggcggccattggggtgtggcgtttggcttggcctatttctccatgcagggagcgtgggccaaagtcatcgccatcctcctccttgtcgcaggagtggacgcaaccacctatgctaccggcgcggtaacgggtaacaccattcagaggttcaccggcttgtttagccctggtgcccgtcagaagattagcttaatcaacacaaatggcagctggcacataaaccggaccgccctcaactgcaatgacagcttgcatacgggcttcatcgcttccctgttttacgtccgcaatttcaacagctctggctgcccagagcgtttgtcttcctgccgtgggttggatgacttccgcattgggtggggagccttggaatacgagactaatgtcaccaacgatgaggacatgaggccgtactgctggcactaccctccgaagccttgcggcattgtctcggctaggacggtttgcgggccggtctactgtttcactcctagccctgtcgtcgtgggtaccactgataggcagggtgtgcccacctatagctggggggaaaatgagaccgatgtcttcctgctaaatagcacgagacccccgcagggagcttggttcggctgcacttggatgaacgggactgggttcactaagacatgcggtgcgccaccttgccgcattagaagggactacaacagcactcttgatctattgtgccccacagactgttttaggaagcacccagaaaccacctatcttaagtgcggagcaggaccttggttgacccccaaatgcctggttgattatccttatagattgtggcattatccgtgcactgtgaacttcaccatcttcaaggtgcggatgtatataggaggggtggagcatcgattgaacgcagcgtgcaactacacgcgcggggatcgctgcagattggaagatagggataggggccagcagagcccactactgcattccaccactgaatgggcggtgatgccatgctctttctctgacctaccggcactatctactggtctattgcacctccaccaaaacatcgtggacgtgcagtacctctatgggctttctccagctatcacaaggtacatcgtgaagtgggagtgggtggtcctccttttcctgttgttggcagacgccagggtctgcgcatgcctttggatgctcatcatactgggccaggccgaggcagcgcttgagaagctcatcgtcttgcactccgctagcgctgctagtgccaatgggccgctgtggttcttcatcttctttatagcggcctggcacttaaagggcagggtggtccctgtggctacgtactctgttctcggcttgtggtcctttctcctcctggtcttggccttaccacagcaggcttatgccctggatgcagctgaccaagggcagctagggctggtcatattagtaatcatatccatcttcactcttactccagcatacaagactctcctgagccgtgcattgtggtggctgtcctacatgctagtcttggccgaggctcagattcagcaatgggttccccccctggaggtccgaggggggcgtgacgggatcatctgggtggctgtcattctacacccacgccttgtgtttgaggtcacgaaatggctgttggcagtcctggggcctgcctacctcctcaaagtttccctgttacgggtaccatactttgtgagggcccacgccctgctacgaatatgtaccctagtgagacatcttgcaggggctaagtacatccagatgctgctgatcaccgtaggcaggtggactggcacttacatctatgaccacctttcccctttgtcaacttgggcagcccatggcctgcgagacctggcagtcgccgtggagcctgtggtattcagcccaatggagaagaaggtcattgtgtggggagctgagacggtggcatgtggggatatcctgcatggcctcccggtttccgcgaggctaggtagggaagttttgcttggccccgccgacgactacacctcgaagggttggaggcttctagctcccatcactgcttatactcagcagactcgtggcctcctgggtgccattgtggtcagcctaacgggccgcgacaaaaatgagcaggctgggcaggtccaggttctgtcctccgtcacacaatctttcttggggacatctatttcgggtgtcctttggacagtatatcatggggctggtaataagaccttagctggccccaaaggaccagtcactcagatgtactctagcgcggagggggaccttgtgggatggcctagcccccccgggactaagtctttagacccctgtacctgcggggccgtggacctctacctggttacccgaaacgctgatgtcattccggtccggaggaaggacgaccggcgaggtgcactactctcgccaaggcctctctcaaccctcaaaggatcatccggcggacccgtgctctgccctaggggacatgccgtgggcctgttcagagcggccgtgtgcaccaggggtgtggccaaatccattgacttcatccctgtcgaatctctcaatatcgccgcacggtcgcccagtttctctgacaacagcacaccaccagctgtgcctcagtcttaccaggtgggctacctgcatgcaccaacaggcagtgggaagagtaccaaggtccctgccgcgtacgccagtcagggatataaggtacttgtactaaatccctctgtcgcggccacacttggctttggggcctacatgtccaaagcccacgggattaaccccaacatcacaaccggagtacgaactgtgaccaccggggaccccatcacctactctacttatggcaagtttctcgcggatggaggctgctctgctggcgcctatgacatcatcatatgcgacgaatgccattcagtggacgctactaccatcctcggcattggaacagttctcgaccaggctgagaccgcaggtgccaggttagtggtcttggccacagccacgcctcccggttcagtgacaactccccatagcaacatagaggaggtggcccttggtcatgagggcgagatccccttctacggcaaggctatccctctagctttcatcagggggggcagacacctgatcttttgccattcaaagaagaagtgcgacgagctcgcagcagcccttcggggcatgggcgtcaatgccgttgcctactacaggggtctcgacgtttccgtcataccaactcaaggagacgtggtggttgtcgccaccgatgccctaatgactggatacaccggtgattttgactctgtcattgactgcaacgttgcagtcactcagattgttgactttagcctagacccaacctttaccattaccacccaaactgtccctcaggacgctgtctcccgtagtcaacgtagaggcagaactggaagagggcgactgggcatttacaggtatgtctcgtcaggtgaaaggccgtctgggatgttcgacagcgtagtgctctgcgagtgctatgatgccggggcagcctggtacgaactcacgcctgctgagaccacagtgagacttcgggcctacttcaacacgcccggtctgcccgtgtgtcaagaccacctagaattttgggaggcggtcttcacgggcctcacacatatcgatgcccatttcctctctcagacgaagcaaggaggagacaactttgcgtatctagtggcctaccaggccacagtatgcgctagggcaaaggctcctcctccttcgtgggacgtgatgtggaagtgtctaactaggctcaaacctacactgactggtcctacccccctcctgtaccgtttgggtgctgtgaccaatgagatcaccctgacgcaccctgtgacgaaatacatcgccacgtgcatgcaagctgaccttgaggtcatgacaagcacatgggttctggcagggggggtgctagccgccgtggcagcttactgcctggcgaccggctgtatttccatcatcggccgtttacacctgaatgatcaggtagttatgacccctgacaaggaaatcttatatgaggcctttgatgagatggaagagtgctcctccaaagccgccctcatcgaggaggggcagcggatggcggagatgctcaagtccaagatacaaggccttttacaacaggccacaaaacaggcccaagacatacagccagccatacagtcatcatggcccaagctagaacaattttgggccaaacacatgtggaacttcatcagtggcatacagtacctggcggggctctccaccctgccggggaatcccgcagtggcatcaatgatggctttcagcgccgcgttgaccagcccgctacccaccagcaccaccatcctcttgaacatcatgggggggtggttggcctcccagattgcccccccagccggagccactggcttcgttgtcagcggtctagtaggggcagctgtcggaagtataggcctgggtaagatcctggtggacgttttggccgggtatggcgcaggcatttcgggagccctcgtagcttttaagatcatgagcggcgagaagccctcggtagaagatgttgtgaatctcctgcctgctatcctgtctcctggcgctttggtagtgggagtcatctgtgcagcaatcctgcgccgccacgtcggccagggggagggggcggtccagtggatgaacagactgatcgcctttgcctccagaggaaaccatgttgcccccactcattacgtggcagagtctgatgcctcacagcgtgtaatgcaggtgttgagttcacttacaattaccagcttgctcaggagactacatgcctggatcactgaagattgcccagtcccatgctcggggtcttggctccgggacatttgggattgggtgagttccatcctcacagactttaagaactggctgtcttcaaaactgctccccaaactgcccggccttccctttatctcttgtcaaaaggggtacaggggtgtatgggctggcacgggagtcatgactactcggtgtccatgcggagcaaacatttcgggccatgtccgcctgggtaccatgaaaataacgggcccaaagacttgcttgaacatgtggcaggggactttccccattaattgttacacagaagggccttgcacaccaaaaccccctcccaactataagaccgcaatttggagggtggcagcgtctgagtacgttgagatcacgcagcatggctctttctcgtatgtgacggggctaaccagtgacaaccttaaggtcccttgccaggtaccagctccagaattcttctcttgggtggatggggtgcagatacaccgattcgcccccattccaggtcctttctttcgggatgaggtgacattcaccgtgggcctcaattcctttgtggtcggctctcagctcccttgcgaccctgagccggacaccgaggtactggcctccatgttgacagacccatcccacatcacagcggaggcggcagctaggcgattggccaggggatctcccccctcacaggccagctcttcagcgagccagctctccgccccgtccttgaaggctacctgcaccactcacaagatggcatatgattgtgacatggtggatgctaacctcttcatgggaggcgatgtgactcggattgagtccaactctaaggtggttgtccttgattccctcgactccatgactgaggtagaggatgaccgcgagccttccgtaccatcagagtacttgatcaggaggaaaaagttcccatcggcactacctccctgggctcgcccagattacaaccctcctacgatcgagatatggaagaggccaggctatgaaccacccactgtcctaggatgtgccctcccccccacacctcaagtgccagtgcccccccctcggaggcgccgcaccaaagtcctgactcaggacaatgtggagggagtactcaaggggatggcggacaaagtgttcagccctccccaagattgcaatgactccggtcactccactggagtggataccggggcagacagcgtccagcagccctctgacgagactgccgcttcagaagcgggatcactgtcctccatgcctccccttgagggagagccaggagaccctgacctggagttcgaaccagctgggtccattcccccttccgagggggagtgtgaggtcgttgattcggattctaagtcgtggtccacagtctctgatcaagaggattctgtcatctgctgctctatgtcatactcctggacgggggccctcataacaccatgtgggcccgaggaggagaagttgccaatcaaccctctgagtaattcgctcatgcggtttcataacaaggtgtactccacaacatcgaggagcgcctctcagagagcaaagaaggtgaccttcgacagagtgcaggtgctggacgcacactatgactcagtcttgcaggacgttaagcgggccgcctctacggttagtgcgaggctcctctcagtagaggaagcctgtgcgctgaccccgccccactccgccaaatcacggtacggatttggggcaaaagaggtgcgcagcttatccaggagggccgttaaccatatccggtccgtatgggaggacctcctggaagaccaacatactccaattgacacaactatcatggccaaaaatgaggtgttctgtattgatcccgctaaaggcgggaaaaagccagctcgcctcatcgtatacccggaccttggggtcagggtgtgcgagaagatggccctttatgacattgcacagaagcttcccaaggcagtaatggggccgtcatataggttgcaaaactctcctgcagcacgggtcgatttcctcctcaaagcttcaggaagtaagaaggacccaaccgggttctcgtatgacacccgctgctctgactcaaccgtcacggagagggacataagaacagaagaatccatatatcaggcttgttccctgcctcaagaggccagaactgtcatacactcgctcactgagagactttacgtaggagggcccatgacaaacagcaaagggcaatcctgcggttacaggcgttgccgcgcaagcggtgttttcactaccagcatggggaataccatgacgtgctacatcaaagcccttgccgcttgcaaagctgcagggatcgtggaccccgttatgctggtatgtggagacgacctggttgtcatctcagagagccaaggaaacgaggaggatgagcggaacctgagagctttcacggaggctatgaccaggtattcggcccctcccggtgaccttcccagaccggaatatgacttggagcttataacatcctgctcctcaaacgtatcggtagcgctggaccctcggggtcgccgccggtactacctaaccagagaccctaccactccaatctcccgagctgcttgggaaacagtaagacactcccctgtcaattcttggctgggcaacatcatccaatacgcccctacaatctgggtccggatggtcataatgacccacttcttctccatacttttggcccaggacactctgaaccaaaatctcaattttgagatgtacggggcagtgtattcggtcaatccattagacctaccggccataattgaaaggctacacgggcttgacgctttctcactgcacacatactctccccacgaactctcacgggtggcagcgactctcagaaaacttggagcacctcccctcagagcgtggaagagtcgggcgcgtgctgtgagagcatcactcatcgcccaaggagggaaggcagccatttgtggccgctacctcttcaactgggcggtgaagacaaagctcaaactcactccattgcccgaggcgggccgcctggatttatccgggtggttcactgtgggcgccggcgggggcgacatctttcacagcgtgtcgcatgcccgaccccgcctattactcctttgcctactcctactcagtgtaggagtaggcatctttttactccccgctcggtag

SEQ ID NO: 726 - DNA, 9406 bp, Hepatitis C Virus
cactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggataaacccactctatgtccggtcatttgggcgtgcccccgcaagactgctagcctagtagcgttgggttgcgaacggccttgtggtactgcctgatagggtgcttgcgagtgccccgggaggtctcgtagaccgtgcatcatgagcacaaatcctaaacctcaaagaaaaaccaaaagaaacacaaaccgccgcccacaggacgtcaagttcccgggtggtggtcagatcgttggcggagtttacttgctgccgcgcaggggccccaggttgggtgtgcgcgcgacaaggaagacttctgagcgatcccagccgcgtggacgacgccagcccatcccgaaagatcggcgctccaccggcaagtcctggggaaagccaggatatccttggcccctgtacggaaacgagggttgcggctgggcgggttggctcctgtccccccgcgggtctcgtcctacttggggccccactgacccccggcatagatcacgcaatttgggcagagtcatcgacaccattacgtgtggatttgccgacctcatggggtacatccctgtagttggcgccccagtcggaggcgtcgccagagctctggcacacggtgttagggtcctggaagacgggataaattatgcaacagggaatcttcctggttgctctttttctatcttcttgcttgctcttctgtcgtgcgttacagtgccagtgtctgcagtggaaatcaggaacatcagtactagttactatgccactaacgattgctccaacaacagcatcacctggcagctcactaacgcagtcctccaccttcccggatgcgtcccgtgtgagaacgataacggcaccttgcgctgctggatacaagtaacacctaatgtggctgtgaaacaccgtggcgcactcactcacaacctgcgaacacatgtcgacgtgatcgtaatggcagctacggtctgctcggccttgtatgtgggagacgtgtgcggggccgtgatgatcgtgtcgcaggctttcataatatcgccgcaacaccacaacttcacccaggagtgcaattgttccatctaccaaggtcatatcaccggccaccgcatggcatgggacatgatgctaaactggtcaccaactcttaccatgatccttgcctatgctgctcgtatccctgagctagtccttgaagttgtcttcggcggccattggggtgtggcgtttggcttggcctatttctccatgcagggagcgtgggccaaagtcatcgccatcctcctccttgtcgcaggagtggatgcaaccacctatgctatcggcgcggtaacgggtaacaccattcagaggttcaccggcttgtttagccctggtgccagtcagaagattagcttaatcaacacaaatggcagctggcacataaaccggaccgccctcaattgcaatgacagcttgcatacgggcttcctcgcttccctgttttacgtccgcaatttcaacagctctggctgcccagagcgtatgtcttcctgccgtgggttggatgacttccgcattgggtggggagccttggaatacgagactaatgtcaccaacgatgaggacatgaggccgtactgctggcactaccctccgaagccttgcggcattgtctcggctaggacggtttgcgggccggtctactgtttcactcctagccctgtcgtcgtgggtaccactgataggcagggtgtgcccacctatagctggggggaaaatgagaccgatgtcttcctgctaaatagcaccagacccccgcagggagcttggttcggctgcacttggatgaacgggactgggttcactaagacatgcggtgcgccaccttgccgcattaggagggactacaacagcactcttgatctattgtgccccacagactgttttaggaaacacccagaaaccacttatcttaagtgcggagcaggaccttggttgacccccaaatgcctggttgattatccttatagattgtggcattatccgtgcactgtgaactttaccatcttcaaggtgcggatgtatataggaggggtggagcatcgattgaacgcagcgtgcaactacacgcgcggggatcgctgcagattggaggatagggataggggccagcagagcccactactgcattccaccactgaatgggcggtgatgccatgctctttctctgacctaccggcactatctactggtctattgcacctccaccaaaacatcgtggacgtgcagtacctctatgggctttctccagctatcacaaggtacatcgtgaagtgggagtgggtggtcctccttttcctgttgttggcagacgccagggtctgcgcatgcctttggatgctcatcatactgggccaggccgaggcagcgcttgagaagctcatcgtcttgcactctgctagcgctgctagtgccaatgggccgctgtggttcttcatcttctttatagcggcctggcacttaaagggcagggtggtccctgtggccacgtactctgttctcggcttgtggtcctttctcctcctggtcttggccttaccacagcaggcttatgccctggatgccgctgaccaagggcagctagggctggtcatattagtaatcatatccatctttactcttactccagcatacaagactctcctgagccgtgcattgtggtggctgtcctacatgctagtcttggccgaggctcagattcagcaatgggttccccccctggaggtccgaggggggcgtgacgggatcatctgggtggctgtcattctacacccacgccttgtgtttgaggtcacgaaatggctgttggcagtcctggggcctgcctaccttctcaaagtttccctgctacgggtaccatactttgtgagggcccacgccctgctacgagtgtgtaccctggtgagacatcttgcaggagctaagtacatccagctgctgttgatcaccgtaggtaggtggactggcacttacatctatgaccacctctcccctttgtcaacctgggcagcccatggcctgcgagacctggcagtcgccgtggagcctgtggtgttcagcccaatggagaagaaggtcattgtgtggggggctgagacagtggcatgtggggatatcctgcatggcctcccggtttccgcgaggctaggtagggaagttctgcttggccccgccgatgactacacctcaaagggttggaggcttctagctcccatcactgcttatactcagcagactcgtggcctcctgggtgccatcgtggtcagcctaacgggccgcgacaaaaacgagcaggctgggcaagtccaggttttgtcctccgtcacacaatctttcttggggacatctatttcgggtgtcctttggacagtataccatggggctggcaataagaccttagccggccccaaaggaccagtcactcagatgtactctagcgcggagggggaccttgtgggatggcctagcccccccgggactaagtctttagacccctgtacctgcggggccgtggacctctacctggttacccgaaacgctgatgtcattccggtccggaggaaggacgatcggcgaggtgcactactctcgccaaggcctctctcaaccctcaaaggatcatccggcggacccgtgctctgccctaggggacatgccgtgggcctgttcagagcggccgtgtgcaccaggggtgtggccaaatccattgacttcatccctgtcgaatctctcaatatcgccgcacggtcgcccagtttctctgacaacagcacaccaccagctgtgcctcagtcttaccaggtgggctacctgcatgcaccaacaggcagtgggaagagtaccaaggtccctgccgcgtacgccagtcagggatataaggtacttgtactaaatccctctgtcgcggccacacttggctttggggcctacatgtccaaagcccacggggttaaccccaacatcagaaccggagtacgaactgtgaccactggggaccccatcacctactccacttatggcaagtttctcgcggatggaggctgctccgctggcgcctatgacatcatcatatgcgacgaatgccattcagtggacgctactaccatccttggcattggaacagttctcgaccaggctgagaccgcaggtgccaggctagtagtcttggccacagccacgcctcccggttcagtgacaactccccatagcaacatagaggaggtggcccttggtcatgagggcgagatccccttctacggcaaggctattcctctagctttcatcaaggggggcagacacctgatcttttgccattcaaagaagaagtgcgacgagctcgcagcagcccttcggggcatgggtgtcaatgccgttgcctactacaggggtcttgacgtttccgtcataccaactcaaggagacgtggtggttgtcgccaccgatgccctaatgactggatacaccggtgattttgactctgtcattgactgcaacgttgcagtcactcagattgttgactttagcctagacccaacctttaccattaccacccaaactgtccctcaggatgctgtctcccgtagtcaacgtagaggcagaaccgggagagggcgactgggcacttacaggtatgtctcgtcaggtgaaaggccgtctgggatgttcgacagcgtagtgctctgcgagtgctatgatgccggggcagcctggtacgaactcacgcctgctgagaccacggtgagacttcgggcctacttcaatacacccggtctgcccgtgcatcaagaccacctagaattttgggaggcggtcttcacgggcctcacacatatcgatgcccatttcctctctcagacgaagcaaggaggagacaactttgcgtatctagtggcctaccaggccacagtatgcgctagggcaaaggctcctcctccttcgtgggacgtgatgtggaagtgtctaactaggctcaaacctacactgactggtcctacccccctcctgtaccgtttgggtgctgtgaccaatgagatcaccctgacgcaccccgtgacgaaatacatcgccacgtgcatgcaagctgaccttgaggtcatgacaagcacatgggttctggcagggggggtgctagccgccgtggcagcttactgcctggcgaccggctgtatttccatcatcggccgtttacacctgaatgatcaggtagttgtgacccctgacaaggaaatcttatatgaggcctttgatgagatggaagagtgctcctccaaagccgccctcatcgaggaggggcagcggatggcggagatgctcaagtctaagatacaaggccttctacaacaggccacaagacaggcccaagacatacagccagccatacagtcatcatggcccaagctagaacaattttgggccaaacacatgtggaacttcatcagtggcatacagtacctggcgggactctccaccctaccggggaatcctgcagtggcgtcaatgatggctttcagcgccgcattgaccagcccactacccaccagtactaccatcctcttgaacatcatgggggggtggttggcctcccagattgccccccctgccggagccactggctttgttgtcagtggcctagtaggggcagcggtcggaagtataggcctgggtaaaatactggtggacgttttggccgggtatggcgcaggcatttcgggagccctcgtagcttttaagatcatgagcggcgagaagccctcggtagaagatgttgtgaatctcttgcctgccatcctgtctcctggcgctttggtagtgggagtcatctgtgcagcaatcctgcgccgccacgtcggccagggagagggggcggtccagtggatgaacagactgatcgcctttgcctccagaggaaaccatgttgcccccactcattatgtagcagagtccgacgcctcgcagcgtgtgatgcaggtgttgagttcacttacaattaccagcttgctcaggagactacatgcctggatcactgaagattgcccagtcccatgctcggggtcttggctccgggacatttgggattgggtgagttccatcctcacagactttaagaactggctgtcttcaaaactgctccccaaactgcccggccttccctttatctcttgtcaaaaggggtacaggggtgtatgggctggcacgggagtcatgactactcggtgtccatgcggagcaaacatttcgggccatgtccgcctgggtaccatgaaaataacgggcccaaagacctgcttgaacatgtggcaggggactttccccattaattgttacacagaagggccttgcacaccaaaaccccctcccaactataagaccgcaatttggagggtggcagcgtctgagtacgttgagatcacgcagcatggctctttctcgtatgtgacggggttaaccagtgacaaccttaaggtcccttgccaggtaccagctccagaattcttctcttgggtggatggggtgcagatacaccgattcgcccccattccaggtcctttctttcgggatgaggtgacattcaccgtgggcctcaattcctttgtggttggctctcagctcccttgcgatcctgagccggacaccgaggtattggcctccatgttgacagacccatcccacatcacagcggaggcagcagctaggcgattggccaggggatctcccccctcacaggccagctcttcagcgagccagctctccgccccgtccttgaaggctacctgcaccactcacaagatggcatatgattgtgacatggtggatgctaacctcttcatgggaggcgatgtgactcggattgagtccaactctaaggtggttgtccttgattccctcgactccatgactgaggtagaggatgatcgcgagccttccgtaccatcagagtacttgatcaggaggaaaaagttcccaccggcactacctccctgggctcgcccagattacaaccctcctacgatggagatatggaacaggtcgggctatgaaccacccactgtcctaggctgtgccctcccccccacacctcaagtgccagtgcccccccctcggaggcgccgcaccaaagtcctaactcaggacaatgtggagggagtactcaaggggatggcggacaaagtgttcagccctccccaagattgcaatgactccggtcactccactggagtggataccggggcagacagcgtccagcagccctctgacgagactgccgcttcggaagcgggatcactgtcctccatgcctccccttgagggagagccaggagaccctgacctggagttcgaaccagctgggtccattcccccttccgagggggagtgtgaggtcgttgattcggattctaagtcgtggtccacagtctctgatcaagaggattctgtcatctgctgctctatgtcatactcctggacgggggccctcataacaccatgtgggcccgaggaggagaagttgccaatcaaccctctgagtaattcgctcatgcggtttcataacaaggtgtactccacaacatcgaggagcgcctctcagagagcgaagaaggtgaccttcgacagagtgcaggtgctggactcacactatgactcagtcttgcaggacgttaagcgggccgcctctacggttagtgcgaggctcctctcagtagaggaagcctgcgcgctgaccccgccccactccgccaaatcacggtacggatttggggcaaaagaggtgcgcagcttatccaggagggccgttaaccacatccggtccgtgtgggaggacctcctggaagaccaacatactccaattgacacaactatcatggccaaaaatgaggtgttctgtattgatcccgctaaaggcgggaaaaaggcagctcgcctcatcgtatacccggaccttggggtcagggtgtgcgagaagatggccctttatgacattgcacagaagcttcccaaggcagtaatggggccgtcatatgggttccaatactctcctgcagaacgggtcgatttcctcctcaaagcttggggaagtaagaaggacccaatggggttctcgtatgacacccgctgctttgactcaaccgtcacggagagggacataagaacagaagaatccatatatcaggcttgttccctgcctcaagaggccagaactgtcatacactcgctcactgagagactttacgtaggagggcccatgacaaacagcaaagggcaatcctgcggttacaggcgttgccgcgcaagcggtgttttcactaccagcatggggaataccatgacgtgctacatcaaagcccttgccgcttgcaaagctgcagggatcgtggaccccgttatgctggtatgtggagacgacctggttgtcatctcagagagccaaggaaacgaggaggatgagcgaaacctgagagctttcacggaggctatgaccaggtattcggcccctcccggtgaccttcccagaccggaatatgacttggagcttataacatcctgctcctcaaacgtatcggtagcgctggaccctcggggtcgccgccggtactacctaaccagagaccctaccactccaatctcccgagctgcttgggaaacagtaagacactcccctgtcaattcttggctgggcaacatcatccaatacgcccctacaatctgggtccggatggtcataatgacccacttcttctccatacttttggcccaggacactctgaaccaaaatctcaattttgagatgtacggggcagtgtattcggtcaatccattagacctaccggccataattgaaaggctacacgggcttgacgccttctcactgcacacatactctccccacgaactctcacgggtggcagcgactctcagaaaacttggagcacctcccctcagagcgtggaagagtcgggcgcgtgctgtgagagcgtcactcatcgcccaaggagggaaggcagccatttgtggccgctacctcttcaactgggcggtgaagacaaagctcaaactcactccattgcccgaggcgagccgcctggatttatccgggtggttcaccgtgggcgccggcgggggcgacatctttcacagcgtgtcgcatgcccgaccccgcctattactcctttgcctactcctactcagtgtaggagtaggcatctttttactccccgctcggtag

SEQ ID NO: 727 - DNA, 9406 bp, Hepatitis C Virus
cactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggataaacccactctatgtccggtcatttgggcgtgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacacaaaccgccgcccacaggacgtcaagttcccgggtggcggccagatcgttggcggagtttacttgctgccgcgcaggggccccaggttgggtgtgcgcgcgacaaggaagacttctgagcgatcccagccgcgtggacgacgccagcccatcccgaaagatcggcgctccaccggcaagtcctggggaaagccaggatatccttggcccctgtacggaaacgagggttgcggctgggcgggttggctcctgtccccccgcgggtctcgtcctacttggggccccactgacccccggcacagatcacgcaatttgggtaaagtcatcgacaccattacgtgtggttttgccgacctcatggggtacatccctgtcattggcgccccggtcggaggcgtcgccagagctctagcacacggtgttagggtcctggaagatggggtaaattacgcaacagggaatctgcccggttgctccttttctatcttcttacttgctcttctgtcttgcgttacagtgccagtgtctgcagtggaaatcaggaacattagttctagctactacgccactaatgactgctcgaacaacagcatcacctggcagctcactaacgcagttctccaccttcctggatgcgtcccatgtgagaatgataatggcaccttgcgctgctggatacaagtaacacctaatgtggctgtgaaacaccgcggtgcactcactcacaacctgcgaacacacgtcgacatgatcgtaatggcagctacggtctgctcggccttgtacgtgggagatgtgtgcggggccgtgatgatcgtgtcgcaggccctcatagtatcgccgcaacgccacaacttcacccaagagtgcaattgttccatctaccaaggccatatcaccggccaccgcatggcatgggacatgatgctaaactggtcaccaactcttaccatgatcctcgcctacgctgctcgtgtgcctgagctagcccttgaacttgtctttggcggccactggggtgtggtgtttggcttggcctatttctccatgcagggagcgtgggccaaagtcatcgccattctccttcttgtcgcgggagtggatgcaaacacctattccactggtgcgcaggcgggtcataccatttcagggctcagtggcctctttgcccctggtcccaggcagagaatccatttaatcaacaccaatggcagctggcacatcaaccggaccgccctcaattgcaacgacagcttaaagacgggcttcatcgcttccctgttttacaccaataatttcaacagctccggctgtcccgagcgtttgtcttcctgccgcgggctggacgattttcgcatcgggtggggaaccttggaatacgagaccaatgtcaccaacgatgaggacatgaggccgtactgctggcattaccctccgaagccttgcggtatcgtctcggctaggacggtttgcgggccggtctactgttttactcctagccctgttgtcgtgggcaccactgacaggcagggcgtacccacctacagctggggagaaaatgagaccgatgtctttttgctaaacagcacaagacccccgcaaggagcttggttcggctgcacttggatgaacgggactgggttcactaaaacatgcggagcgccaccttgccgcattaggagagactacaacagcactctcgatctattgtgccccacagattgctttaggaagcacccaggtactacctatattaagtgtggggcagggccttggttgacccccaagtgcctggtggaatacccttatagattgtggcattatccgtgcactgtgaattttaccatcttcaaggtgcggatgtatgtagggggggtggagcatcgattgtccgcagcatgtaatttcacgcgcggagaccgctgcaggttggaagatagggacaggggtcagcagagtccactgctgcattccaccactgagtgggcggtgttgccatgctccttctccgatctaccggcactatctactggcctattgcacctccaccaaaacatcgtggacgtgcagtacctctatggactttctccggctgttacgagatacatcgtgaagtgggaatgggtggtccaccttttcctgctgttggcagacgccagggtctgtgcatgcctttggatgctcatcatactgggccaagccgaggcggcgcttgagaagctcatcatcttgcactccgccagcgctgctagtgccaacgggccgctgtggttcttcatcttctttacagcagcctggtacttaaagggcagggtggtccccgcggccacgtactctgtcctcggcttgtggtcctttctcctcctagtcctggccctaccacagcaggcctatgccttggacgctgccgaacaaggggaactagggctggtcatattagtaatcatatccatctttactcttactccagcatacaagattctcctgagccgttcggtgtggtggttgtcctacatgctggtcttagccgaagcccagattcagcaatgggttccccccctggaagcccgaggggggcgtgatgggatcatctggctggctgtcatcttacacccacgccttgtgtttgaggtcacgaaatggttgttagcaatcctggggtctgcctacctccttaaggcgtctctgctacggataccatactttgtgagggctcacgccttgctacgagtgtgtaccctggtgaggcaccttgcaggagctaggtacatccagatgctgttgatcaccataggcaggtggaccggcacctacatctatgaccatctctcccccctatcaacttgggcagcccagggtttgcgggacctggcagtcgccgtggagcctgtggtgttcagcccaatggagaggaaggtcattgtgtggggggctgagacagtggcatgcggagacatcctgcatggcctcccggtttccgcgaggctaggtagggaagttctgctcggccctgccgatagctacacctcgaaggggtggaagctcctagcccccattactgcttacactcaacagactcgtggtcttctgggtgccatcgtggtcagcctaacgggccgcgacaaaaatgagcaggctgggcaagtccaggttctgtcctccgtcacacaatccttcttggggacatctatttcgggggtcctctggacagtatatcacggggctggcaacaaaaccttggctggccccaaaggaccagccactcagatgtacaccagcgcagagggggacctcgtgggatggcctagccccccgggtactaagtcattagacccctgtacctgcggggccgtggacctctacctggtcacccgaaacgctgatgtcattccggtccggaggaaagatgacaggcggggtgcactactctcaccaaggcctctctcaaccctcaaaggatcatccggcggacccgtgctttgccctagggggcacgccgtgggcttgttcagagcggccgtgtgctccaggggtgtggccaaatctattgacttcatccctgttgaatctctcgacatcgccagacggacgcccagtttctctgacaatagtacgccaccagctgtgccccagtcttaccaggtgggctacttgcatgcaccaacaggcagcgggaagagcaccaaggtccctgccgcatatgccagtcaggggtataaggtacttgtactaaatccctctgtcgcggccacacttggttttggggcctacatgtccaaagcccacgggattaaccccaacatcagaaccggagtacggactgtgaccaccggagactctatcacctactccacttatggcaagtttctcgcagatggaggctgctcagctggcgcctatgacatcatcatatgcgacgaatgccattcagtggacgccactaccatccttggcattggaacagtcctggatcaggctgagaccgcaggtgtcaggctagtggttctagccacagccacgcctcccggtacggtaacaactcctcacagtaacatagaggaggtggcccttggtcatgagggcgagatccctttttacggcaaggctattcccctagctttcatcaaggggggcagacacctgatcttttgccattcgaagaagaagtgcgatgagctcgcagcagcccttcggggcatgggtgtcaacgccgttgcctactacaggggtctcgacgtctccgttatcccaactcagggagacgtggtggtcgtcgccaccgacgccctaatgactggatacaccggtgactttgactctgttatcgactgcaatgttgcagtcactcagattgttgactttagcctagacccaacctttaccatcaccactcaaaccgtccctcaggacgctgtctcccgtagtcaacgtagagggagaactgggagggggcgactgggcacttacaggtatgtttcatcgggcgaaaggccgtctgggatgttcgacagcgtagtgctctgcgagtgctatgatgccggagcagcctggtacgagctcacgcctgctgagactacagtaagactccgggcttatttcaacacgcccggtttacccgtgtgtcaagaccacctagagttctgggaagcggtcttcacgggtctcacacacattgatgcccacttcctctcccagacaaagcaaggaggagagaactttgcgtatctgacggcctaccaggccacagtatgcgctagggctaaggcccctcctccttcgtgggacgtgacatggaagtgcctaactaggctcaaacccacactgactggtcctacccccctcctgtaccgcttgggcgccgtgaccaacgaggttaccctgacgcaccccgtgacgaaatatatcgccacgtgcatgcaggctgacctcgagatcatgacgagctcatgggtcctggcagggggggtgctagccgccgtggcagcttactgcctggcgaccggctgcatttccatcattggccgcatacacctgaatgatcaggtagttgtgacccctgacaaagaaatcttatatgaggcctttgatgagatggaagaatgcgcctccaaagccgccctcattgaggaagggcagcggatcgcggagatgctcaagtctaagatacaaggcctcttacaacaggccacaagacaggcccaagacatacagccagccatacagtcatcatggcccaagcttgaacaattttgggccaaacatatgtggaactttatcagtggcatacagtacctggcgggactctccaccctaccgggaaatcccgcagtggcgtcaatgatggctttcagcgccgcattgactagcccactacccaccagcaccaccatcctcttgaacatcatgggggggtggttggcctcccagattgccccccctgccggagccactggctttgttgtcagcggtctagtgggggcggccgtcggaagtataggcctaggtaagatactggtggacgttttggccgggtacggtgcaggcatttcgggggccctcgtagcttttaaaatcatgagcggcgagaggccctcggtagaggatgttgtgaatctcctgcctgctattctgtctcctggcgctttggtggtgggagtcatctgtgcagcaatcttgcgccgccacgtcggccagggagagggggcggtccagtggatgaacaggctaatcgcctttgcttccagaggaaaccatgttgcccctactcactacgtggcggagtctgacgcctcacagcgcgtaatgcaggtgctgagttcactcacaattaccagcctactcaggagactacatacctggatcactgaggattgcccggtcccatgttcggggtcttggctccgggacatttgggactgggtttgttccattctcacagacttcaagaactggctgtcttccaaattgctccccaaaatgcctggccttcccttcctctcttgccaaaagggatacaggggtgtatgggctggcacgggagtcatgaccactcggtgtccatgcggagcaaacatctcgggccatgtccgcatgggtaccatgaaaataacaggcccgaagacttgcttgaacctatggcaggggaccttccccattaattgttacacagaggggccttgcgtgccaaaaccctctcctaattacaagaccgcaatttggagggtggcagcgtcggagtacgttgaggtcacgcagcatggttctttctcgtacgtaacggggctaaccagtgacaaccttaaggtcccttgccaggtaccagctccagaattcttctcttgggtggacggggtgcaaatacaccgattcgcccccattccaggtcccttctttcgggacgaggtaacgttcactgtaggccttaattcctttgtggtcggctctcagctcccttgcgaccctgagccggacaccgaggtattggcctccatgttgacagacccgtcccacattactgcggaggcggcagccaggcggttggccaggggatctcccccttcacaagccagctcctcagcgagccagctctccgccccgtccttgaaggctacctgcaccacccacaagatggcatatgattgtgacatggtggatgctaaccttttcatgggaggcgatgtgacccggatcgagtccgactcgaaggtggtcgtcctcgactccctcgattccatgactgaggtagaggatgatcgtgagccttctgtaccatcagagtacctgatcaggaggaggaagttcccaccggcactacctccttgggcccgtccagactacaaccctcctgtgctcgagacatggaagaggccggactatgaaccacccactgtcctaggctgtgcccttccccccacacctcaaacgccggtgcccccacctcggaggcgccgcgccaaagtcctgactcaggacaatgtggagggggtcctcagggagatggcggacaaagtgctcagccctctccaagaccacaatgactccggtcattccacaggagtggacaccggaggagacagcgtccagcagccctctgacgagacccccccttcagaaacaggatcactgtcctccatgcctccccttgagggagagccgggggaccctgacctggagtttgaaccagcgggatccgctcccccttctgagggggagtgtgagatcgttgattcagactctaagtcgtggtccacagtctctgatcaagaggattctgtcatctgctgctccatgtcttactcctggacgggggccctcataacaccatgtgggcccgaggaggagaagttgccgatcaaccctctgagtaattcgcttatgcggttccataacaaggtgtactccacaacctcgaggagtgccactctgagggcaaagaaggtgacctttgacagggtgcaggtgctggacgcacactatgactcagtcttgcaggacgttaagcgggccgcctccaaggttagtgcgaggctcctctcaatagaggaagcctgcgcgctgacgccgccccactccgccaaatcacggtacggatttggggcaaaagaggtgcgcagcttatccaggagggccgtcaaccacatccggtccgtgtgggaggacctcctggaagaccaacataccccaattgacacaactatcatggccaaaaacgaggtgttctgtcttgatcccactaaaggcgggaaaaagccagctcgcctcatcgtataccccgaccttggggtcagggtgtgcgagaagatggccctatatgacattgcacaaaagcttcccaaggcagtaatggggccatcccaagggtttcagtactctcctgcagaacgggtcgattttctcctcaaagcttggggaagtaagaaagacccaatggggccctcatatgacacccgctgctttgactcaaccgtcacggagagggacataagaacagaggaatccatatatcaggcttgttccctgcctcaagaggccagaactgtcatacactcgctcactgagagactctacgtaggagggcccatgacaaacagcaaagggcaatcctgcggttacaggcgttgccgcgcaagcggtgttttcactaccagcatggggaataccatgacatgctacatcaaagcccttgcagcatgcaaagccgcagggatcgtggaccccattatgctggtgtgtggagacgacctggtagtcatctcagagagccaaggcaacgaggaggacgagcggaacctgagagctttcacggaggctatgaccaggtattctgccccccccggtgaccttcccagaccggaatatgacttggagcttataacatcctgctcctcaaacgtatcggtagcgctggactctcggggtcgccgccggtacttcctaaccagagaccctaccactccaatcacccgagctgcttgggaaacagtaagacactcccctgtcaattcttggctgggtaacatcatccaatacgcccctacaatctgggtccggatggtcataatgacccacttcttcgccatactattggcccaggacactctgaaccaaaatctcaattttgagatgtatggggcagtatattcggtcaatccattggacctaccggccataattgaaaggctacatgggctcgaggccttttcactgcacacatactctccccacgaactctcacgggtggcagcgactctcagaaaacttggagcgcctcccctcagagcgtggaagagtcgggcgcgtgctgtgagggcctcactcatcgcccagggagggagagcggccacttgtggccgctacctcttcaactgggcggtgaggacgaagctcaaactcactccattgcccgaggcgagccgcctggatttatccgggtggttcaccgtgggcgccggcgggggcgacatatttcacagcgtgtcgcatgcccgaccccgcctattactcctttgcctactcctacttagcgtaggggtaggcatctttttactccccgctcgatag

SEQ ID NO: 728 - DNA, 9406 bp, Hepatitis C Virus
cactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggataaacccactctatgtccggtcatttgggcgtgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacacaaaccgccgcccacaggacgtcaagttcccgggtggcggccagatcgttggcggagtttacttgctgccgcgcaggggccccaggttgggtgtgcgcgcgacaaggaagacttctgagcgatcccagccgcgtggacgacgccagcccatcccgaaagatcggcgctccaccggcaagtcctggggaaagccaggatatccttggcccctgtacggaaacgagggttgcggctgggcgggttggctcctgtccccccgcgggtctcgtcctacttggggccccactgacccccggcacagatcacgcaatttgggcaaagtcatcgacaccattacgtgtggttttgccgacctcatggggtacatccccgtcattggcgccccggtcggaggcgtcgccagagctctagcacacggtgttagggtcctggaagatggggtaaattacgcaacagggaatctgcccggttgctccttttctatcttcttacttgctcttctgtcttgcgttacagtgccagtgtctgcagtggaaatcaggaacattagttctagctactacgccactaatgactgctcgaacaacagcatcacctggcagctcactaacgcagttctccaccttcctggatgcgtcccatgtgagaatgataatggcaccttgcgctgctggatacaagtaacacctaatgtggctgtgaaacaccgcggtgcactcactcacaacctgcggacacacgtcgacatgatcgtaatggcagctacggtctgctcggccttgtacgtgggagatgtgtgcggggccgtgatgatcgtgtcgcaggccctcatagtatcgccgcaacgccacaacttcacccaagagtgcaattgttccatctaccaaggccatatcaccggccaccgcatggcatgggacatgatgctaaactggtcaccaactcttaccatgatcctcgcctacgctgctcgtgtgcctgagctagcccttgaacttgtctttggcggccactggggcgtggtgtttggcttggcctatttctccatgcagggagcgtgggccaaagtcatcgccattctccttcttgtcgcgggagtggatgcaaacacctattccactggcgcgcaggcgggtcataccatttcagggctcagtggcctctttgcccctggtcccaggcagagaatccatttaatcaacaccaatggcagctggcacatcaaccggaccgccctcaattgcaacgacagcttaaagacgggcttcatcgcttccctgttttacaccaataatttcaacagctccggctgtcccgaacgtttgtcttcctgccgcgcgctggacgattttcgcatcgggtggggaaccttggaatacgagaccaatgtcaccaacgatgaggacatgaggccgtactgctggcattaccctccgaagccttgtggtatcgtctcggctaggacggtctgcgggccggtctactgttttactcctagccctgttgtcgtgggcaccactgacaggcagggcgtacccacctacagctggggagaaaatgagaccgatgtctttttgctaaacagcacaagacccccgcaaggagcttggttcggctgcacttggatgaacgggactgggttcactaaaacatgcggagcaccaccttgccgcattaggagggactacaacagcactctcgatctattgtgccccacagattgctttaggaagcacccaggtactacctatattaagtgtggggcagggccttggttgacccccaagtgcctggtggaatacccttatagattgtggcattatccgtgcactgtgaatttcaccatcttcaaggtgcggatgtatgtagggggggtggagcatcgattgtccgcagcatgtaatttcacgcgcggagaccgctgcaggttggaagatagggacaggggtcagcagagtccgctgctgcattccaccactgagtgggcggtgttgccatgctccttctccgatctaccggcactatctactggcctattgcacctccaccaaaacatcgtggacgtgcagtacctctatggactttctccggctgttacgagatacatcgtgaagtgggagtgggtggtcctccttttcctgctgttggcagacgccagggtctgtgcatgcctttggatgctcatcatactgggccaagccgaggcggcgcttgagaagctcatcatcttgcactccgccagcgctgctagtgccaacgggccgctgtggttcttcatcttctttacagcagcctggtacttaaagggcagggtggtccccgcggccacgtactctgtcctcggcttgtggtcctttctcctcctagtcctggccctaccacagcaggcctatgccttggacgctgccgaacaaggggaactagggctggtcatattagtaatcatatccatctttactcttactccagcatacaagattctcctgagccgttcggtgtggtggttgtcctacatgctggtcttagccgaagcccagattcagcaatgggttccccccctggaagcccgaggggggcgtgatgggatcatctggctggctgtcatcttacacccacgccttgtgtttgaagtcacgaaatggttgttagcaatcctggggtctgcctacctccttaaggcgtctctgctacggataccatactttgtgagggctcacgccctgctacgagtgtgtaccctggtgaggcaccttgcaggagctaggtacatccagatgctgttgatcaccataggcaggtggaccggcacctacatctatgaccatctctcccccctatcaacttgggcagcccagggtttgcgggacctggcagtcgccgtggagcctgtggtgttcagcccaatggagaggaaggtcattgtgtggggggctgagacagtggcatgtggagacatcctgcatggcctcccggtttccgcgaggctaggtagggaagttctgctcggccctgccgatagctacacctcgaaggggtggaagctcctagcccccattactgcttacactcaacagactcgtggtcttctgggtgccatcgtggtcagcctaacgggccgcgacaaaaatgagcaggctgggcaagtccaggttctgtcctccgtcacacaatctttcttggggacatctatttcgggggtcctctggacagtgtatcacggggctggcaacaaaaccttggctggccccaaaggaccagccactcagatgtacaccagcgcagagggggacctcgtgggatggcctagccccccgggtactaagtcattagacccctgtacctgcggggccgtggacctctacctggtcacccgaaacgctgatgtcattccggtccggaggaaagatgacaggcggggtgcactactctcaccaaggcctctctcaaccctcaaaggatcatccggcggacccgtgctttgccctagggggcacgccgtgggcttgttcagagcggccgtgtgctccaggggtgtggccaaatctattgacttcatccctgttgaatctctcgacatcgccagacggacgcccagtttctctgacaatagtacgccaccagctgtgccccagtcttaccaggtgggctacttgcatgcaccaacaggcagcgggaagagcaccaaggtccccgccgcatatgccagtcaggggtataaggtacttgtactaaatccctctgtcgcggccacacttggttttggggcctacatgtccaaagcccacgggattaaccccaacatcagaaccggagtacggactgtgaccaccggagactctatcacttactccacttatggcaagtttctcgcagatggaggctgctcagctggcgcctatgacatcatcatatgcgacgaatgccattcagtggacgccactaccatccttggcattggaacagtcctggatcaggctgagaccgcaggtgtcaggctagtggttctagccacagccacgcctcccggtacggtaacaactcctcacagtaacatagaggaggtggcccttggtcatgagggcgagatccctttttacggcaaggctattcccctagctttcatcaaggggggcagacacctgatcttttgccattcgaagaagaagtgcgacgagctcgcagcagcccttcggggcatgggtgtcaacgccgttgcctactacaggggtctcgacgtctccgttatcccaactcagggagacgtggtggtcgtcgccaccgacgccctaatgactggatacaccggtgactttgactctgttatcgactgcaatgttgcagtcactcagattgttgactttagcctagacccaacctttaccatcaccactcaaaccgtccctcaggacgctgtctcccgtagtcaacgtagagggagaactgggagggggcgactgggcacttacaggtatgtttcatcgggcgaaaggccgtctgggatgttcgacagcgtagtgctctgcgagtgctatgatgccggagcagcctggtacgagctcacgcctgctgagactacagtaagactccgggcttatttcaacacgcccggtttacccgtgtgtcaagaccacctagagttctgggaagcggtcttcacgggtctcacacacattgatgcccacttcctctcccagacaaagcaaggaggagagaactttgcgtatctgacggcctaccaggccacagtatgcgctagggctaaggcccctcctccttcgtgggacgtgacgtggaagtgtctaactaggctcaaacccacactgactggtcctacccccctcctgtaccgcttgggcgccgtgaccaacgaggttaccctgacgcaccccgtgacgaaatatatcgccacgtgcatgcaggctgacctcgagatcatgacgagctcatgggtcctggcagggggggtgctagccgccgtggcagcttactgcctggcgaccggctgcatttccatcattggccgcatacacctgaataatcaggtagttgtgacccctgacaaagaaatcttatatgaggcctttgatgagatggaagaatgcgcctccaaagccgccctcattgaggaagggcagcggatcgcggagatgctcaagtctaagatacaaggcctcttacaacaggccacaagacaggcccaagacatacagccagccatacagtcatcatggcccaagcttgaacaattttgggccaaacatatgtggaactttatcagtggcatacagtacctggcgggactctccaccctaccgggaaatcccgcagtggcgtcaatgatggctttcagcgccgcattgactagcccactacccaccagcaccaccatcctcttgaacatcatgggggggtggttggcctcccagattgccccccctgccggagccactggctttgttgtcagcggtctagtgggggcggccgtcggaagtataggcctaggtaagatactggtggacgttttggccgggtacggtgcaggcatttcgggggccctcgtagcttttaaaatcatgagcggcgagaggccctcggtagaggatgttgtgaatctcctgcctgctattctgtctcctggcgctttggtggtgggagtcatctgtgcagcaatcttgcgccgccacgtcggccagggagaaggggcggtccagtggatgaacaggctaatcgcctttgcttccagaggaaaccatgttgcccctactcactacgtggcggagtctgacgcctcacagcgcgtaatgcaggtgctgagttcactcacaattaccagcctactcaggagactacatacctggatcactgaggattgcccggtcccatgttcggggtcttggctccgggacatttgggactgggtttgttccattctcacagacttcaagaactggctgtcttccaaattgctccccaaaatgcctggccttcccttcctctcttgccaaaagggatacaggggtgtatgggctggcacgggagtcatgaccactcggtgtccatgcggagcaaacatctcgggccatgtccgcatgggtaccatgaaaataacaggcccgaagacttgcttgaacctatggcaggggaccttccccattaattgttacacagaggggccttgcgtgccaaaaccctctcctaattacaagaccgcaatttggagggtggcagcgtcggagtacgttgaggtcacgcagcatggttctttctcgtacgtaacggggctaaccagtgacaaccttaaggtcccttgccaggtaccagctccagaattcttctcttgggtggacggggtgcaaatacaccgattcgcccccattccaggtcccttctttcgggacgaggtaacgttcactgtaggccttaattcctttgtggtcggctctcacctcccttgggaccctgagccggacaccgaggtattggcctccatgttgacagacccgtcccacattactgcggaggcggcagccaggcggttggccaggggatctcccccttcacaagccagctcctcagcgagccagctctccgccccgtccttgaaggctacctgcaccacccacaagatggcatatgattgtgacatggtggatgccaaccttttcatgggaggcgatgtgacccggatcgagtccgactcgaaggtggtcatcctcgactccctcgattccatgactgaggtagaggatgatcgtgagccttctgtaccatcagagtacctgatcaggaggaggaagttcccaccggcactacctccttgggcccgtccagattacaaccctcctgtgctcgagacatggaagaggccggactatgaaccacccactgtcctaggctgtgcccttccccccacacctcaaacgccggtgcccccacctcggaggcgccgcgccaaagtcctgactcaggacaatgtggagggggtcctcagggagatggcggacaaagtgctcagccctctccaagaccacaatgactccggtcattccacaggagtggacaccggaggagacagcgtccagcagccctctgacgagacccccgcttcagaaacaggatcactgtcctccatgcctccccttgagggagagccgggggaccctgacctggagtttgaaccagcgggatccgctcccccttctgagggggagtgtgagatcgttgattcagactctaagtcgtggtccacagtctctgatcaagaggattctgtcatctgctgctccatgtcttactcctggacgggggccctcataacaccatgtgggcccgaggaggagaagttgccgatcaaccctctgagtaattcgcttatgcggttccataacaaggtgtactccacaacctcgaggagtgccactctgagggcaaagaaggtgacctttgacagggtgcaggtgctggacgcacactatgactcagtcttgcaggacgttaagcgggccgcctccaaggttagtgcgaggctcctctcaatagaggaagcctgcgcgctgacgccgccccactccgccaaatcacggtacggatttggggcaaaagaggtgcgcagcttatccaggagggccgtcaaccacatccggtccgtgtgggaggacctcctggaagaccaacataccccaattgacacaactatcatggccaaaaacgaggtgttctgtcttgatcccactaaaggcgggaaaaagccagctcgcctcatcgtataccccgaccttggggtcagggtgtgcgagaagatggccctatatgacattgcacaaaagcttcccaaggcagtaatggggccatcccaagggtttcagtactctcctgcagaacgggtcgattttctcctcaaagcttggggaagtaagaaagacccaatggggccctcatatgacacccgctgctttgactcaaccgtcacggagagggacataagaacagaggaatccatatatctggcttgttccctgcctcaggaggccaaaactgccatacactcgctcactgagagactctacgtaggagggcccatgactaacagcaaagggcaatcctgcggttacaggcgttgccgcgcaagcggtgttttcaccaccagcatggggaataccatgacatgctacatcaaagccctcgcggcatgtaaagctgcagggatcgtggaccctattatgctggtgtgtggagacgacctggttgtcatctcagagagccaaggtaacgaggaggacgagcgaaacctgagagccttcacggaggctatgaccaggtattccgcccctcccggtgaccttcccagaccggaatatgacttggagcttataacatcctgctcctcaaacgtatcggtagcgctggactctcggggtcgccgccggtactacctaaccagagaccctaccactccaatcacccgagctgcttgggaaacagtaagacactcccctgtcaattcttggctgggtaacatcatccaatacgcccctacaatctgggtccggatggtcataatgacccacttcttcgccatactattggcccaggacactctgaaccaaaatctcaattttgagatgtatggggcagtatattcggtcaatccattggacctaccggccataattgaaaggctacatgggctcgaggccttttcactgcacacatactctccccacgaactctcacgggtggcagcgactctcagaaaacttggagcgcctcccctcagagcgtggaagagtcgggcgcgtgctgtgagggcctcactcatcgcccagggagggagagcggccacttgtggccgctacctcttcaactgggcggtgaggacgaagctcaaactcactccattgcccgaggcgagccgcctggatttatccgggtggttcaccgtgggcgccggcgggggcgacatatttcacagcgtgtcgcatgcccgaccccgcctattactcctttgcctactcctacttagcgtaggggtaggcatctttttactccccgctcgatag

SEQ ID NO: 729 - DNA, 9406 bp, Hepatitis C Virus
cactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggataaacccactctatgtccggtcatttgggcgtgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacacaaaccgtcgcccacaggacgttaagttcccgggtggcggtcagatcgttggcggagtttacttgctgccgcgcaggggccccaggttgggtgtgcgcgcgacaaggaagacttccgagcgatcccagccgcgtgggagacgccagcccatcccgaaagatcggcgctccaccggcaagtcctggggaaagccaggatatccttggcctctgtatggaaacgagggttgcggttgggcaggttggctcctgtccccccgcgggtctcgtcctacttggggccccactgacccccggcacagatcacgtaatttgggcaaagtcatcgataccgttacgtgcggttttgccgacctcatggggtacatccctgtcgttggcgccccggttggcggcgtcgccagagctctggcacacggtgttagggtcctggaagacgggataaattacgcaacagggaatctacccggttgctctttttctatcttcttacttgctcttctgtcgtgtgtcacagtgccagtgtctgcagtggaagtcaggaacattagttctagctactacgccactaatgattgctcgaacaacagcatcacctggcagctctctggcgcagttctccatcttcccggatgcgtcccatgtgagaatgacaacggcaccttgcgatgctggatacaagtaacacctaatgtggctgtgaaatatcacggtgcactcactcacaacctgcgaacacacgtcgacatgatcgtaatggcagctacggtctgctcggccttgtacgtgggggatgtgtgcggggccgtgatgatcgtgtcgcaggctttcataatatcaccacaacatcacaacttcacccaagagtgcaactgttccatctaccaaggtcgtatcaccggccatcgcatggcatgggacatgatgctaaactggtcaccaactcttaccatgatccttgcctacgctgctcgtgttcctgagctagctcttgagcttgtcttcggcggccactggggtgtggtgtttggcctggcctatttctccatgcaaggagcgtgggccaaagtcattgccatcctccttcttgtcgcgggagtggatgcagacacctatgcctccggcgcgcaagcgggtcgggtcacttcggggtttgctagcatcttttcccccggcgccaagcagaacatcaatttaatcaagaccaatggcagctggcacataaaccggaccgccctcaactgcaatgacagcctaaacacgggtttcatcgcttccctgttttacgtccaacatttcaacagctctggttgccccgagcgtatgtcttcctgccgcgggctggacgattttcgcatcgggtggggaaccttggaatacgagaccaatgtcaccaacgatgaggacatgaggccgtactgctggcattaccctccgaagccttgcggtatcgttccggctaggacagtttgcgggccggtctactgttttacccctagccctgttgtcgtgggcaccactgacaggcagggcgcgcccacctacagctggggggaaaatgagaccgatgtcttcttgctaaatagcacaagaccaccgcgaggagcttggttcggctgcacctggatgaacgggactggtttcaccaagacatgcggagcaccaccttgccgcattaggagggactacaacagcactctcgatctattgtgccccacagattgttttaggaagcacccagatgctacctatattaagtgcggggcaggaccttggttgacccccaggtgcttggtagactacccttataggctgtggcattatccgtgcactgtaaatttcaccatcttcaaggtgcggatgtatatagggggggtggagcatcgattctccgcggcatgcaacttcacgcgcggagaccgctgcggattggaagatagggataggggtcagcaaagtccactactgcattccaccactgagtgggcggtgctgccatgctccttctccgacctaccggcactatccactggcctattgcacctccaccaaaacatcgtggacgtgcagtacctctatggactttctccggctgttacaagatacatcgtgaagtgggaatgggtggtcctcctcttcttgctgttagcagacgcccggatctgtgcatgcctttggatgctcattatactgggccaagccgaggcggcgcttgagaagctcatcatcttgcactccgctagcgctgctagtgccaatgggctgctgtggtttttcatcttctttacagcggcctggtacttaaagggcagggtggtccccgtggccacgtactctgtcctcggcttgtggtcctttctcctcctagtcctggccctaccacagcaggcttatgccttgaacgtcgctgaacaaggggaactggggctggttgtgatagtaatcatatccatctttactctcaccccagcatacaagattctcctgagccgttcggtgtggtggctgtcctacatgctggtcttggccgaggcccagattcaacaatgggttccccccttggaggcccgaggggggcgtgacgggatcatttgggtggctgtcatcctacacccacgccttgtgtttgaggtcacaaaatggctgttagcaatcctggggtctgcctacctccttaaagcgtctctgctgcgggttccatactttgtgagggctcatgccctgctacgagtgtgtaccctggttagacacctcgcaggagctaggtacatccagatgctgttgatcaccgtgggcaggtggaccggcacttacatctatgaccacctctcccctctatcaacttgggcagcccagggtttgcgggacctggcggtcgccgtggagcctgtggtgtttagcccaatggagaagaaggtcattgtgtggggggctgagacagtggcatgtggagacatcctgcatggcctcccggtttccgcgaggttaggtagggaagttctgctcggccctgctgatagctacacctcgaaggggtggaagctcctagctcccattactgcttacgcccagcagactcgtggtctcctgagcgccattgtggtcagcctaacgggccgcgacaaaaatgaacaggctgggcaggttcaggtcctgtcctccgtcacacaatctttcttggggacatctatttcgggggtcctctggacagtataccacggggctggcaataagaccttggctggccccaaaggaccagttactcagatgtacaccagcgcagagggcgacctcgtgggatggcccagcccccccgggactaagtcattagacccctgtacctgtggggccgtggatctctacctggtcacccgaaacgctgatgtcattccggtccggaggaaagatgaccggcggggtgcactgctctcgccaaggcctctctcaaccctcaaaggatcatccggtggacccgtgctctgccctaggggacacgccgtgggcttgttcagagcggccgtgtgtgccaggggtgtagccaaatctattgacttcatccctgttgaatctctcgatatcgccgcacggacgcccagtttctctgacaacagcacgccaccagctgtgccccagacttaccaggtgggctacttgcacgcaccaacaggcagcgggaagagcaccaaggtccctgctgcatacgccagtcaggggtacaaggtactcgtactaaatccctctgtcgcggccactcttggttttggggcgtacatgtctaaggcccacggaatcaaccccaacatcagaaccggagtacggactgtcaccaccggggaccctatcacctactccacctatggcaagtttctcgcggacggaggctgctcagctggcgcctatgacgtcatcatatgcgatgaatgccattcagtggacgctactaccatccttggcattggaacagtcctcgaccaggctgagactgcaggcgccaggctagtggtcttagccacagccacgcctcccggtacggtgacaactccccacagtaacatagaggaggtggccctcggtcacgagggagagatccctttttatggcaaggctattcctctagcttccatcaaggggggcagacacctgatcttttgccattcaaagaagaagtgcgatgagctcgcagcagcccttcggggcatgggtgtcaatgccgttgcctactacaggggtctcgacgtctccgttataccaacccaaggagacgtggtggtcgtcgccaccgatgccctaatgactggatacaccggtgactttgactctgtcatcgactgcaacgttgcagtcactcaggttgttgactttagcctagacccaaccttcaccatcaccactcaaaccgtccctcaggacgctgtctcccgtagtcaacgtagagggagaactgggagggggcgactgggcatttacaggtatgtctcatcaggcgaaaggccttctgggatgttcgacagcgtagtgctctgcgagtgctatgatgccggggcagcctggtatgagcttacgcctgctgagactacggtgagactccgggcttatttcaacacgcccggtctacccgtgtgtcaagaccacctggagttctgggaagcggtctttacaggtctcacacacattgatgcccacttcctctcccagacgaagcaaggaggagataactttgcgtatctgacggcctatcaggccacagtatgcgctagggcaaaggctcctcctccctcgtgggacgtgatgtggaagtgtctaactaggcttaaacccacactgactggtccaacccccctcctgtaccgcttgggtgctgtgaccaacgaggttaccctgacgcaccccgtgacgaaatatatcgccacgtgcatgcaagctgacctcgagatcatgacaagcacatgggtcctggcagggggggtgctagccgccgtggcagcctactgcctggcgactggctgcatttccatcattggccgcttacacctgaacgatcaggtggttgtagctcctgacaaggaagtcttatatgaggcctttgatgagatggaagaatgcgcctccaaagccgccctcattgaggaagggcagcggatggcggagatgctcaagtctaagatacagggcctccttcaacaggccacaagacaggcccaagacatacagccagccatacagtcatcatggccaaagcttgaacaattttgggccaagcacatgtggaacttcatcagtggcatacagtacctggcgggactctccaccctaccaggaaatcctgcggtggcgtcaatgatggctttcagcgccgctttgactagcccactacccaccagcaccaccatcctcttgaacatcatggggggatggttggcctctcagattgccccccctgctggggccactggcttcgttgtcagcggtctagtgggggcggccgtcggaagcataggcctgggtaagatactggtggatgttttggccgggtacggcgcaggcatttcaggggccctcgtagcttttaaaatcatgagcggcgagaagccctcggtagaagatgttgtgaatctcctgcctgctattctgtctcctggcgctttggtagtgggagtcatctgtgcggcaatcctgcgccgccacgtcggccagggagagggggcggtccagtggatgaacagactgatcgcctttgcctccagaggaaaccatgttgcccctacccactacgtggcggagtccgacgcctcgcagcgcgtgacgcaggtgctaagttcactcacaattaccagcttgcttaggagactacatgcctggatcactgaggattgcccagttccatgttcggggtcttggctccaggacatttgggattgggtttgctccatcctcgcagactttaagaactggctgtctgcaaaattgctccctaaaatgcccggccttcccttcatctcttgccaaaagggatacaggggtgtatgggctggcacgggagttatgactactcggtgtccatgcggagcaaacatctcgggccatgtccgcatgggcaccatgaaaataacaggcccgaagacctgcctgaacctgtggcaggggaccttccccattaattgttacacagaagggccttgcgtgccaaaaccccctcctaattacaagaccgcaatttggagggtggcagcgtcggagtacgttgagatcacgcagcatggctctttctcgtacgtaacggggttaaccagtgacaaccttaaggtcccttgccaggtaccggctccagaatttttctcttgggtggacggggtgcaagtacaccgatttgcccccattccaggtcccttctttcgggatgaggtgacgttcaccgtaggcctcaattcctttgtggtcggctttcagttcccttgtgaccctgagccggacaccgaggtattggcctccatgttgacagacccgtcccacattaccgcggaggcggcagccaggcggttggccagggggtctcccccctcacaggccagctcttcagcgagccagctttccgccccgtctttgaaggctacctgtaccacccataagacagcatatgattgtgacatggtggatgctaaccttttcatgggaggcgatgtgacccggattgagtccgactctaaggtgattgttgtcctctccctggattccatgactgaggtagaggatgatcgtgagccttccataccatcagagtacttgatcaggaggagaaagttcccaccggcgctacccccctgggcccgtccggactacaaccctcctgtgatcgagacatggaaaaggccaggctatgaaccacccactgtcctaggctgtgcccttccccccacacttcaagcgccagtgcccccacatcgaaggcgccgcgccaaagtcctgactcaggacaatgtggagggggtcctcagggagatggcggacaaagtgttcagccctctccaagaccaaaatgactccggtcactccactggagcagataccgggggagacagcgtccagcagccccctgacgagactgccgcttcagaagcgggatcactgtcctccatgcctccccttgagggagagccgggggaccctgacctggagtttgagccagcgggacccgctcccccttccgagggggagtgtgaggtgattgattcagactctaagtcgtggtccacagtctctgatcaagaggattctgttatctgctgctccatgtcatactcctggacgggagccctcataacaccatgtgggcccgaggaggagaagttgccgatcaaccctctgagtaactcgctcatgcggttccataacaaggtgtactccacaacctcaaggagtgcctctctgagggcaaagaaggtgacctttgacagggtgcaggtgctggacgcacactatgactcagtcttgcaggacgttaagcaggccgcctctaaggttagtgcgaggctcctctctgtagaggaagcctgcgcgctgaccccgccccactccgccaaatcacgatacggatttggggcaaaggaggtgcgcagcttatccaggagggccgttaaccacatccggtccgtgtgggaggacctcctggaagaccaacatactccaattgacacaactatcatggccaaaaatgaggtgttctgtgttgatcccactaaaggcgggaaaaagccagctcgcctcatcgtataccccgacctcggggtcagggtgtgcgaaaagatggccctctatgacattgcacaaaagcttcccaaggcaataatggggccatcctatgggttccaatactctcctgcagaacgggtcgattttctcctcaaagcttggagaagtaagaaggacccaatggggttctcatatgacacccgctgctttgactcaaccgtcacggagagggacataagaacagaagaatccatatatcaggcttgttccctgcctcaagaggccagagttgccatacactcgctcactgagagactctacgtaggagggcccatgacaaacagcaaagggcaatcctgcggttacaggcgttgccgcgcaagcggtgttttcactaccagcatggggaataccatgacatgctacatcaaagcccttgcagcatgcaaagctgcagggatcgtggaccctgttatgctggtgtgtggagacgacctggtcgtcatctcagagagccaaggtaacgaggaggacgagcggaacctgagagctttcacggaggctatgaccaggtattccgcccctcccggtgaccttcccagaccggaatatgacttggagcttataacatcctgctcctcaaacgtatcggttgcgctggactctcgaggtcgccgccggtacttcctaaccagagaccctaccactccaatcacccgagctgcttgggaaacagtaagacactcccctgtcaattcttggctgggcaacatcatccaatacgcccctacaatctgggtccggatggtcataatgacccatttcttttccatactattggcccaggatactctgaaccaaaatctcaattttgagatgtacggggcagtatattcggtcaatccattagacctaccggccataattgaaaggctacacgggcttgatgctttttcactgcacacatactctcccaacgaactctcaagggtggcagcaactctcagaaaacttggagcgcctccccttagagcgtggaagagtcgggcgcgtgctgtgagggcctcactcatcgcccagggagggagggcggccatttgtggccgctacctcttcaactgggcggtgaagacaaagctcaaactcactccattgcccgaggcgagccgcctggatttatccgggtggttcaccgtgggcgccggcgggggcgacgtttttcacagcgtgtcgcatgcccgaccccgcctattactcctttgcctactcctacttagcgtaggagtaggcatctttttactccccgctcggtag

SEQ ID NO: 730 - DNA, 9406 bp, Hepatitis C Virus
cactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggataaacccactctatgtccggtcatttgggcgtgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacacaaaccgtcgcccacaggacgttaagttcccgggtggcggtcagatcgttggcggagtttacttgctgccgcgcaggggccccaggttgggtgtgcgcgcgacaaggaagacttccgagcgatcccagccgcgtggaagacgccagcccatcccgaaagatcggcgctccaccggcaagtcctggggaaagccaggatatccttggcctctgtatggaaacgagggttgcggttgggcaggttggctcctgtccccccgcgggtctcgtcctacttggggccccactgacccccggcacagatcacgtaacttgggcaaagtcatcgataccgttacgtgcggttttgccgacctcatggggtacatccctgtcgttggcgccccggttggcggcgtcgccagagctctggcacacggtgttagggtcctggaagacgggataaattacgcaacagggaatctacccggttgctctttttctatcttcttacatgatcatctgtcgtgtgtcacagtgccagtgtctgcagtgaaagtcaggaacattagttctagctactacgccactaatgattgctcgaacaacagcatcacctggcagctctctggcgcagttctccatcttcccggatgcgtcccatgtgagaatgacaacggcaccttgagatgctggatacaagtaacacctaatgtggctgtgaaatatcacggtgcactcactcacaacctgcgaacacacgtctacatgatcgtaatgacagctacggtctgctcggccttgtacgtgggggatgtgtgcggggccgtaatgatcgtgtcgcaggcttttataatatcaccacaacatcacaccttcacccaagagtgcaactgttccatctaccaaggtcgtatcaccggccatcgcatggcatgggacatgatgctaaactggtcaccaactcttaccatgatccttgcctacgctgctcgtgttcctgagctagctcttgagcttgtcttcggcggccactggggtgtggtgtttggcctggcctatttctccatgcaaggagcgtgggccaaagtcattgccatcctccttcttgtcgcgggagtggatgcagacacctatgcctccggcgcgcaagcgggtcgggtcacttcggggtttgctagcatcttttccgccggcgccaagcagaacatcaatttaatcaagaccaatggcagctggcacataaaccggaccgccctcaactgcaatgacagcctaaacacgggtttcatcgcttccctgttttacgtccaacatttcaacagctctggttgccccgagcgtatgtcttcctgccgcgggctggacgattttcgcatcgggtggggaaccttggaatacgagaccaatgtcaccaacgatgaggacatgaggccgtactgctggcattaccctccgaagccttgcggtatcgttccggctaggacagtttgcgggccggtctactgttttacccctagccctgttgtcgtgggcaccactgacaggcagggcgcgcccacctacaactggggggaaaatgagaccgatgtcttcttgctaaatagcacaagaccaccgcgaggagcttggttcggctgcacctggatgaacgggactggtttcactaagacatgcggagcaccaccttgccgcattaggagggactacaacagcactctcgatctattgtgccccacagattgttttaggaagcacccagatgctacctacattaagtgcggggcaggaccttggttgacccccaggtgcttggtagactacccttataggctgtggcattatccgtgcactgtaaatttcaccatcttcaaggtgcggatgtatatagggggggtggagcatcgattctccgcggcatgcaacttcacgcgcggagaccgctgcggattggaagatagggataggggtcagcaaagtccactactgcattccaccactgagtgggcggtgctgccatgctccttctccgacctaccggcactatccactggcctattgcacctccaccaaaacatcgtggacgtgcagtacctctatggactttctccggctgttacaagatacatcgtgaagtgggaatgggtggtcctcctcttcttgctgttagcagacgcccggatctgtgcatgcctttggatgctcattatactgggccaagccgaggcggcgcttgagaagctcatcatcttgcactccgctagcgctgctagtgccaatgggctgctgtggtttttcatcttctttacagcggcctggtacttaaagggcagggtggtccccgtggccacgtactctgtcctcggcttgtggtcctttctcctcctagtcctggccctaccacagcaggcttatgccttgaacgtcgctgaacaaggggaactggggctggttgtgatagtaatcatatccatctttactctcaccccagcatacaagattctcctgagccgttcggtgtggtggctgtcctacatgctggtcttggccgaggcccagattcaacaatgggttccccccttggaggcccgaggggggcgtgacgggatcatttgggtggctgtcatcctacacccacgccttgtgtttgaggtcacaaaatggctgttagcaatcctggggtctgcctacctccttaaagcgtctctgctgcgggtgccatactttgtgagggctcatgccctgctacgagtgtgtaccctggttagacacctcgcaggagctaggtacatccagatgctgttgatcaccgtgggcaggtggaccggcacttacatctatgaccacctctcccctctatcaacttgggcagcccagggtttgcgggacctggcggtcgccgtggagcctgtggtgtttagcccaatggagaagaaggtcattgtgtggggggctgagacagtggcatgtggagacatcctgcatggcctcccggtttccgcgaggttaggtagggaagttctgctcggccctgctgatagctacacctcgaaggggtggaagctcctagctcccattactgcttacgcccagcagactcgtggtctcctgagcgccattgtggtcagcctaacgggccgcgataaaaatgaacaggctgggcaggtccaggtcctgtcctccgtcacacaatctttcttggggacatctatttcgggggtcctctggacagtataccacggggctggcaataacaccttggctggccccaaaggaccagttactcagatgtacaccagcgcagagggcgacctcgtgggatggcccagcccccccgggactaagtcattagacccctgtacctgtggggccgtggatctctacctggtcacccgaaacgctgatgtcattccggtccggaggaaagatgaccggcggggtgcactgctctcgccaaggcctctctcaaccctcaaaggatcatccggtggacccgtgctctgccctaggggacacgccgtgggcttgttcagagcggccgtgtgtgccaggggtgtagccaaatctattgacttcatccctgttgaatctctcgatatcgccgcacggacgcccagtttctctgacaacagcacgccaccagctgtgccccagacttaccaggtgggctacttgcacgcaccaacaggcagcgggaagagcaccaaggtccctgctgcatacgccagtcaggggtacaaggtactcgtactaaatccctctgtcgcggccactcttggttttggggcgtacatgtctaaggcccacggaatcaaccccaacatcagaaccggagtacggactgtcaccaccggggaccctatcacctactccacctatggcaagtttctcgcggacggaggctgctcagctggcgcctatgacatcatcatatgcgatgaatgccattcagtggacgctactaccatccttggcattggaacagtcctcgaccaggctgagactgcaggcgccaggctagtggtcttagccacagccacgcctcccggtacggtgacaactccccacagtaacatagaggaggtggccctcggtcacgagggagagatccctttttatggcaaggctattcctctagctttcatcaaggggggcagacacctgatcttttgccattcaaagaagaagtgcgatgagctcgcagcagcccttcggggcatgggtgtcaatgccgttgcctactacaggggtctcgacgtctccgttataccaacccaaggagacgtggtggtcgtcgccaccgatgccctaatgactggatacaccggtgactttgactctgtcatcgactgcaacgttgcagtcactcaggttgttgactttagcctagacccaaccttcaccatcaccactcaaaccgtccctcaggacgctgtctcccgtagtcaacgtagagggagaactgggagggggcgactgggcatttacaggtatgtctcatcaggcgaaaggccttctgggatgttcgacagcgtagtgctctgcgagtgctatgatgccggggcagcctggtacgagcttacgcctgctgagactacggtgaggctccgggcttatttcaacacgcccggtctacccgtgtgtcaagaccacctggagttctgggaagcggtctttacaggtctcacacacattgatgcccacttcctctcccagacgaagcaaggaggagataactttgcgtatctgacggcctatcaggccacagtatgcgctagggcaaaggctcctcctccctcgtgggacgtgatgtggaagtgtctaactaggcttaaacccacactgactggtccaacccccctcctgtaccgcttgggtgctgtgaccaacgaggttaccctgacgcaccccgtgacgaaatatgtcggcacgtgcatgcaagctgacctcgagatcatgacaagcgcatggggcctggcagggggggtgctagccgccgtggcagcctactgcctggcgactggctgcatttccatcattggccgcttacacctgaacgatcaggtggttgtagctcctgacaaggaagtcttatatgaggcctttgatgagatggaagaatgcgcctccaaagccgccctcattgaggaagggcagcggatggcggagatgctcaagtctaagatacagggcctccttcaacaggccacaagacaggcccaagacatacagccagccatacagtcatcatggccaaagcttgaacaattttgggccaagcacatgtggaacttcatcagtggcatacagtacctggcgggactctccaccctaccgggaaatcctgcggtggcgtcaatgatggctttcagcgccgctttgactagcccactacccaccagcaccaccatcctcttgaacatcatggggggatggttggcctctcagattgccccccctgctggggccactggcttcgttgtcagcggtctagtgggggcggccgtcggaagcataggcctgggtaagatactggtggatgttttggccgggtacggcgcaggcatttcaggggccctcgtagcttttaaaatcatgagcggcgagaagccctcggtagaagatgttgtgaatctcctgcctgctattctgtctcctggcgctttggtagtgggagtcatctgtgcggcaatcctgcgccgccacgtcggccagggagagggggcggtccagtggatgaacagactgatcgcctttgcctccagaggaaaccatgttgcccctacccactacgtggcggagtccgacgcctcgcagcgcgtgacgcaggtgctaagttcactcacaattaccagcttgcttaggagactacatgcctggatcactgaggattgcccagttccatgttcggggtcttggctccaggacatttgggattgggtttgctccatcctcgcagactttaagaactggctgtctgcaaaattgctccctaaaatgcccggccttcccttcatctcttgccaaaagggatacaggggtgtatgggctggcacgggagttatgactactcggtgtccatgcggagcaaacatctcgggccatgtccgcatgggcaccatgaaaataacaggcccgaagacctgcctgaacctgtggcaggggaccttccccattaattgttacacagaagggccttgcgtgccaaaaccccctcctaattacaagaccgcaatttggagggtggcagcgtcggagtacgttgagatcacgcagcatggctctttctcgtacgtaacggggttaaccagtgacaaccttaaggtcccttgccaggtaccggctccagaatttttctcttgggtggacggggtgcaagtacaccgatttgcccccattccaggtcccttctttcgggatgaggtgaagttcaccgtaggcctcaattcctttgtggtcggctttcagttcccttgtgaccctgagccggacaccgaggtattggcctccatgttgacagacccgtcccacattaccgcggaggcggcagccaggcggttggccagggggtctcccccctcacaggccagctcttcagcgagccagctttccgccccgtctttgaaggctacctgtaccacccataagacagcatatgattgtgacatggtggatgctaaccttttcatgggaggcgatgtgacccggattgagtccgactctaaggtgatcgttgtccactccctggattccatgactgaggtagaggatgatcgtgagccttccataccatcagagtacttgatcaggaggagaaagttcccaccggcgctacccccctgggcccgtccggactataaccctcctgtgatcgagacatggaaaaggccgggctatgaaccacccactgtcctaggctgtgcccttccccccacacttcaagcgccagtgcccccacctcggaggcgccgcgccaaagtcctgactcaggacaatgtggagggggtcctcagggagatggcggacaaagtgttcagccctctccaagaccaaaatgactccggtcactccactggagcagataccgggggagacagcgtccagcagccccctgacgagactgccgcttcagaagcgggatcactgtcctccatgcctccccttgagggagagccgggggaccctgacctggagtttgagccagcgggacccgctcccccttccgagggggagtgtgaggtgattgattcagactctaagtcgtggtccacagtctctgatcaagaggattctgttatctgctgctccatgtcatactcctggacgggagccctcataacaccatgtgggcccgaggaggagaagttgccgatcaaccctctgagtaactcgctcatgcggttccataacaaggtgtactccacaacctcaaggagtgcctctctgagggcaaagaaggtgacctttgacagggtgcaggtgctggacgcacactatgactcagtcttgcaggacgttaagcaggccgcctctaaggttagtgcgaggctcctctctgtagaggaagcctgcgcgctgaccccgccccactccgccaaatcacgatacggatttggggcaaaggaggtgcgcagcttatccaggagggccgttaaccacatccggtccgtgtgggaggacctcctggaagaccaacatactccaattgacacaactatcatggccaaaaatgaggtgttctgtgttgatcccactaaaggcgggaaaaagccagctcgcctcatcgtataccccgacctcggggtcagggtgtgcgaaaagatggccctctatgacattgcacaaaagcttcccaaggcaataatggggccatcctatgggtttcagtactcttctgcagaacgggtcgattttctcctcaaagcttggagaagtaagaaggacccaatggggttctcatatgacacccgctggtttgactcaaccgtcacggagagggacataagaacagaagaatccatatatcaggcttgttccctgcctcaagaggccagaactgtcatacactcgctcactgagagactctacgtaggagggcccatgacaaacagcaaagggcaatcctgcggttacaggcgttgccgcgcaagcggtgttttcactaccagcatggggaataccatgacatgctacatcaaagcccttgcagcatgcaaagccgcagggatcgtggaccctattatgctggtgtgtggagacgacctggtagtcatctcagagagccaaggtaacgaggaggacgagcggaacctgagagctttcacggaggctatgaccaggtattctgcccctcccggtgaccttcccagaccggaatatgacttggagcttataacatcctgctcctcaaacgtatcggttgcgctggactctcgaggtcgccgccggtacttcctaaccagagaccctaccactccaatcacccgagctgcttgggaaacagtaagacactcccctgtcaattcttggctgggcaacatcatccaatacgcccctacaatctgggtccggatggtcataatgacccatttcttttccatactattggcccaggatactctgaaccaaaatctcaattttgagatgtacggggcagtatattcggtcaatccattagacctaccggccataattgaaaggctacacgggcttgatgctttttcactgcacacatactctcccaacgaactctcaagggtggcagcaactctcagaaaacttggagcgcctccccttagagcgtggaagagtcgggcgcgtgctgtgagggcctcactcatcgcccagggagggagggcggccatttgtggccgctacctcttcaactgggcggtgaagacaaagctcaaactcactccattgcccgaggcgagccgcctggatttatccgggtggttcaccgtgggcgccggcgggggcgacgtttttcacagcgtgtcgcatgcccgaccccgcctattactcctttgcctactcctacttagcgtaggagtaggcatctttttactccccgctcggtag

SEQ ID NO: 731 - DNA, 9406 bp, Hepatitis C Virus
cactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggataaacccactctatgtccggtcatttgggcgtgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacacaaaccgccgcccacaggacgttaagttcccgggtggcggtcagatcgttggcggagtttacttgctgccgcgcaggggccccaggttgggtgtgcgcgcgacaaggaagacttccgagcgatcccagccgcgcgggaggcgccagcccatcccgaaagatcggcgctccaccggcaagtcctggggaaagccaggatatccttggcctctgtacggaaacgagggttgcggctgggcaggttggctcctgtccccccgcgggtctcgtcctacttggggccccactgacccccggcatagatcacgcaatttgggcagagtcatcgataccattacgtgtggttttgccgacctcatggggtacatccctgtcgttggcgccccggtaggaggcgtcgccagagctctggcacacggtgttagggtcctggaagacgggataaattacgcaacagggaatttgcccggttgctctttttctatcttcttgcttgctcttctgtcgtgcgtcacagtgccagtgtctgcagtggaggtcaggaacatcagttctagctactacgccactaatgattgctcgaacaacagcatcacctggcagctcgctaacgcagttctccaccttcctggatgtgtcccatgtgagaatgacaatggcactttgcgctgttggatacaagtaacacctaatgtggctgtgaaacatcgcggtgcactcactcacaacctgcgaacacacgtcgacatgatcgtaatggcagctacggtctgctcggccttgtacgtgggagatgtgtgcggggccgtgatgatcgtgtcgcaggctctcatagtgtcgccggaacgccacaacttcacccaagagtgcaactgttccatctaccagggccatatcaccggccatcgcatggcatgggacatgatgctaaactggtcaccaactcttaccatgatcctcgcctacgctgctcgtgttcctgagctagtccttgaagttgtcttcggcggccactggggtgtggtgtttggcttggcctatttctccatgcagggagcgtgggccaaagtcattgctatcctccttcttgtcgcgggagtggatgcaaccacctactccaccggcgcgcaagcgggccgtgctgcttcggggattgctaacctctttacccctggtgccaagcagaacatccagttaatcaacaccaacggcagctggcacataaaccggaccgccctcaattgcaatgacagcttacagacgggtttccttgcttccctgttctacaccaaaagctttaatagctctggctgccccgagcgcttgtcctcctgccgcgggctggacgattttcgcatcgggtggggaaccctggaatacgagaccaaagtcaccaacgatgaggacatgaggccgtactgctggcattaccctccgaagccttgcggtatcgtctcggctaagacggtttgcgggccggtctactgttttacccccagccctattgtcgtgggcaccactgacaagcagggcgtacccacctataactggggggataatgagaccgatgtcttcctactaaatagcacaagacccccgcaaggagcttggttcggttgcacttggatgaacgggactgggttcactaagacgtgcggagcaccaccttgccgcattaggagggacttcaacagcactctcgacctattatgccccacagactgctttaggaagcatccagatgctacctatattaagtgtggagcagggccttggttgacccccaggtgcctggtagaatacccttatagactgtggcattatccgtgcactgtgaatttcaccatcttcaaggtgcggatgtatgtgggaggggtggagcatcgattgtccgcagcatgtaacttcacgcgcggagaccgttgcagactggaagatagggataggggtcagcaaagtccactgctgcattccaccactgagtgggcggtgttgccatgctccttctccgacctaccggcactatccactggcctattgcacctccaccaaaacatcgtggacgtgcagtacctctatggacttactccggctattacaagatacattgtgaagtgggaatgggtggttctcctcttcttgttgttggcagacgccagggtctgtgcatgcctttggatgcttatcatactgggccaagccgaggcggcgcttgagaagctcatcatcttgcactccgctagcgctgccagtgccaatgggccgatgtggttcttcatcttctttatcgcggcctggtacttaaagggcagggtggtccctatggccacgtactctgttctcggcttgtggtcctttctcctcctggtcctggccctaccacagcaggcctatgccttggacaccgctgaacaaggggaactagggctggtcatattagcaatcatatccatttttactcttaccccagcatacaagattctcctgagccgttcagtgtggtggctgtcctacatgctggtcttggccgaggcccagattcagcagtgggttccccccctggaggcccggggggggcgtgacgggatcatttgggtggctgtcattctacacccacgcctggtgtttgagatcacgaaatggttgctagcaatcctggggcctgcttacctccttagagcttctctgctacggataccatactttgtgagggcccacgctttgctacgagtgtgtaccctggtgagacgcattgcaggagctaagtacatccaggtgctgctgctcaccataggcaggtggaccggcacttacatctatgaccacctctcccctttatcaacctgggcagctcagggtttacgggacctggcagtcgccgtggagcccgtggtgttcagcccaatggagaagagggtcattgtatggggagctgagacagtggcatgtggagacatcctgcatggcctcccggtttccgcgaggctaggcagagaagttctgctcggccctgccgatagctacacctcgaaggggtggaagctcctagctcccattactgcttacacccagcagactcgcggtctcctgggcgccattgtggtcagcctaacgggccgcgacaaaaatgagcaggctgggcaggtccaggttctgtcctccgtcacacaatctttcttggggacatctatttcgggggtcctttggacagtatatcatggggctggtaataagaccttggctggccccaaaggaccagtcactcagatgtacaccagcgcggagggggacctcgtgggatggcctagcccccctggtactaagtcattagacccctgtacctgcggggccgtggacctctacttggtcacccgaaacgctgatgtcattccggtccggaggaaagatgaccgacggggcgcactactctcgccaaggcccctctcaaccctcaaaggatcatccggcggacccgtgctctgctctaggggacacgccgtgggcttattcagagcggccgtgtgtaccaggggtgtggccaaatccattgacttcatccctgtcgaatctctcgacattgccgcacggacgcccagtttctctgacaacagcacgccaccagctgtgccccagtcttaccaggtgggctacttgcatgcaccaacaggcagcgggaagagcaccaaggttcctgccgcatatgccagtcaggggtataaagtacttgtactaaatccctctgtcgcggccacacttggttttggggcctacatgtccaaagcccacgggattaaccccaatatcagaactggagtacggactgtgaccaccggggaccctatcacctactccacttatggcaaattcctcgcggatggaggctgctcagctggcgcctatgatgtcatcatatgcgacgaatgccattcagtggacgctactactatccttggcattggaaccgtcctcgaccaggccgagaccgcaggcgccaggctagtggttttggccacagccacgccccctggtacggtgacaactccccacagtaacatagaggaggtagccctcggtcatgagggcgagatccctttttatggcaaggctattcccctagctttcatcaaggggggcagacacctgatcttttgccactcaaagaagaagtgcgatgagctcgcatcagcccttcggggcatgggtgtcaacgccgttgcttactacaggggtctcgacgtctccgttataccaactcaaggagacgtggtggtcgtcgccactgatgccctaatgactggatacaccggtgactttgactctgtcatcgactgcaacgttgcagtcactcagattgttgacttcagcctagacccaaccttcaccatcaccactcaaaccgtccctcaggacgctgtctcccgtagtcaacgtagagggagaactgggagagggcgattgggcatttacagatacgtctcgtcaggcgagaggccgtctgggatgttcgacagcgtagtgctctgcgagtgctatgatgccggggcagcctggtacgagcttacgcccgctgagactacggtgagactccgggcttacttcaacacgcccggtttacccgtgtgtcaagaccacctagagttctgggaagcggtcttcacaggtctcacacatattgatgctcacttcctctcccagacgaagcaaggaggagacaacctcgcgtatctaacggcctatcaggccacagtatgcgctagagcaaaagccccccctccttcgtgggacgtgatgtggaaatgtctaactaggctcaaacctacactaactggtcctacccccctcctgtaccgcttgggtgccgtgaccaacgaggttaccctgacgcaccctgtgacgaaatatatcgccacgtgcatgcaggccgacctcgaggtcatgacgagctcatgggtcctggcagggggggtgctagccgccgtggcagcttactgcctggcgaccggctgcatttctatcattggccgcttacacctgaataatcaggtagttgtggcccctgacaaagaaatcttatatgaggcctttgatgagatggaagaatgcgcctccaaagccgctctcattgaggaagggcagcggatggcggagatgctcaagtctaagatacaaggcctcctacaacaggccacaaaacaggcccaagacatacagccagctgtacagtcatcatggcccaagcttgaacaattttgggccaaacacatgtggaacttcatcagtggcatacagtacctggcgggactctccaccctaccgggaaatcccgcagtggcatcaatgatggctttcagcgccgcattgactagtccactacccaccagcactaccatcctcttgaacatcatggggggatggttggcctcccagattgccccccctgccggagctactggcttcgttgtcagtggtctagtgggggctgccgtcggaagtataggcctgggtaagatactggtggacgttttggccgggtacggtgcaggcatttcaggggccctcgtagcttttaagatcatgagcggcgagaagcccacggtagaggatgccgtgaatctcctgccttctatcctgtctcctggcgccttggtagtgggagtcatctgtgcagcaatcttgcgccgccacgtcggccagggagagggggcagtccagtggatgaacaggctgatcgcctttgcctccagaggaaaccatgttgcccctacccactacgtgacggagtctgacgcctcgcagcgcgtgatacaggtgctgagctcactcacaattaccagcttacttaggagactacatgcctggatcactgaagattgcccagtcccatgttcggggtcttggctccgggacatttgggattgggtttgttccattctcacagactttaagaactggctgtcttcaaaattgctccccaaaatgcccggccttcccttcatctcttgccaaaagggatacaggggtgtatgggctggcacgggagtcatgactactcggtgtccgtgcggggcaaacatctcgggccatgtccgcatgggcaccatgaaaataacaggcccgaagacctgcttgaacctgtggcagggaaccttccccattaactgttacacggaagggccttgcgtgccaaaaccccctcctaattataagaccgcaatttggagggtggcagcgtccgagtacgttgaggtcacacagcatggctctttctcgtacataacggggttaaccagtgacaaccttaaggtcccttgccaggtaccggctccagaattcttctcttgggtggatggggtgcaaatacaccgattcgcccccattccaggtcccttctttcgggatgaggtaacgttcactgtaggcctcaattcctttggggtcggctctcagcttccttgcgatcctgagccggacaccgaggtattagcctccatgttgacagacccgtcccacattaccgcggaggcggcagccaggcggttggccaggggatctcccccttcacaggccagctcttcagcaagccagctctccgctccatctttgaaggctacctgtaccacccataagatggcatatgattgtgagatggtggatgctaacctttccaggggaggcgatgtgacccggattgagtccgactctaaggtgatcgttctcgactctcttgattccatgactgaggtagacgatgatcgtgagccttctgtaccatcagagtacttgatcaggaggaaaaagtttccaccggcactacctccttgggctcgtccggactacaaccctcctacgatcgagatatggaagaggccgggctatgaaccacccactgtcctaggctgtgcccttcccccttcacttcaagcgccggtgcccccacctcggaggcgccgcgccaaagtcctgactcaggacaatgtggagggggtcctcagggagatggcggacaaagtgctcagccctctccaagaccacaatgactccgggcactccactggagcagataccggaggagacagcgcccagcagccctctgacgagactgctgcttcagaaacgggatcactgtcctccatgcctccccttgagggagagccgggggaccctgacctggagtttgaaccagcgggatccgctcccccttccgagggggagtgtgaggtcattgattcggactctaagtcgtggtccacagtctctgatcaagaggatgctgttatctgctgctccatgtcatactcctggacaggggccctcataacaccatgtgggcccgaggaggagaagttgccaatcaaccctctgagtaattcgctcatgcgattccacaacaaggtgtactccacaacatcgaggagtgcttctctgagggcaaagaaggtgacctttgacagggtgcaggtgctggacgcacactatgactcagtcttgcaggacgttaagcaggccgcctctaaggttagtgcgaggctcctctcagtagaggaagcctgcgcgctgaccccgccccactccgccaagtcacggtacggatttggggcaaaggaggtgcgcagcttatccaggagggccgtcaaccacatccggtccgtgtgggaggacctcctggaagaccaacatactccaattgacacaactatcatggccaaaaatgaggtgttctgtgttgatcccacaaaaggcgggaaaaagccagcccgcctcatcgtataccccgaccttggggtcagggtgtgcgaaaagatggccctctatgacatcgcacaaaagcttccccaggcaataatggggccatcatatgggttccagtactctcctgcagaacgggtcgattttctcctcaaagcttggggaagtaagaaagacccaatggggttttcatatgacacccgctgctttgactcaaccgtcacggagagggacataagaacagaagaatccatatatcaggcttgttccctgcctcaagaggccagaactgtcatacactcgctcactgagagactctacgtaggagggcccatgacaaacagcaaagggcaatcctgcggttacaggcgttgccgcgcaagcggtgttttcactaccagcatggggaataccatgacatgttacatcaaagcccttgcagcatgcaaagctgcagggatcgtggaccccgttatgctggtgtgtggagacgacctggttgtcatctcagagagccaaggcaacgaggaggacgagcggaacctgagagctttcacggaggctatgaccaggtattctgccccccccggtgaccttcccagaccggaatatgacttggagcttataacatcttgctcctcaaacgtatcggtagcgctggactctcggggtcgccgccggtacttcctaaccagagaccctaccactccaatcacccgagccgcttgggaaacagtaagacactcccccgtcaattcttggctgggcaacatcatccaatacgcccctacaatctgggtccggatggtcataatgacccacttcttctccatactattggcccaggatactctgaaccaaaatctcaattttgagatgtatggggcagtatattcggtcaatccattagacctaccagccattattgagaggctacatgggcttgaggccttttcactgcacacatactctccccacgaactctcacgggtggcagcaactctcagaaaacttggagcgcctccccttagagcgtggaagagtcgggcacgtgccgtgagggcctcactcatcgcccagggggggagggcggccatctgtggtcgctacctcttcaactgggcggtgaagacaaagctcaaactcactccattgcccgaggcgcgccgcctagatttatctgggtggttcaccgtgggcgccggcgggggcgacatctttcacagcgtgtcgcatgcccgaccccgcctattactcctttgcctactcctacttagcgtaggagtaggcatctttttactccccgctcggtag

SEQ ID NO: 732 - DNA, 9406 bp, Hepatitis C Virus
cactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggataaacccactctatgtccggtcatttgggcgtgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaataaccaaaagaaacataaaccgccgcccacaggacgttaagttcccgggtggcggtcagatcgttggcggagtttacttgctgccgcgcaggggccccaggttgggtgtgcgcgcgacaaggaagacttctgagcgatcccagccgcgtgggaggcgccagcccatcccgaaagatcggcgctccaccggcaagtcctggggaaagccaggatatccttggcctctgtacggaaacgagggttgcggctgggcaggttggctcctgtccccccgcgggtctcgtcctacttggggccccactgacccccggcatagatcacgcaatttgggcaaagtcatcgataccattacgtgtggttttgccgacctcatggggtacatccctgtcgttggcgccccggtaggaggcgtcgccagagctctggcacacggtgttagggtcctggaagacgggataaattacgcaacagggaatttgcccggttgctctttttctatcttcttgcttgctcttctgtcgtgcgtcacagtgccagtgtctgcagtggaggtcaggaacatcagttctagctactacgccactaatgattgctcgaacaacagcattacctggcagctcgctaacgcagttctccaccttcctggatgtgtcccatgtgagaatgacaatggcactttgcgctgttggatacaagtaacacctaatgtggctgtgaaacatcgcggtgcactcactcacaacctgcgaacacacgtcgacatgatcgtaatggcagctacggtctgctcggccttgtacgtgggagatgtgtgcggggccgtgatgatcgtgtcgcaggctctcatagtatcgccggaacgccacaacttcacccaagagtgcaactgttccatctaccagggccatatcaccggccaccgcatggcatgggacatgatgctaaactggtcaccaactcttaccatgatcctcgcctacgctgctcgtgttcctgagctagtccttgaggttgtcttcggcggccactggggtgtggtgtttggcttggcctatttctccatgcagggagcgtgggccaaagtcattgccatcctccttcttgtcgcgggagtggatgcaaccacctactccaccggcgcgcaagcgggccgtggtgcttcggggattgctaacctctttacccctggtgccaagcagaacatccagttaatcaacaccaacggcagctggcacataaaccggaccgccctcaattgcaatgacagcttacagacgggtttccttgcttccctgttctacaccaaaagttttaacagctctggctgccccgagcgcatgtcctcctgccgcgggctggacgattttcgcatcgggtggggaaccctggaatacgagaccaaagttaccaacgatgaggacatgaggccgtactgctggcactaccctccgaagccttgcggtatcgtctcggctaagacggtttgcgggccggtctactgttttacccccagccctattgtcgtgggcaccactgacaagcagggcgtacccacctataactggggggataatgagaccgatgtcttcctactgaatagcacaagacccccgcaaggagcttggtttggctgcacttggatgaacgggactgggttcactaagacgtgcggagcaccaccttgccgcatcaggagggacttcaacagcactctcgacctattgtgccccacagactgctttaggaagcatccagatgctacctatattaagtgtggagcagggccttggttgacccccaggtgcctggtagaatacccttatagactgtggcattatccgtgcaccgtgaatttcaccatcttcaaggtgcggatgtatgtagggggggtggagcatcgattgtccgcagcatgtaacttcacgcgcggagaccgttgcagactggaagatagggataggggtcagcaaagtccactgctgcattccaccactgagtgggcggtgttgccatgctccttctccgacctaccggcactatccactggcctattgcacctccaccaaaacatcgtggacgtgcagtacctctatggactcactccggctattacaagatacattgtgaagtgggaatgggtggtcctcctcttcttgttgttggcagacgccagggtctgtgcatgcctttggatgcttatcatactgggccaagccgaggcggcgcttgagaagctcatcatcttgcactccgctagcgctgctagtgccaatgggccgatgtggttcttcatcttcttcatcgcggcctggtacttaaagggcagggtggtccctgtggccacgtactctgttctcggcttatggtcctttctcctcctagttctggccttaccacagcaggcctatgccttggacaccgctgaacaaggggaactagggctggtcatattagcaatcatatccatttttactcttaccccagcatacaagattctcctgagccgttcagtgtggtggctgtcctacatgctggtcttggccgaggcccagattcagcagtgggttccccccctggaggcccggggggggcgtgacgggatcatttgggtggctgtcatcctacacccacgcctggtgtttgagatcacgaaatggttgctagcaatcctggggcctgcttacctcctaagagcgtctctgctacggataccatactttgtgagggcccacgctctgctacgagtgtgtaccctggtgagacgccttgcaggagctaagtacatccaggtgctgttgctcaccataggcaggtggaccggcacttacatctatgaccacctctcccctttatcaacctgggcagctcagggtttgcgggacctggcagtcgccgtggagcccgtggtgttcagcccaatggagaagagggtcattgtatggggagctgagacagtggcatgtggagacatcctgcatggcctcccggtttccgcgaggctaggcagggaagttttgcttggccctgccgatagctacacctcgaaggggtggaagcttttagctcccattactgcttacacccagcagactcgcggtctcctgggcgccattgtggtcagcctaacgggccgcgacaaaaatgagcaggctgggcaggtccaggttctgtcctccgtcacacaatctttcttggggacatctatttcgggggtcctttggacagtatatcatggggctggtaataagaccttggctggccccaaaggaccagtcactcagatgtacaccagcgcggagggggacctcgtgggatggcctagcccccctggtactaagtcattagacccctgtacctgcggggccgtggacctctacttggtcacccgaaacgctgacgtcattccggtccggaggaaagatgaccgacggggcgcactactctcgccaaggcccctctcaaccctcaaaggatcatccggcggacccgtgctctgctctaggggacacgccgtgggcttattcagagcggccgtgtgtaccaggggtgtggccaaatccattgacttcatccccgtcgaatctctcgacatcgccgcacggacgcccagtttctctgacaacagtacgccaccagctgtgccccagtcttaccaggtgggctacttgcatgcaccaacaggcagcgggaagagcaccaaggttcctgccgcatatgccagtcaggggtataaagtacttgtactaaatccctctgtcgcggccacacttggttttggggcctacatgtccaaagcccacgggattaaccccaacatcagaactggagcacggactgtgaccaccggggaccctatcacctactccacttatggcaagtttctcgcggatggaggctgctcagctggcgcctatgacatcatcatatgcgacgaatgccattcagtggacgctactaccatccttggcattggaaccgtcctcgaccaggctgagaccgcaggtgccaggctagtggttttagccacagccacgccccccggtacggtgacaactccccacagtaacatagaggaggtagccctcggtcatgagggcgagatccctttttatggcaaggctattcccctagctttcatcaaggggggcagacacctaatcttttgccactcaaagaagaagtgcgatgagcttgcatcagcccttcggggcatgggtgtcaacgccgttgccttctacaggggtctcgacgtctccgttataccaactcaaggagacgtggtggtcgtcgccactgatgccctaatgactggatacactggcaactttgactctgtcatcgactgcaacgttgcagtcactcagattgttgactttagcctagacccaacctttaccatcaccactcaaaccgtccctcaggacgctgtctctcgcagtcaacgtagagggagaactgggagagggcgactgggcatttacagatacgtctcgtcaggcgagaggccgtctgggatgttcgacagcgtagtgctctgcgagtgctatgatgccggggcagcctggtacgagcttacgccttctgagactacggtgagactccgggcttattttaacacgcccggtttacccgtgtgtcaagaccacctagagttctgggaagcggtcttcacaggtctcacacatattgatgcccacttcctctcccagacgaagcaaggaggagacaactttgcgtatttaacggcctatcaggccacagtatgcgctagggcaaaagcccctcctccttcgtgggacatgatgtggaaatgtctaactaggctcaaacctacactgactggtcctacccccctcctgtaccgcttgggcgccgtgaccaacgaggttaccctgacgcaccctgtgacgaaatatatcgccacgtgcatgcaggctgacctcgagatcatgacgagctcatgggtcctggcagggggggtgctagccgccgtggcagcttactgcctggcgaccggctgcatttccatcattggccgcttacacctgaatgatcaggcagttgtggcccctgacaaggaaatcttatatgaggcctttgatgagatggaagaatgcgcctccaaagccgctctcattgaggaagggcagcggatggcggagatgctcaagtctaagatacaaggcctcctacaacaggccacaaaacaggcccaagacatacagccagttgtacagtcatcatggcccaagcttgaacaattttgggccaaacacatgtggaacttcatcagtggcatacagtacctggcgggactctccaccctaccaggaaatcccgcagtggcatcaatgatggctttcagcgccgcattgactagtccactgcccaccagcaccaccatcctcttgaacatcatgggtggatggttggcctcccagattgccccccctgctggagctactggcttcgttgtcagtggtctagtgggggctgccgtcgggagtataggcctgggtaagatactggtggacgttttggccgggtacggtgcaggcatttcaggggccctcgtagcttttaagatcatgagcggcgagaagccctcggtagaagatgccgtgaatctcctgccttctatcctgtctcctggcgccttggtagtgggagtcatctgtgcagcaatcttgcgccgccacgtcggccagggagaaggggcagtccagtggatgaacaggctgatcgcctttgcctccagaggaaaccatgttgcccctacccactacgtgacggagtctgacgcctcgcagcgcgtgatacaggtgctgagctcactcacaattaccagcttgctcaggagactacatacctggatcactgaagattgcccagtcccatgttcggggtcctggctccgggacatttgggattgggtttgttccattctcacagactttaagaactggctgtcttcaaaattgctccccaaaatgcccggccttcccttcatctcttgccaaaagggatacaggggtgtatgggctggcacgggagtcatgactactcggtgtccatgcggagcaaacatctcgggccatgtccgcttgggcaccatgaaaataacaggcccgaagacctgcttgaacctgtggcagggaaccttccccattaactgttacacggaagggccttgcgtgccaaaaccccctcctaattataagaccgcaatttggagggtggcagcatcggagtacgttgaggtcacacagcatggctctttctcgtacataacggggttaaccagtgacaaccttaaggtcccttgccaggtaccggctccagaattcttctcttgggtggatggggtgcaaatacaccgattcgcccccaatccaggtcccttctttcgggatgaggtaacgttcactgtaggcctcaattcctttgtggtcggctcccagcttccttgcgatcctgagccggacaccgaggtattagcctccatgttgacagacccgtcccacattaccgcggaggcggcagccaggcggttggccaggggatctcccccttcacaggccagctcttcagcaagccagctctccgctccatctttgaaggctacctgtaccacccataagatggcatatgattgtgacatggtggatgctaaccttttcatgggaggcgatgtgacccggattgagtccgactctaaggtgatcgttctcgactccctcgattccatgactgaggtagacgatgatcgtgagccttctgtaccatcagagtacttgatcaggaggaagaagtttccaccagcactacctccctgggctcgtccggactacaaccctcctacgatcgagatatggaagaggccgggctatgaaccacccactgtcctaggctgtgcccttcccccttcacctcaagcgccggtgcccccacctcggaggcgccgcgccaaagtcctaactcaggacaatgtggagggggttctcagggagatggcggacaaagtgctcagccctctccaagaccacaatgactccgggcactccactggagcagataccggaggagacagcgcccagcagccctctgacgagactgctgcttcagaaacgggatcactgtcctccatgcctccccttgagggagagccgggggaccctgacctggagtttgaaccagcgggatccgctcccccttccgagggggagtgtgaggtcattgattcggactctaagtcgtggtccacagtctctgatcaagaggattctgttatctgctgctccatgtcatactcctggacgggggccctcataacaccatgtgggcccgaggaggagaagttgccaatcaaccctctgagtaattcgctcatgcgattccataacaaggtgtactccacaacatcgaggagtgcttctctgagggcaaagaaggtgacctttgacagggtgcaggtgctggacgcacactatgattcagtcttgcaggacgttaagcaggccgcctctaaggttagtgcgaggctcctctcagtagaggaagcctgcgcgttgaccccgccccactccgccaagtcacggtacggatttggggcaaaggaggtgcgcagcttatccaggagggccgtcaaccacatccggtccgtgtgggaggacctcctggaagaccaacaaactccaattgacacaactatcatggccaaaaatgaggtgttctgtgttgatcccacaaaaggcgggaaaaagccagcccgcctcatcgtgtaccccgaccttggggtcagggtgtgcgaaaagatggccctctatgacatcgcacaaaagcttccccaggcaataatggggccatcatatgggttccagtactctcctgcagaacgggttgattttctcctcaaagcttggggaagtaagaaagacccaatggggttttcatatgacacccgctgctttgactcaaccgtcacggagagggacataagaacagaagaatccatatatcaggcttgttccttgcctcaagaggctagaactgtcatacactcgctcactgagagactctacgtaggagggcccatgacaaacagcaaagggcaatcctgcggttacaggcgttgccgcgcaagcggtgttttcactaccagcatggggaataccatgacatgctacatcaaagcccttgcagcatgcaaagccgcagggatcgtggaccctattatgctggtgtgtggagacgacctggtcgtcatctcagagagccaaggcaacgaggaggacgagcggaacctgagagctttcacggaggctatgaccaggtattctgccccccccggtgaccttcccagaccagaatatgacttggagcttataacatcttgctcctcaaacgtatcggtagcgctggactctcggggtcgccgccggtacttcctaaccagagaccctaccactccaatcacccgagccgcttgggaaacagtaagacactcccccgtcaattcttggctgggcaacatcatccaatacgcccctacaatctgggtccggatggtcataatgacccacttcttctccatactattggcccaggacactctgaaccaaaatctcaattttgagatgtatggggcagtatattcggtcaatccattagacctaccagccattattgagaggctacatgggcttgaggccttttcactgcacacatactctccccacgaactctcacgggtggcagcgactctcagaaaacttggagcgcctccccttagagcgtggaagagtcgggcacgtgctgtgagggcctcactcatcgcccaaggggggagggcggccatctgtggccgctacctcttcaactgggcggtgaagacaaagctcaaactcactccattgcccgaggcgcgccgcctggatttatctgggtggttcaccgtgggcgccggcgggggcgacatctttcacagcgtgtcgcatgcccgaccccgcctattactcctttgcctactcctactcagcgtaggagtaggcatctttttactccccgctcggtag

SEQ ID NO: 733 - DNA, 9406 bp, Hepatitis C Virus
cactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggacaaacccactctatgtccggtcatttgggcgtgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacacaaaccgccgcccacaggacgtcaagttcccgggtggcggtcagatcgttggcggagtttacttgctgccgcgcaggggccccaggttgggtgtgcgcgcgacaaggaagacttccgagcgatcccagccgcgtggaagacgccagcccatcccgaaagatcggcgctccaccggcaagtcctggggaaagccaggatatccttggcctctgtacggaaacgagggctgcggctgggcaggttggctcctgtccccccgcgggtctcgtcctacttggggccccaacgacccccggcacagatcacgcaacttgggtaaagtcatcgatacctttacgtgtggttttgccgacctcatggggtacatccctgtcattggcgccccggtaggaggcgtcgccagagctctggcacacggtgttagggtcctggaagacgggataaattacgcaacagggaatctacctggttgctccttttctatcttcttacttgctcttctgtcatgcgtcacagtgccagtgtctgcagtggaagtcaggaacatcagttctagctactatgccactaacgattgctcgaacaacagcatcacctggcagctcactaacgcagttctccaccttcctggatgcgtcccatgtgagaatgataatggcaccttgcgctgctggatacaagtaacacccaatgtggctgtgaaacaccgcggcgcactcactgacaacctgcgaacgcacgtcgacatgatcgtaatggcagctacggtctgttcggccttgtacgtgggagacgtgtgcggggccgtgatgatcgtgtcgcaggctttcataatatcgccagagcgccacaacttcacccaagagtgcaattgttccatctaccaaggtcatatcaccggccatcgcatggcatgggacatgatgttaaattggtcaccaactcttaccatgatcctcgcctacgctgctcgtgttcctgagctagtccttgaaattgtcttcggcggccactggggtgtggcgtttggcttggcctatttctccatgcagggagcgtgggccaaagtcattgccatcctccttcttgtcgcgggagtggatgcaagcacctattccaccggcgcacaagcgggtcgtgccacttcggggctcactggcatctttagccctggtcctcagcagaacatccacttaatcaataccaatggcagctggcacataaacaggactgctctcaattgcaatgacagcttgcagacgggattcatcgcttccctgttttataccaggaaatttaacagctccggctgccccgagcgcttgtcttcctgccgcaggctggacgattttcgcatcgggtggggaactttggaatacgagaccaatgtcaccaatgatgaggacatgaggccgtactgctggcattaccctccgaagccttgcggtatcgtctcggctaggacggtttgcgggccggtctactgttttactcctagccctgttgtcgtgggcaccactgacaggcagggcgtacccacctatacctggggggaaaacgagaccgatgtctttctgctaaatagcacaagacccccgcaaggagcttggttcggctgcacttggatgaacgggactgggtacactaagacgtgcggagcaccaccttgccgcattaggagagacttcaacagtactctcgatctattgtgccccacagactgttttaggaagcacccaggtgctacctatcttaagtgcggagctgggccttggttgacccccaggtgcctgatagaatacccttataggctgtggcattatccgtgcactgtaaatttcaccatcttcaaggtgcggatgtatgtagggggggtggagcatcgattgtccgcagcatgtaacttcacgcgcggagaccgctgcagattagaagacagggataggggtcagcagagtccactgctgcactccaccactgagtgggcagtgttgccatgctccttctccgacctaccggcattatccactggcctattgcacctccaccaaaacatcgtggacgtgcagtatctctatggactttctccggctcttacaagatacatcgtgaggtgggaatgggtggtcctccttttcttgttgttggcagacgccagggtctgtgcatgcctttggatgctcatcatactgggccaagccgaggcggcgcttgagaagctcatcatcttgcactccgctagcgccgctagtgccaatgggccgctgtggttcttcatcttctttacagcggcctggtacttaaagggcagggtggtccccgcggccacatactctgtactcggcttgtggtcctttctccttctggtcctggccctaccacagcaggcttatgccctggacgccgctgaacaaggggaactagggctggttttattagtaatcatatccatctttactcttaccccagcatacaagattctcctcagccgttcagtgtggtggctgtcctacatgctggtcttggccgaggcccagattcagcaatgggtcccccccctcgaggcccgaggggggcgtgacgggatcatctgggtggctgtcattctacacccacgccttgtgtttgagatcacgaaatggttgttagcaatcctggggtctgcccacctccttaaagcgtctctgctacgggtaccatactttgtgagggctcacgctctgctacgagtgtgcaccctggtgagacacctcgcaggagctaggtacatccagatgctgttgatcaccatgggcaggtggaccggcacttacatctatgaccacctctcccctttatcaacttgggcagctcagggtttgcgggacctggcagtcgccgtggagcctgtgatcttcagcccaatggagaagaaggtcattgtgtggggggctgagacagtggcgtgtggagacatcctgcatggcctcccggtttccgcgaggctaggtagggaagttctgctcggccctgccgatagctacgcctcgaaggggtggaagctcctagcccccattactgcttacactcagcagactcgtggtctcctgggtgccatcgtggtcagcctaacgggccgcgacaaaaatgagcaggctgggcaggtccaggttctgtcctctgtcacacaatctttcttggggacatctatttcgggggtcctctggacagtataccacggggctggtaataagaccttggctggccccaaaggaccagtcactcagatgtacaccagcgcagagggggacctcgtgggatggcctagcccccccgggactaagtcattagacccctgtacctgcggggccgtggacctctacctggtcacccgaaacgctgatgtcattccggtccggaggaaagatgaccggcggggtgcactactctcgccaaggcctctctcaaccctcaaaggatcatccggcggacccgtgctctgccctaggggacacgccgtcggcttgttcagagcggccgtgtgtgccaggggtgtggccaagtctattgacttcatccctgttgaatctctcgacatcgccacacggacgcccagcttctctgacaacagcacgccaccagctgtgccccagtcttaccaggtgggctacttgcacgcaccaacgggcagcgggaagagcaccaaggtccctgccgcatatgccagtcaggggtacaaagtactcgtactaaacccctctgtcgcggctacacttggttttggggcctacatgtccaaagcccatgggatcaaccccaacatcagaaccggagtacggactgtgaccaccggggaccctatcacttattccacttatgccaagttcatcgcagacggaggctgctcagctggcgcctatgacgtcatcatatgcgacgaatgccattcagtggacgccactaccattcttggcattggaacagtcctcgaccaggctgagaccgcaggtgtcaggctagtggttttagccacagccacgcctcccggtacggtgacaactccccacagtaacatagaggaggtggccctcggtcatgagggcgagatccctttctatggcaaggctatccccctagcttacatcaaggggggcaggcacctgatcttttgtcattcaaaaaagaagtgcgacgagctcgcagcagcccttcggggcttgggtgtcaatgccgttgcctactacaggggtctcgacgtctccgttataccaactcaaggagacgtggtggtcgtcgccaccgacgccctaatgactggatacaccggtgactttgactctgtcatcgactgcaatgttgcagttactcagattgttgactttagcctagacccaacttttaccatcactactcaaaccgtccctcaggacgctgtctcccgtagtcaacgtagagggagaactgggagggggcgactgggcacttacaggtatgtctcgtcaggcgagagaccgtctgggatgttcgacagcgtagtgctctgtgagtgctatgattccggggcagcctggtacgagcttacgcctgctgagactacggtgagactccgggcatatttcaacacgcccggtttacccgtgtgtcaagaccacctggagttctgggaagcggtctttacaggtctcacacacattgatgcccacttcctctcccagacaaagcaaggaggagaaaactttgcgtatctaacggcctaccaggccacagtatgcgctagggcaaaggcccctcctccttcgtgggacgtgatgtggaagtgtctaactaggctaaaacctacactgactggtcctacccccctcctgtaccgcttgggtgccgtgaccaacgaggttaccctgacgcaccccgtgacgaaatacatcgccacgtgcatgcaggctgacctcgaggtcatgacaagcacatgggtcctagcagggggggtgctagccgccgtggcagcttactgcttggcgaccggctgcatttccatcattggccgcatacacctgaatgatcgggtagttgtgacccctgacaaggaaatcttatatgaggcctttgatgagatggaagaatgcgcctccaaagccgccctcattgaggaagggcagcggatggcggagatgctcaagtctaagatacaaggcctcctacaacaggccacaagacaagcccaagacatacagccagccatacagtcatcatggcccaagcttgaacaattttgggccaaacacatgtggaacttcatcagcggcatacagtacctggcgggactctccactctaccgggaaatcccgcagtggcatcaatgatggctttcagcgccgcattgactagcccactacccaccagcaccaccatcctcttgaacatcatggggggatggttggcctcccagattgccccccctgccggggccactggcttcgttgtcagtggtctagtgggggcggccgttggaagtataggcctaggtaagatactggtggacgttttggccgggtacggtgcaggcatttcaggggccctcgtagcttttaaaatcatgagcggcgagaagcccacggtagaagatgttgtgaatctcctacctgctattctgtctcctggcgctttggtagtgggagtcatctgtgcggcaatcttgcgccgccacgtcggccagggagagggggcggtccagtggatgaacagactgatcgcctttgcctccagaggaaaccatgttgcccccacccactacgtggcggagtctgacgcctcgctgcgcgtaacgcaggtgctaagttcactcacaatcaccagcctacttaggagactacatgcctggatcactgaagattgcccagtcccatgttcggggtcttggctccgggacatttgggattgggtttgttccattctcacagactttaagaactggctgtcttcaaaattgctccccaaaatgcccggccttcccttcatctcttgccaaaagggatacaggggtgtatgggctggcacgggagtcatgactactcggtgtccatgcggagcaaacatctcgggccatgtccgcatgggtaccatgaaaataacaggcccgaagacctgcttgaacctgtggcagggaaccttccccatcaattgttacacagaagggccttgcgtgccaaaaccccctcctaattataagaccgcaatttggagggtggcagcgtcggagtacgttgaggtcacgcagcatggctctttctcgtacgtaacggggttaaccagtgacaaccttaaggtcccttgccaggtaccagctccagaattcttctcttgggtggacggggtgcaaatacatcgattcgcccccactccaggtcccttctttcgggatgaggttacgttcaccgtaggcctcaattcctttgtggtcggctctcagctcccttgcgaccctgagccggacaccgaggtattggcctccatgctgacagacccgtcccacattaccgcggaggcggcagccaggcgattggccaggggatcccccccctcacaggccagctcttcagcgagccagctttccgccccgtccttgaaggctacctgtaccacccataagatggcatatgattgtgacatggtggatgctaaccttttcatgggaggcgatgtgacccggattgagtccgactccaaggtgatcgttctcgactccctcgattccatgaccgaggtagaggatgatcgtgagccttctgtaccatcagagtacttgatcaggaggagaaagttcccaccggcactacctccctgggcccgtccagactacaaccctcctatgatcgagacatggaaacggccgggctatgaaccacccactgtcctaggctgtgccctcccccccacacctcaagcgccagtgcccccacctcggaggcgccgcgccaaagtcctgactcaggacaatgtggagggggtcctcaaggagatggcggacaaggtgttcagccctctccaagaccacaatgactccggtcactccactggagcggataccggaggagacagcgtccagcagccctctgacgagactgccgcttcggaaacgggatcactgtcctccatgcctccccttgagggagagccgggggaccctgacctggagtttgaaccagcaggatccgctcccccttctgagggggagtgtgaggttattgattcagactctaaatcgtggtccacagtctctgatcaagaggactctgttatctgctgctccatgtcgtactcctggacgggggccctcataacaccatgtgggcccgaggaggagaagttgccgatcaaccctctgagtaattcgctcatgcggttccataacaaggtgtactccactacctcgaggagtgccactctgagggcaaagaaggtgacctttgacagggtgcaggtgctggacgcacactatgactcagtcttgcaggacgttaagcgggccgcctctaaggttagtgcgaggctcctctcagtagaggaagcctgcgcgctgaccccgccccactccgccaaatcacggtacggatttggggcaaaggaggtgcgcagcttatccaggagggccgttaaccacatccggtccgtgtgggaggacctcctggaagaccaacatactccaattgacacaaccatcatggccaaaaatgaggtgttctgtgttgatcccactaagggtgggaaaaagccagctcgcctcatcgtataccccgaccttggggtcagggtgtgcgaaaagatggccctctatgacattgcacaaaagcttcccaaggcagtgatggggccatcctatgggttccaatactctcccgcagaacgggtcgatttcctcctcaaagcttggggaagtaagaaggacccaatggggttctcgtatgacacccgctgctttgactcaaccgtcacggagagggacataagaccagaagaatccatatatcaggcctgttctctgcctcaagaggctagaactgtcatacactcgctcactgagagactctacgtaggagggcccatgacaaacagcaagggacaatcctgcggttacaggcgttgccgcgcaagcggtgttttcactaccagcatggggaacaccatgacatgctacatcaaagcccttgcagcgtgtaaagctgcagggattgtggaccccattatgctggtgtgtggagacgacctggtcgtcatctcagagagccaaggtaacgaggaggacgagcgaaacctgagagctttcacggaggctatgaccaggtattccgcccctcccggtgaccttcccagaccagaatatgacttggagcttataacatcctgctcctcaaacgtatcggtagcgctggactctcggggtcgccgccggtacttcctaaccagagaccctaccactccaatcacccgagctgcttgggaaacagtaagacactcccctgtcaattcttggctgggtaacatcatccaatacgcccctacaatctgggtccggatggtcataatgacccacttcttctccatactattggcccaggacaccctgaaccagaatctcaattttgagatgtacggggcagtatactcggtcaatccattagacctaccggccataattgaaaggctacatgggcttgaggccttttcactgcacacatactctccccacgaactctcgcgggtggcagcgactctcagaaaacttggagcgcctccccttagagcgtggaagagtcgggcgcgtgctgtgagggcctcactcatcgcccagggagggagggcggccatttgtggccgctacctcttcaactgggcggtgaagacaaagctcaaactcactccattgcccgaggcgagccgcctggatttatccggatggttcaccgtgggcgccggcgggggcgacatctttcacagcgtgtcgcatgcccgaccccgcctattactcctttgcctactcctactcagcgtaggggtaggcatctttttactccccgctcggtag

SEQ ID NO: 734 - DNA, 9406 bp, Hepatitis C Virus
cactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggacaaacccactctatgtccggtcatttgggcgtgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacacaaaccgccgcccacaggacgtcaagttcccgggtggcggtcagatcgttggcggagtttacttgctgccgcgcaggggccccaggttgggtgtgcgcgcgacaaggaagacttccgagcgatcccagccgcgtggaagacgccagcccatcccgaaagatcggcgctccaccggcaagtcctggggaaagccaggatatccttggcctctgtacggaaacgagggctgcggctgggcaggttggctcctgtccccccgcgggtctcgtcctacttggggccccaacgacccccggcacagatcacgcaacttgggtaaagtcatcgatacctttacgtgtggttttgccgacctcatggggtacatccctgtcattggcgccccggtaggaggcgtcgccagagctctggcacacggtgttagggtcctggaagacgggataaattacgcaacagggaatctacctggttgctccttttctatcttcttgcttgctcttctgtcatgcgtcacagtgccagtgtctgcagtggaagtcaggaacatcagttctagctactatgccactaacgattgctcgaacaacagcatcacctggcagctcactaacgcagttctccaccttcctggatgcgtcccatgtgagaatgataatggcaccttgcgctgctgggtacaagtaacacccaatgtggctgtgaaacaccgcggcgcactcactgacaacctgcgaacgcacgtcgacatgatcgtaatggcagctacggtctgttcggccttgtacgtgggggacgtgtgcggggccgtgatgatcgtgtcgcaggctttcataatatcgccagagcgccacaacttcacccaagagtgcaattgttccatctaccaaggtcatatcaccggccatcgcatggcgtgggacatgatgttaaattggtcaccaactcttaccatgatcctcgcctacgctgctcgtgttcctgagctagtccttgagattgtcttcggcggccactggggtgtggcgtttggcttggcctatttctccatgcagggagcgtgggccaaagtcattgccatcctccttcttgtcgcgggagtggatgcaagcacctattccaccggcgcacaagcgggtcgtgccactttggggctcactggcatctttagccctggtgctcagcagaacatccagttaatcaataccaatggcagctggcacataaacaggactgctctcaattgcaatgacagcttgcagacgggattcatcgcttccctgttttataccaggaggtttaacagctccggctgccccgagcgcttgtcttcctgccgcaggctggacgattttcgcatcgggtggggaactttggaatacgagaccaatgtcaccaatgatgaggacatgaggccgtactgctggcattaccctccgaagccttgcggtatcgtctcggctaggacggtttgcgggccggtctactgttttactcctagccctgttgtcgtgggcaccactgacaggcagggcgtacccacctatacctggggggaaaacgagaccgatgtctttctgctaaatagcacaagacccccgcaaggagcttggttcggctgcacttggatgaacgggactgggtacacaaaaacgtgcggagcaccaccttgccgcattaggagagacttcaacagtactctcgatctattgtgccccacagactgttttaggaagcacccaggtgctacctatcttaagtgcggagctgggccttggttgacccccaggtgcctgatagaatacccttataggctgtggcattatccgtgcactgtgaatttcaccatcttcaaggtgcggatgtatgtagggggggtggagcatcgactgtccgcagcgtgtaacttcacgcgtggagaccgctgcggattagaagacagggataggggtcagcagagtccactgctgcactccaccactgagtgggcagtgttgccatgctccttctccgacctaccggcattatccactggcctattgcacctccaccaaaacatcgtggacgtgcagtacctttatggactttctccggcccttacaagatacatcgtgaggtgggaatgggtggtcctccttttcttgttgttggcagacgccagggtctgtgcatgcctttggatgctcatcatactgggccaagccgaggcggcgcttgagaagctcatcatcttgcactccgctagcgccgctagtgccaatgggccgctgtggttcttcatcttctttacagcggcttggtacttaaagggcagggtggtccctgcggccacatactctgtactcggcttgtggtcctttctcctcctagtcctggccctaccacagcaggcttatgccctggacgccgctgaacaaggggaactagggctggttttattagtaatcatatccatctttactcttaccccagcatacaagattctcctcagccgttcagtgtggtggctgtcctacttgctggtcttggccgaggcccagattcagcaatgggtcccccccctcgaggcccgaggggggcgtgacgggatcatctgggtggctgtcattctacacccgcgccttgtgtttgagatcacgaaatggttgttagcaatcctggggtctgcccacctccttaaagcgtctctcctacgggtaccatactttgtgagggctcacgccctactacgagtgtgcaccctggtgagacacctcgcaggagctaggtacatccagatgctgttgatcaccataggcaggtggaccggcacttacatctatgaccacctctcccctttatcaacttgggcagcccagggattgcgggacctggcggtcgccgtggagcctgtgatcttcagcccaatggagaagaaggtcattgtgtggggggctgagacagtggcgtgtggagacatcctgcatggcctcccggtttccgcgaggctgggtagggaagttctgctcggccctgccgatagctacacctcgaaggggtggaagctcctagcccccatcactgcttacactcagcagactcgtggtctcctgggtgccatcgtggtcagcctaacgggccgcgacaaaaatgagcaggctgggcaggtccaggttctgtcatctgtcacacaatctttcttggggacatctatttcgggggttctctggacagtataccacggggctggtaataagaccttggctggccccaaaggaccagtcactcagatgtacaccagcgcagagggggacctcgtgggatggcctagccccccagggactaagtcattggacccctgtacctgcggggccgtggacctctacctggtcacccgaaacgctgatgtcattccggtccggaggaaagacgaccggcggggtgcactactctcgccaaggcctctctcaaccctcaaagggtcatctggcggacccgtgctctgccctaggggacacgccgtcggcttgttcagagcggccgtgtgtgccaggggtgtggccaagtctattgacttcatccctgttgaaactctcgacatcgccacgcggacgcccagcttctctgacaacagcacgccaccagctgtgccccagtcttaccaggtgggctacttgcacgcaccgacgggcagcgggaagagcaccaaggtccctgccgcatatgccagtcaggggtacaaagtactcgtactaaacccctctgtcgcggctacacttggttttggggcctacatgtccaaagcccatgggatcaaccccaacatcagaaccggagtacggactgtgaccaccggggaccctatcacttattccacttatgccaagttcatcgcagacggaggctgctcagctggcgcctatgacgtcatcatatgcgacgaatgccattcagtggacgccactaccattcttggcattggaacagtcctcgaccaggccgagaccgcaggtgtcaggctggtggttttagccacagccacgcctcctggtacggtgacaactccccacagtaacatagaggaggtggccctcggacatgagggcgagatccctttctatggcaaggctatccccctagcttacatcaaggggggcaggcacctgatcttttgtcattcaaaaaaaaagtgcgacgagctcgcagcagcccttcggggcttgggtgtcaatgccgttgcctactacaggggtctcgacgtctccgtcataccaactcaaggagacgtggtggtcgtcgccaccgacgccctaatgactgggtacaccggtgactttgactctgtcatcgactgtaatgttgcagtcactcagattgttgactttagcctagacccaactttcaccatcactactcaaaccgtccctcaagacgctgtctcccgtagtcaacgtagagggagaactgggaggggacgactgggcacttacaggtatgtctcgtcaggcgagagaccgtctgggatgttcgacagcgtagtgctctgtgagtgctacgattccggggcagcctggtacgagcttacgcctgctgagactacggtgagactccgggcatatttcaacacgcccggtttacccgtatgtcaagatcacctggagttctgggaagcggtctttacaggtctcacacacattgatgcccacttcctctcccagacaaagcaaggaggagaaaactttgcgtatctaacggcctaccaggccacagtatgcgctagggcaaaagcccctcctccttcgtgggacgtgatgtggaagtgtctaactaggctaaaacctacactgactggtcctacccccctcctgtaccgcttgggtgccgtgaccaacgaggttaccctgacgcaccccgtgacaaaatacatcgccacgtgcatgcaggctgacctcgaggtcatgacaagcacatgggtcctagcagggggggtgctagccgctgtggcagcttactgcttggcgaccggctgcatttccatcattggccgcatacacctgaatgatcgggtggttgtgacccctgacaaagaaatcttatatgaggcctttgatgagatggaagagtgcgcctccaaggccgccctcctcgaggaagggcagcggatggcggagatgctcaagtctaagatacaaggcctcctacaacaggccacaagacaagcccaagacatacagccagccatacagtcatcatggcccaagcttgaacaattttgggccaaacacatgtggaacttcatcagcggcatacagtacctggcgggactctccactctaccgggaaatcccgcagtggcatcaatgatggctttcagcgcagcattgactagtccactacctaccagcactaccattctcttgaacatcatggggggatggctggcctcccagattgctccccctgccggggccactggcttcgttgtcagtggtctagtgggggcagccgttgggagtataggcctaggtaagatactggtggacgttttggccgggtacggtgcaggcatttcaggggccctcgtagcttttaaaatcatgagcggcgagaagcccacggtagaagatgttgtgaatctcctacctgccattctgtctcctggcgctttggtagtgggagtcatctgcgcggcaatcttgcgccgccacgttggccagggagagggggcggtccagtggatgaacagactgatcgcctttgcctccagaggaaaccatgttgcccccacccactacgtggcggagtctgacgcctcgctgcgcgtaacgcaggtgctaagttcactcacaatcaccagcctactcaggagactacatgcctggatcactgaagattgcccagtcccgtgttcggggtcttggctccgggacatttgggattgggtttgttccattctcacagactttaagaactggctgtcttcaaaattgctccccaaaatgcccggccttcccttcatctcttgccaaaagggatataggggtgtatgggctggcacgggagtcatgactactcggtgtccatgcggagcaaacatctcgggccatgtccgcatgggtaccatgaaaataacaggcccgaagacctgcttgaacatgtggcagggaaccttccccatcaattgttacacagaagggccttgcgtgccaaaaccccctcctaattataagaccgcaatttggagggtggcagcgtcggagtacgttgaggtcacacagcatggctctttctcgtacgtaacggggttaaccagtgacaaccttaaggtcccttgccaggtaccagctccagaattcttctcttgggtggacggggtgcaaatacaccgattcgcccccactccaggacccttctttcgggatgaggttacgttcaccgtaggcctcaattcctttgtggtcggctcccagctcccttgcgaccctgagccggacaccgaggtattggcctccatgctgacagacccgtcccacatcaccgcggaggcggcagccaggcgattggccaggggatcccccccctcacaggccagctcttcagcgagccagctttctgccccgtccttgaaggctacctgtaccacccataaaatggcatatgactgtgacatggtggatgctaaccttttcatgggaggcgatgtgacccggattgagtccgactccaaggtgatcgttctcgactccctcgattctatgaccgaggtagaggacgatcgtgagccttctgtaccatctgagtacttgatcaggaggaggaagttcccaccggcactacctccttgggcccgtccagactacaaccctcctgtgatcgagacatggaaacggccgggctatgaaccacccactgtcctaggctgtgccctcccccccacacctcaagcgccggtgcccccacctcggaggcgccgcgccaaagttctgactcaggacaatgtggagggggtcctcaaggagatggcggacaaggtgttcagccctccccaagaccacaatgactccggtcactccactggagcggataccggaggagacagcgtccagcagccctctgacgagactgccgcttcagaaacgggatcactgtcctccatgcctccccttgagggagagccgggggatcctgacctggagtttgaaccagcaggatccactcccccttctgagggggagtgtgaggttattgattcagactccaaatcgtggtccacggtctctgatcaagaggactctattatctgctgctccatgtcatactcctggacgggggccctcataacaccatgtgggcccgaggaggagaagttgccgattaaccctctgagtaattcgctcatgcggttccacaacaaggtgtactccactacctcgaggagtgccactctgagggcaaagaaggtgacctttgacagggtgcaggtgctggacgcacactatgactcagtcttgcaggacgttaagcgggccgcctctaaggttagtgcgaggctcctctcagtagaggaagcctgcgcgctgaccccgccccactccgccaagtcacggtacggatttggggcaaaggaggtgcgcagcttatccaggagggccgttaaccacatccggtccgtgtgggaggacctcctggaagaccaacatactccaattgacacaaccatcatggccaaaaatgaggtgttctgtgttgatcccactaagggtgggaaaaagccagctcgcctcatcgtataccctgacctaggggtcagggtgtgcgaaaagatggccctctatgacattgcacaaaagcttcccaaggcagtgatggggccatcctatgggttccaatactctcccgcagaacgggtcgatttcctcctcaaagcttggggaagtaagaaggacccaatggggttctcgtatgacacccgctgctttgactcaaccgtcacggagagggacataagaccagaagaatccatataccaggcttgttccctgcctcaagaggccagaactgtcatacattcgctcactgagagactttacgtaggagggcccatgataaacagcaaagggcaatcctgcggttacaggcgttgccgcgcaagcggcgttttcactaccagcatggggaacaccatgacatgttacatcaaagcccttgcagcatgcaaagctgcagggatcgtgaaccccgatatgttggtgtgtggagacgacctagtcgtcatctcagagagccaaggcaacgaggaggacgagcgaaacctgagagctttcacggaggctatgaccaggtattcagcccctcccggtgaccttcccagaccagaatatgacttggagcttataacatcctgctcctcaaacgtatcggttgcgctggactctcggggtcgccgccggtacttcctaaccagagaccctaccactccaatcacccgagctgcttgggaaacagtaagacactcccctgtcaattcttggctgggcaacatcatccaatacgcccctacaatctgggtccggatggtcataatgacccattttttctccatactattggcccaggacactctgaaccaaaatctcaattttgagatgtacggggcagtatactcggtcaatccattagacctaccggccataattgaaaggctacatgggctcgaggccttttcactgcacacatactctccccacgaactctcgcgggtggcagcgactctcagaaaacttggagcgcctccccttagagcgtggaagagtcgggcgcgtgctgtgagggcctcactcatcgcccagggagggagggcggccatttgtggccgctacctcttcaactgggcggtgaagacaaagctcaaactcactccattgcccgaggcgagccgcctggatttatccgggtggttcaccgtgggcgccggcgggggcgacatctttcacagcgtgtcgcacgcccgaccccgcttattactcctttgcctactcctactcagcgtaggggtaggcatctttttactccccgctcggtag

SEQ ID NO: 735 - DNA, 9406 bp, Hepatitis C Virus
cactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggataaacccactctatgtccggtcatttgggcgtgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacacaaaccgtcgcccacaggacgtcaagttcccgggtggcggtcagatcgttggcggagtttacttgctgccgcgcaggggccccaggttgggtgtgcgcgcgacaaggaagacttccgagcgatcccagccgcgtgggagacgccagcccatcccgaaagatcggcgctccaccggcaagtcctggggaaagccaggatatccttggcctctgtacggaaacgagggttgcggctgggcaggttggctcctgtccccccgcgggtctcgtcctacctggggccccactgacccccggcatagatcacgcaatttgggcagagtcatcgataccattacgtgtggttttgccgacctcatggggtacatcccagtcgttggcgccccggtcggaggcgtcgccagagctctggcacacggtgttagggtcctggaagacgggataaattacgcaacagggaatttacccggttgctccttttctatcttcttacttgcccttctgtcatgcgtcacagtgccagtgtctgcagtggaagtcaggaacatcagttctagctactacgccactaatgattgctcgaacaacagcatcacctggcagctcactaacgcagttctccaccttcctggatgcgtcccatgtgagaacgacaatggcaccttgcgttgctggatacaagtaacacctaatgtggctgtaaaacaccgcggtgcacttactcacaacctgcgaacgcacgtcgacatgatcgtaatggcagctacggtctgttcggccttgtacgtaggagatgtgtgtggagccgtgatgctcgtgtcgcaggctctcatagtatcaccagaacgccacaacttcacccaagagtgcaattgttccatctaccaaggccagatcaccggccaccgcatggcatgggacatgatgctaaactggtcaccaaccctcaccatgatccttgcctacgctgctcgtgttcctgagctagtccttgaagttgtcttcggtggccactggggtgtgatgtttggcttggcctatttctccatgcagggagcgtgggccaaagtcattgccatcctccttctcgtcgcgggagtggatgcaaccacctattccagcggcacggcagtgggttctaccttgtcgagcttcgctgggctcttcacccgtggtccccagcagcagctccacttaatcaacaccaatggtagttggcacataaatcggaccgccctcaattgcaatgacagcttgcagacgggcttcatagcctccctgttttacgccaaacgtttcaacagctctggctgccccgagcgcttgtcttcctgccgtgcgctggacgattttcgcatcgggtggggagccttggaatacgagaccaatgttaccaacgatgaggacatgaggccgtactgctggcattaccctccgaagccttgcggtattgtcccggctaggacggtttgcgggccggtctactgttttacccctagccctgttgtcgtgggcaccactgacaggcagggcgtacccacctatagttggggggaaaacgagaccgatgtcttcttgctgaatagcacaagacccccgcgaggagcttggttcggctgcacttggatgaatgggactggatttactaagacatgcggagcaccaccttgccgcattaggagggacttcaacagcactctcgacctattgtgccccacagactgttttaggaagcacccagatactacctacattaagtgtggagcggggccttggttgacccccaggtgcctgatagaatacccttatagactgtggcattatccttgcactgtaaatttcaccatcttcaaggtgcggatgtatgtagggggggtggagcatcggatgtccgcagcatgtaacttcacacgcggagaccgctgcagattggaagatagggataggggtcagcagagtccactgctgcattccaccactgagtgggcggtgttgccatgctccttctccgacctaccggcactatctactggtctaatgcacctccaccaaaacatcgtggacgtgcagtacctctatggacttagtccggctgttacaagatacatcgtgaagtgggaatgggtggtcctcctcttcctgttgttggctgatgctagggtctgtgcatgcctttggatgctcatcatactaggccaagccgaggcagcgcttgagaagctcatcatcttgcactccgctagcgccgctagtgccaatgggccgctgtggttcttcatcttctttacagcggcctggtacttgaagggcagggtggtccccgtggccacgtactccgttctcggcttgtggtcctttctcctcctagtcctggccctaccacaacaggcttatgctttggacaccgctgaacaaggggagctggggctagtcatattagcaatcatatccatctttactcttaccccagcatacaagatcctcctgagccgttcggtgtggtggctgtcctacatgctggtcttggccgaggcccagatccagcagtgggttccccccctggaggctagggggggacgtgacgggatcatctgggcggctgtcattctacacccgcgccttgtgtttgaggtcactaaatggttgttagcaatcctagggtctgcttatctccttaaagcgtctctgctacgggtgccatactttgtgagggctcacgctctgctacgagtgtgtaccctggtgagacacctcgcaggagctaagtacatccagatgctgttgatcaccttaggcaggtggaccggcacttacatttatgaccacctctctcctctatcaacttgggcagcccagggtttgcgggacttggcagtcgccgtggagcccgtggtgttcagcccaatggagaagaaggtcattgtgtggggggctgagacagtggcatgtggagacatcttgcatggcctcccggtttccgcgaggctaggtaaggaagttctgctcggccccgctgatagctacacctcgaaggggtggaagctcttagctcccattactgcttacactcagcagactcgtggcctcttgggtgctatcgtggtcagcctaacgggccgcgacaagaatgagcaggctggacaggtccagattctgtcctctgtcacacaatccttcttggggacatctatttcgggggtcctctggacagtatatcacggggccggtaataagaccttggccggccctaagggaccagtcactcagatgtacaccagtgcagagggagacctcgtgggatggcctagcccccccggtactaagtcattagacccctgtacttgcggggccgtggacctctacctggtcacccgaaacgctgatgtcatcccggtccggaggaaagatgaccggcggggtgcactactctcgccaagacctctctcaaccctcaaaggatcatccggcggacccgtgctctgccctaggggacatgccgtgggcctgttcagagcagccgtgtgtgccaggggtgtagccaagtctattgacttcgtccctgttgaatctctcgctatcgccacacggacgcccagtttctctgacaacagcgcgccaccagctgtgccccagacttaccaggtgggctacttgcacgcaccaacaggcagcgggaagagcaccaaagtccctgccgcatatgccagtcaggggtataaggtactcgtactaaatccctctgtagcggccacacttggttttggggcctacatgtccaaagcccacgggatcaaccctaacatcagaaccggagtgcggactgtgaccaccggggaccctatcacctactccacttatggcaagttcatagcgaatggaggctgctcagccggcgcctatgacgtcatcatttgcgacgaatgccattctgtggacgccactaccatccttggcattggaacagtcctcgaccaggctgagaccgcaggtgccaggctagtggttttagccacagccacgccccccggcacggtgacaactccccacagtaacatagaggaggtggcccttggtcatgagggcgagatccctttttatggcaaggctattcccctagctttcatcagggggggcagacacctgatcttttgccattcaaagaagaagtgcgatgagctcgcagcagcccttcggggcatgggtgtcaatgccgttgcctactacaggggtctcgacgtctccgttataccaacccaaggagacgtggtggtcgtcgccactgatgccctaatgacgggatacaccggtgactttgactctgtaatcgactgcaacgttgcagtcactcagattgttgactttagcctagacccaacctttaccatcaccactcaaaccgtccctcaggacgctgtctcccgtagtcaacgtagggggagaactgggagaggacggctgggtatatacaggtatgtctcgtcaggcgagaggccgtctgggatgttcgacagcgtagtgctctgcgagtgctacgatgccggggcagcctggtacgagcttacgcctgctgagactacggtgagacttcgggcttatttcaacacgcccggcttacccgtgtgtcaagaccacctggagttctgggaagcggtcttcacaggtctcacacacatcgatgcccacttcctctcccagacgaagcaaggaggcgacaactttgcgtatctaacggcctaccaggccacagtatgcgctagggcaaaggcccctcccccttcgtgggacgtgatgtggaagtgtctgactaggctcaaacctacactgactggtcctacccccctcctgtaccgcttgggtgccgtgaccaacgaggttaccctgacacaccccgtgacgaagtatatcgccacgtgcatgcaggctgatctcgagatcatgacaagcacgtgggtcctggcagggggggtgctagccgccgtggcagcttactgcctggcgaccggctgcgtttccatcatcggccgcatacacctgaatgatcaggtagttgtggcccctgacaaggaagtcttatatgaggcctttgatgagatggaggaatgctcctccaaagccgccctcattgaggaagggcagcggatagcggagatgctcaagtctaagatacaaggcctcctacaacaggccacaagacaggcccaagacatacagccagccatacagtcatcatggcccaagcttgaacaattttgggccaaacacatgtggaacttcatcagtggcatacagtacttggcgggactctccaccctaccgggaaatcccgcagtggcatcaatgatggctttcagcgccgcattaaccagcccactacccaccagcaccaccatcctcttgaacatcatggggggatggttggcctcccagattgccccccctgccggagccactggcttcgttgtcagtggtctagtgggggcggccgttggaagtataggcctgggtaagatactggtggacattttggccgggtacggtgcgggcatttcgggggccctcgtagcttttaaaatcatgagcggcgagaagccctcggtagaggatgttgtgaacctcctgcccgctatcctatcccctggtgcgttggtagtgggagtcatctgtgcagcaatcctgcgccgccacgtcggccaaggagagggggcggtccagtggatgaacagattgatcgcctttgcctccagaggaaaccatgttgcccctacccactacgtggctgagtctgacgcctcgcagcgcgtgatgcagatgctaagttcactcacgattaccagcttgcttaggaggctacacacctggatcactgaagattgcccagtcccatgttcggggtcgtggctccgggacgtttgggattgggtttgttccattcttatagactttaagaactggctgtcttcaaagttactccccaaaatgcctggccttcccttcatctcttgccaaaagggatacaggggcgtatgggctggcacgggagtcatgactactcggtgtccatgcggggcaaacatttcgggccatgtccgcatgggtaccatgaaaataactggcccgaagacctgcttgaacctgtggcagggaaccttccccattaattgttacacagaagggccttgcgtgccaaaaccccctcctaattataagaccgcaatttggagggtggcagcgtcggagtacgttgaagtcacacagcatggctctttctcgtacgtaacggggttgaccagtgacaaccttaaggtcccttgccaggtaccagctccagaattcttctcttgggtggacggggtgcaaatacatcgattcgcccccattccaggtcctttctttcgggatgaggtaacgttcaccgtaggccttaattccttggtggtcggctctcagctcccttgtgaccctgagccggacaccgaggtattggcctccatgttgacagacccgtcccacattaccgcggaagcggcagccaggcggttggccaggggatcccccccttcacaggccagctcctcagcgagccagctctccgccccgtccttgaaggccacctgtaccacccataggatggcatatgactgtgacatggtggatgctaaccttttcatgggaggcgatgtgacccggattgaatccgactccaaggtgatcgttcttgactccctcgacaccatgactgaggtagaggatgatcgtgaaccttctgtaccatcggagtacttggtcaggaagcgtaagttcccaccggcactgcctccctgggcccgtccggactacaaccctcctgtgatcgagacatggaagaggccgggctatgaaccacccactgtcctaggctgtgctcttccccccacacctcaaacgccagtgcccccacctcggaggcgccgcgccaaagtcctaactcaggacaatgtgggggaagtccttagggagatggcggacaaagtgctcagccctctccaagaccacaatgactccggtcactccactggagcggataccggaggagacagcgtccagcagccctctgacgagactgccgcttcagaagcgggatcatcgtcctccatgcctcccctcgagggagagccgggggaccctgacctggagtttgaaccagcggaatccgctcccccttctgagggagagtgtgaggtcattgattcggactctaagtcatgggcgacagtctctgatcaagaggattctgtcatctgctgctccatgtcatactcctggacgggggcccttataacaccatgtgggcccgaggaggagaagttgccaatcaaccctctgagtaattcgcttatgcggttccataacaaggtgtactccacaacttcgaggagcgcctctctgagggctaagaaggtgacctttgacagggtgcaggtgctggacgcacactatgactcagtcttgcaggacgttaagcgtgccgcctctaaggttagtgcgaggctcctctcaatagaggaagcctgtgcgctgaccccgccccactccgccaaatcacgatatggctttggggcaaaggaggtgcgcagcttatccaggagggccgtcaaccacatccggtccgtgtgggaggacctcctggaggaccaacatactccaattgacacaactgtcatggccaaaaatgaggtgttctgtgttgatcccgctaaaggcgggaaaaagccagctcgtctcatcgtataccccgacctcggggtcagggtgtgcgaaaagatggccctatatgacattgcacaaaagcttcccaaggcaataatgggaccatcctatgggttccaatactctcctgcagaacgggtcgactttctcctcaaggcttggagaagtaagaaggacccaatggggttctcgtatgacacccgctgctttgactcaaccgtcacggagagggacataagaacagaagaatccatataccaggcttgctccctgcctgaagaggccagaactgtcatacactcgctcactgagagactctacgtaggagggcccatgacgaacagcaaaggacaatcctgcggttacaggcgttgccgcgcaagcggtgttttcactaccagcatggggaacaccatgacatgctacatcaaagccctcgcagcatgtaaagctgcagggatcatggaccccatgatgctggtgtgtggagacgacctggtcgtcatctcagagagccaaggcaacgaggaggacgagcgaaacctgagagctttcacggaggctatgaccaggtattctgcccctcccggtgaccttcccagacctgaatatgacttggagcttataacatcctgctcctcaaacgtatcggtagcgctggactctcggggtcgccgccggtacttcctaaccagagaccctaccactccaatcacccgagctgcttgggaaacagtaagacactcccctgtcaattcttggctgggcaacatcatccaatacgcccctacaatctgggtccggatggtcataatgacccatttcttctccatactattggcccaggacactctgaaccagaatctcaattttgagatgtacggggcagtatattcggtcaatccattagacctaccagccataattgaaaggctacatgggcttgatgccttttcactgcacacatactctccccacgaactctcacgggtggcagcaactctcagaaaacttggagcgcctccccttagagcgtggaagagtcgggcgcgtgctgtgagggcctcactcatcgcccagggagggagggcggccatttgtggccgatacctcttcaactgggctgtgaagacaaagctcaaactcactccattgcctgaggcgagccgcctggatttatccgggtggttcaccgtgggcgccggcgggggcgacatttatcacagcgtgtcgcatgcccgaccccgccttttactcctttgcctactcctacttagcgtaggagtaggcatctttctactccccgctcgttag

SEQ ID NO: 736 - DNA, 9406 bp, Hepatitis C Virus
cactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggataaacccactctatgtccggtcatttgggcgtgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacacaaaccgtcgcccacaggacgtcaagttcccgggtggcggtcagatcgttggcggagtttacttgctgccgcgcaggggccccaggttgggtgtgcgcgcgacaaggaagacttccgagcgatcccagccgcgtgggagacgccagcccatcccgaaagatcggcgctccaccggcaagtcctggggaaagccaggatatccttggcctctgtacggaaacgagggttgcggctgggcaggttggctcctgtccccccgcgggtctcgtcctacctggggccccactgacccccggcatagatcacgcaatttgggcagagtcatcgataccattacgtgtggttttgccgacctcatggggtacatcccagtcgttggcgccccggtcggaggcgtcgccagagctctggcacacggtgttagggtcctggaagacgggataaattacgcaacagggaatctacccggttgctccttttctatcttcttacttgcccttctgtcatgcgtcacagtgccagtgtctgcagtggaagtcaggaacatcagttctagctactacgccactaatgattgctcgaacaacagcatcacctggcagctcactaacgcagttctccaccttcctggatgcgtcccatgtgagaacgacaatggcaccttgcgttgctggatacaagtaacacctaatgtggctgtaaaacaccgcggtgcacttactcacaacctgcgaacgcacgtcgacatgatcgtaatggcagctacggtctgttcggccttgtacgtaggaaatgtgtgtggagccgtaatgctcgtgtcgcaggctctcatagtttcaccagaacgccacaatttcacccaagagtgcaattgttccatttaccaaggccagattaccggccaccgcatggcatgggacatgatgttaaactggtcaccaaccctcaccatgatccttgcctacgctgctcgtgttcctgagctagtccttgaagttgtcttcggtggccactggggtgtgatgtttggcttggcctatttctccatgcagggagcgtgggccaaagtcattgccatcctccttctcgtcgcgggggtggatgcaaccacctattccagcggcacggcagtgggttctaccttgtcgagcttcactaggctcttcacctttggtccccagcagcagctccacttaatcaacaccaatggtagttggcacataaatcggaccgccctcaattgcaatgacagcttgcagacgggcttcatagcctccctgttttacgccaatcgtttcaacagctctggctgccccgagcgcttgtcttcctgccgtgcgctggacgattttcgtatcgggtggggagccttggaatacgagaccaatgttaccaacgatgaggacatgaggccgtactgctggcattaccctccgaagccttgcggcattgtcccggctaggacggtttgcgggccggtctactgttttacccctagccctgttgtcgtgggcaccactgacaggcagggcgtacccacctatagttggggggaaaacgagaccgatgtcttcttgctgaatagcacaagacccccgcgaggagcttggttcggctgcacttggatgaatgggactgggtttactaaaacatgcggagcaccaccttgccgcattaggagggacttcaacagcactctcgacctattgtgccccacagactgttttaggaagcacccagatactacctacattaagtgtggagcggggccttggttgacccccaggtgcctgatagaatacccttatagactgtggcattatccttgcactgtaaatttcaccatcttcaaggtgcggatgtacgtagggggggtggagcatcggatgtccgcagcatgtaacttcacacgcggagaccgctgcagattggaagatagggataggggtcagcagagtccactgctgcattccaccactgagtgggcggtgttgccatgctccttctccgacctaccggcactatctactggtctaatgcacctccaccaaaacatcgtggacgtgcagtacctctatggacttagtccggctgttacaagatacatcgtgaagtgggaatgggtggtcctcctcttcctgttgttggctgatgctagggtctgtgcatgcctttggatgctcatcatactaggccaagccgaggcagcgcttgagaagctcatcatcttgcactccgctagcgccgctagtgccaatgggccgctgtggttcttcatcttctttacagcggcctggtacttgaagggcagggtggtccccgtggccacgtactccgttctcggcttgtggtcctttctcctcctagtcctggccctaccacaacaggcttatgctttggacaccgctgaacaaggggagctggggctagtcatattagtaatcatatccatctttactcttaccccagcatacaagatcctcctgagccgttcggtgtggtggctgtcctacatgctggtcttggccgaggcccagatccagcagtgggttccccccctggaggctagggggggacgtgacgggatcatctgggcggctgtcattctacacccgcgccttgtgtttgaggtcactaaatggttgttagcaatcctagggtctgcttatctccttaaagcgtctctgctacgggtgccatactttgtgagggctcacgctctgctacgagtgtgtaccctggtgagacacctcgcaggagctaagtacatccagatgctgttgatcaccttaggcaggtggaccggcacttacatttatgaccacctctctcctctatcaacttgggcagcccagggtttgcgggacttggcagtcgccgtggagcccgtggtgttcagcccaatggagaagaaggtcattgtgtggggggctgagacagtggcatgtggagacatcttgcatggcctcccggtttccgcgaggctaggtaaggaagttctgctcggccccgctgatagctacacctcgaaggggtggaagctcttagctcccattactgcttacactcagcagactcgtggcctcttgggtgctatcgtggtcagcctaacgggccgcgacaagaatgagcaggctggacaggtccaaattctgtcctctgtcacacaatccttcttggggacatctatttcgggggtcctctggacagtatatcacggggccggtaataagaccttggccggccctaagggaccagtcactcagatgtacaccagtgcagagggagacctcgtgggatggcctagcccccccggtactaagtcattagacccctgtacttgcggggccgtggacctctacctggtcacccgaaacgctgatgtcatcccggtccggaggaaagatgaccggcggggtgcactactctcgccaagacctctctcaaccctcaaaggatcatccggtggacccgtgctctgccctaggggacatgccgtgggcctgttcagagcagccgtgtgtgccaggggtgtagccaagtctattgacttcgtccctgttgaatctctcgctatcgccacacggacgcccagtttctctgacaacagcgcgccaccagctgtgccccagacttaccaggtgggctacttgcacgcaccaacaggcagcgggaagagcaccaaagtccctgccgcatatgccagtcaggggtataaggtactcgtactaaatccctctgtagcggccacacttggttttggggcctacatgtccaaagcccacgggatcaaccctaacatcagaaccggagtgcggactgtgaccaccggggaccctatcacctactccacttatggcaagttcatagcgaatggaggctgctcagccggcgcctatgacgtcatcatttgcgacgaatgccattctgtggacgccactaccatccttggcattggaacagtcctcgaccaggctgagaccgcaggtgccaggctagtggttttagccacagccacgccccccggcacggtgacaactccccacagtaacatagaggaggtggcccttggtcatgagggcgagatccctttttatggcaaggctattcccctagctttcatcagggggggcagacacttgatcttttgccattcaaagaagaagtgcgatgagctcgcagcagcccttcggggcatgggtgtcaatgccgttgcctactacaggggtctcgacgtctccgttataccaacccaaggagacgtggtggtcgtcgccactgatgccctaatgacgggatacaccggtgactttgactctgtaatcgactgcaacgttgcagtcactcagattgttgactttagcctagacccaacctttaccatcaccactcaaaccgtccctcaggacgctgtctcccgtagtcaacgtagggggagaactgggagaggacggctgggcatatacaggtatgtctcgtcaggcgagaggccgtctgggatgttcgacagcgtagtgctctgcgagtgctacgatgccggggcagcctggtacgagcttacgcctgctgagactacggtgagacttcgggcttatttcaacacgcccggcttacccgtgtgtcaagaccacctggagttctgggaagcggtcttcacaggtctcacacacatcgatgcccatttcctctcccagacgaagcaaggaggcgacaactttgcgtatctaacggcctaccaggccacagtatgcgctagggcaaaggcccctcccccttcgtgggacgtgatgtggaagtgtctgactaggctcaaacctacactgactggtcctacccccctcctgtaccgcttgggtgccgtgaccaacgaggttaccctgacacaccccgtgacgaagtatatcgccacgtgcatgcaggctgatctcgagatcatgacaagcacgtgggtcctggcagggggggtgctcgccgccgtggcagcttactgcctggcgaccggctgcgtttccatcatcggccgcatacacctgaatgatcaggtagttgtggcccctgacaaggaagtcttatatgaggcctttgatgagatggaggaatgctcctccaaagccgccctcattgaggaagggcagcggatagcggagatgctcaagtctaagatacaaggcctcctacaacaggccacaagacaggcccaagacatacagccagccatacagtcatcatggcccaagcttgaacaattttgggccaaacacatgtggaacttcatcagtggcatacagtacttggcgggactctccaccctaccgggaaatcccgcagtggcatcaatgatggctttcagcgccgcattgactagcccactatccaccagcaccaccatcctcttgaacatcatggggggatggttggcctcccagattgccccccctgccggagccactggcttcgttgtcagtggtctagtgggggcggccgttggaagcataggcctgggtaagatactggtggacattttggccgggtacggtgcgggcatttcgggggccctcgtagcttttaaaatcatgagcggcgagaagccctcggtagaggatgttgtgaacctcctgcctgctatcctatcccctggtgcgttggtagtgggagtcatctgtgcagcaatcctgcgccgccacgtcggccaaggagagggggcggtccagtggatgaacagactgatcgcctttgcctccagaggaaaccatgttgcccctacccactacgtggctgagtctgacgcctcgcagcgcgtgatgcagatgctaagttcgctcacgattaccagcttgcttaggaggctacacacctggatcactgaagattgcccagtcccatgttcggggtcgtggctccgggacgtttgggattgggtttgttccattcttatagactttaagaactggctgtcttcaaagttactccccaaaatgcctggccttcccttcatctcttgccaaaagggatacaggggcgtatgggctggcacgggagtcatgactactcggtgtccatgcggggcaaacatttcgggccatgtccgcatgggtactatgaaaataactggcccaaagacctgcttgaacctgtggcagggaaccttccccattaattgttacacagaagggccttgcgtgccaaaaccccctcctaattataagaccgcaatttggagggtggcagcgtcagagtacattgaagtcacacagcatggctctttctcgtacgtaacggggttgaccagtgacaaccttaaggtcccttgccaggtaccagctccagaattcttctcttgggtggacggggtgcaaatacatcgattcgcccccattccaggtcctttctttcgggatgaggtaacgttcaccgtaggccttaattccttggtggtcggctctcagctcccttgtgaccctgagccggacaccgaggtattggcctccatgttgacagacccgtcccacattaccgcggaagcggcagccaggcggttggccaggggatcccccccttcacaggccagctcctcagcgagccagctctccgccccgtccttgaaggccacctgtaccacccataggatggcatatgactgtgacatggtggatgctaaccttttcatgggaggcgatgtgacccggattgaatccgactccaaggtgatcgttcttgactccctcgacaccatgactgaggtagaggatgatcgtgaaccttctgtaccatcggagtacttggtcaggaagcgtaagttcccaccggcactgcctccctgggcccgtccggactacaaccctcctgtgatcgagacatggaagaggccgggctatgaaccacccactgtcctaggctgtgctcttccccccacacctcaagcgccagtgcccccacctcggaggcgccgcgccaaagtcctaactcaggacaatgtgggggaagtccttagggagatggcggacaaagtgctcagccctctccaagaccacaatgactccggtcactccactggagcggataccggaggagacagcgtccagcagccctctgacgagactgccgcttcagaagcgggatcatcgtcctccatgcctcccctcgagggagagccgggggaccctgacctggagtttgaaccagcggaatccgctcccccttctgagggagagtgtgaggtcattgattcggactctaagtcatgggcgacagtctctgatcaagaggattctgtcatctgctgctccatgtcatactcctggacgggggcccttataacaccatgtgggcccgaggaggagaagttgccaatcaaccctctgagtaattcgcttatgcggttccataacaaggtgtactccacaacttcgaggagcgcctctctgagggctaagaaggtgacctttgacagggtgcaggtgctggacgcacactatgactcagtcttgcaggacgttaagcgtgccgcctctaaggttagtgcgaggctcctctcaatagaggaagcctgtgcgctgaccccgccccactccgccaaatcacgatatggctttggggcaaaggaggtgcgcagcttatccaggagggccgtcaaccacatccggtccgtgtgggaggacctcctggaggaccaacatactccaattgacacaactgtcatggccaaaaatgaggtgttctgtgttgatcccgctaaaggcgggaaaaagccagctcgtctcatcgtataccccgaccttggggtcagggtgtgcgaaaagatggccctatatgacattgcacaaaagcttcccaaggcaataatggggccatcctatgggttccaatactctcctgcagaacgggtcgactttctcctcaaggcttggagaagtaagaaggacccaatggggttctcgtatgacacccgctgctttgactcaaccgtcacggagagggacataagaacagaagaatccatataccaggcttgctccctgcctgaagaggccagaactgtcatacactcgctcactgagagactctacgtaggagggcccatgacgaacagcaaaggacaatcctgcggttacaggcgttgccgcgcaagcggtgttttcactaccagcatggggaacaccatgacatgctacatcaaagccctcgcagcatgtaaagctgcagggatcatggaccccatgatgctggtgtgtggagacgacctggtcgtcatctcagagagccaaggcaacgaggaggacgagcgaaacctgagagctttcacggaggctatgaccaggtattctgcccctcccggtgaccttcccagacctgaatatgacttggagcttataacatcctgctcctcaaacgtatcggtagcgctggactctcggggtcgccgccggtacttcctaaccagagaccctaccactccaatcacccgagctgcttgggaaacagtaagacactcccctgtcaattcttggctgggcaacatcatccaatacgcccctacaatctgggtccggatggtcataatgacccatttcttctccatactattggcccaggacactctgaaccagaatctcaattttgagatgtacggggcagtatattcggtcaatccattagacctaccagccataattgaaaggctacatgggcttgatgccttttcactgcacacatactctccccacgaactctcacgggtggcagcaactctcagaaaacttggagcgcctccccttagagcgtggaagagtcgggcgcgtgctgtgagggcctcactcatcgcccagggagggagggcggccatttgtggccgatacctcttcaactgggctgtgaagacaaagctcaaactcactccattgcctgaggcgagccgcctggatttatccgggtggttcaccgtgggcgccggcgggggcgacatttatcacagcgtgtcgcatgcccgaccccgccttttactcctttgcctactcctacttagcgtaggagtaggcatctttctactccccgctcgttag

SEQ ID NO: 737 - DNA, 9406 bp, Hepatitis C Virus
cactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggataaacccactctatgtccggtcatttgggcgtgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacacaaaccgccgcccacaggacgtcaagttcccgggtggcggccagatcgttggcggagtttacttgctgccgcgcaggggccccaggttgggtgtgcgcgcgacaaggaagacttccgagcgatcccagccgcgtgggagacgccagcccatcccgaaagatcggcgctccgtcggcaagtcctggggaaagccaggatatccctggcccctgtacggaaacgagggttgcggttgggcaggttggctcctgtccccccgcgggtctcgtcctacttggggccccactgacccccggcatagatcacgcaatttgggcaaagtcatcgataccattacgtgtggttttgccgacctcatggggtacatccctgtcgttggcgccccggtcggaggcgtcgccagagctctggcacacggtgttagagtcctggaagacgggataaattatgcaacagggaatctacccggttgctctttttctatcttcttacttgctcttctgtcgtgcgtcacagtgccagtgtctgcagtggaagtcaggaacattagttctagctactacgccactaatgattgctcgaacaacagcatcacctggcagctctctaacgcagttctccaccttcctggatgcgtcccatgtgagaatgataatggcaccttgcgctgttggatacaagtgacgcctaacgtggctgtgaagcatcgcggcgcactcactcataacctgcgaacacacgtcgacatgatcgtaatggcagctacggtctgctcggccttgtacgtgggagatgtgtgcggggccgtgatgatcgtgtcgcaggctctcatagtgtcgccagaacgccacaacttcacgcaagagtgcaactgttccatctaccaaggtcacgtcaccggccaacgcatggcatgggacatgatgctcaactggtcaccaactcttaccatgatcctcgcctacgctgctcgtgttcccgagatggtccttgaaattattttcggcggccattggggtgtggtgtttggcttggcctatttctccatgcagggagcgtgggccaaagtcattgccatcctccttcttgtcgcgggagtggatgcaaccacctattccagcggcgcgcaagtgggtcgtgcccttagcgggctcactggtattttcagccctggtgccaagcagaatatccagttgatcaacaccaatggcagctggcacataaaccggaccgccctcaattgcaatgacagcttgcagacgggtttcatcgcttccctgttttacacccataggttcaacagctctggctgtcccgagcgcttgtcttcctgccgtgggctggacgattttcgtatcgggtggggaaccttggaatacgagaccaatgtcaccaacgatgaggacatgaggccgtactgctggcattaccctccgaagccttgcggtatcgtctcggctaagacggtttgcgggccggtctattgttttacccctagccctgttgtcgtgggcaccactgacaggcaaggcgtgcccacctacagctggggggagaacgagaccgatgtcttcctgctaaatagcactagacccccgcaaggagcttggttcggctgcacttggatgaacgggactgggttcactaagacatgcggagcaccaccttgccgcattaggagggactacaacagcactctcgatctattgtgccccacagactgttttaggaagcacccaggtgctacctatcttaagtgcggagcagggccctggttgacccccaggtgcctgatagactacccttatagactgtggcattatccgtgcactgtaaactttaccatcttcaaggtacggatgtatgtagggggggtggagcatcgattatccgcagcatgtaacttcacgcgcggggaccgatgcagattggaagatagggataggggtcagcagagcccactgctgcattccaccactgagtgggcggtgttgccatgctccttctccgacctacccgcactatctactggcctattgcacctccaccagaacatcgtggacgtgcagtacctctatggactttctccggctcttacaagatacattgtaaagtgggaatgggtggtcctccttttcttgttgttggcagatgccaggatctgtgcatgtctttggatgctcatcatactgggccaagccgaggcggcgcttgagaagctcatcatcttgcactccgctagcgctgctagtgctaacgggccgttgtggttcttcatcttctttacggcggcctggtacttaaagggcagggtggtccccgtggccacgtactctgttctcggcttgtggtcctttcttctcctagtcctggccttaccacagcaggcttatgccatggacgccgctgaacaaggggaactagggctggtcatactagtaatcatatccatctttactcttactccagcatacaagattctcctgagccgttcagtgtggtggctctcctatatgctggtcttggccgaggcccagattcagcaatgggttccccccctggaggcccgaggggggcgtgacgggattatctgggtggctgtcattctacacccacgccttgtgtttgaggtcacgaaatggttgctagcaatcctggggcctgcctatctccttaaagcgtctctgctgcgggtaccatactttgtgagggcccacgctctgctacgagtgtgtaccctggtgaggcacctcgcaggagctaggtacgtccagatgctgttgcttaccatgggcaggtggacaggtacttacatctatgaccacctctcccctttgtcaacttgggccgcccagggtttgcgggacctggcagtcgccgtggagcctgttgtgttcagcccaatggagaagaaggtcattgtgtggggggctgagacagtggcatgcggagacatcctgcatggcctcccggtttccgcgaggctaggtagggaagtcctgctcggccctgccgatagctacacctcgaagggatggaagctcctagctcccattactgcttacactcagcagactcgcggtctcttgggtgctatcgtggtcagtctaacgggccgcgacaaaaatgagcaggctgggcaggtccaggtcctgtcctccgtcacacaatcttttttggggacatgtatttcgggggtcctctggacggtatatcacggggctggtaataagaccttggccggccccaagggaccagtcactcagatgtacaccagcgcggagggagacctcgtgggatggcctagcccccccgggactaagtcattagacccctgtacttgcggggccgtggacctctacctggtctcccgaaacgctgatgtcattccagtccggaggaaagatgaccgacggggcgcactactttcgccacggcctctctcaaccctcaaaggatcttctggcggacccgtactctgctctaggggacatgtcgtgggcttgttcagagcggccgtgtgcgccaggggtgtggccaaatctattgacttcatccctgttgaatctctcaatatcgccacacggacgcccagcttctctgacaacagtacgccaccggctgtgccccagacttaccaagtgggctacttgcacgcaccaacaggcagcgggaagagcaccaaggtcccggccgcatatgccagccaggggtataaagtacttggactgaatccctctgtcgcggccacgcttggttttggggcctacatgtccaaagcccacgggatcaaccctaatatcagaaccggggtgcggactgtgaccaccggggaccccatcacttactccatttatggcaagtttgtcgcagatggaggctgtcaagctggcgcctatgacatcatcatatgcgacgaatgccactcggtggacgctactaccatccttggtattggaacagtcctcgatcaggctgagactgcaggcgtcaggctggtggtcctggccacagctacgcctcctggtacggtgacaactccccacagcaacatagaggaggtggcccttggccatgaaggcgagatccctttttatggcaaggctattcctctagctttcatcaaagggggcagacacctgatcttttgccattcaaagaagaagtgcgacgagcttgcagcagcccttcggggcatgggtgtcaacgccgttgcctactacaggggtctcgacgtctccgttataccaactcaaggagacgtggtggttgtcgccaccgatgccctaatgactggatacaccggtgactttgactccgtcattgactgcaacgttgcagtcactcagattgttgactttagcctagacccaaccttcaccatcaccactcaaactgtccctcaggacgctgtctcccgtagtcaacgtagagggagaactgggaggggtcgactgggcacttacaggtatgtctcgtcaggcgagagaccgtctgggatgttcgacagcgtagtgctctgcgagtgctacgatgccggagcagcctggtacgagcttacgcctgctgagactacggtgagactccgggcttatttcaacacgcctggtttgcccgtgtgtcaagaccacctggagttctgggaggcagtcttcacaggtcttacacacattgatgcccatttcctctcccagacgaagcaaggaggggaaaactttgcgtatctaacggcctaccaggccacagtatgcgctagggcgaaggccccccctccttcgtgggacgtgatgtggaagtgtctaactaggctcaaacccacactgacaggtccaacccccctcctgtaccgcttgggtgccgtgaccaacgaggttaccttaacgcaccccgtgacgaaatacatcgccacgtgcatgcaagctgacctcgagatcatgacaagcacatgggtcctggcagggggggtgctagccgccgtggcagcttactgcctggcgactggctgcgtctccatcatcggccgcttacacctgaatgatcaggtagttgtagcccctgacaaagaaatcttatatgaggcctttgatgaaatggaagaatgcgcctccaaagccgccctcattgaggaagggcagcggatggcggagatgctcaagtccaagatacagggcctcttacaacaggccacaagacaggcccaagacgtacagccagtcatacagtcatcatggcctaagcttgaacaattttgggccaaacacatgtggaacttcatcagtggcatacagtacctggcgggactctccaccttaccggggaatcccgcagtggcatcaatgatggctttcagcgccgcattgactagcccgctacccaccagcaccaccatcctcttgaacatcatggggggatggttggcctcccagattgccccccccgctggggccactggcttcgttgtcagtggtctagtgggggcggccgtcgggagcataggcctgggtaagatactggtggacgttttggccgggtacggcgcaggcatttcaggggccctcgtagcttttaaaatcatgagcggcgagaagccctcggtggaagacgtcgtgaatctcctgcctgccattttgtctcctggcgctttggtagtaggggtcatctgtgcggcaatcctgcgccgccacatcggccagggagagggggcggtccagtggatgaacagactgatcgccttcgcctccagaggaaaccatgttgcccctacccactacgtcgcggagtcggacgcttcacagcgcgtgacgcaggtgctgagttcactcacaatcaccagcttgcttaggagactacatgcctggatcactgaagattgcccagtcccatgttcggggtcttggctccaggacatttgggattgggtttgttccattctcacagactttaagaactggctgtcttcaaaattgctccccaaactgcccggccttcccttcatctcttgccaaaagggatacaggggtgtatgggctggcacgggagtcatgactactcggtgtccatgcggagcaaacatctcgggccatgtccgcatgggtaccatgaaaataacaggcccgaagacctgcctgaacctgtggcaggggaccttccccattaattgttacacagaagggccttgcgtgccaaagcccccccccaattataagaccgcaatttggagggtggcagcgtcggagtacgttgaggtcacgcagcatggctctttctcgtacgtaacggggttaaccagtgacaaccttaaggtcccttgccaggtgccagctccagagtttttctcttgggtggacggggtgcaaatacaccgattcgcccccactccaggccccttcttccgggatgaggtaacgttcaccgtaggcctaaattcctttgtggtcggctctcagctcccttgcgaccctgagccggacaccgaggtattggcctccatgttgacagacccgtcccacatcaccgcggaggcggcagccaggcgactggccaggggatctcccccttcacaggccagctcttcagcgagccagctctccgccccgtccttgaaggctacctgtaccacccataagacagcatatgactgtgacatggtggatgctaacctgttcatgggaggcgacgtgacccggattgagtctgactctaaggtgatcgttctcgactccctcgattccatgactgaggtagaggacgatcgtgagccttctgtaccatcagagtacttgatcaggaggagaaagttcccaccggcactacctccctgggcccgtccagactacaaccctcccgtgatcgagacatggaagaggccggactatgaaccacccactgtcctaggctgtgcccttccctccacacctcaagtgccagtgcccccacctcggaggcgccgcgccagagttctgactcaggacaatgtggagggggtcctcagggagatggcggacaaagtgctcagccctctccaagaccacaatgactccggtcactccactggagcggataccggaggagacagcgtccagcagccctctgacgagactgccgcctcagaaacgggatcactgtcctccatgcctccccttgagggagagccgggggaccctgacctggagtttgaaccagcaagatccgcccccccctctgagggggagtgcgaggtcattgattcggactctaagtcgtggtccacagtctctgatcaagaggattctgttatttgctgctccatgtcatactcctggacaggagccctcataacaccgtgtgggcccgaggaggagaagttgccgatcaaccctctgagtaactcgctcatgcggttccacaacaaggtgtactccacaacctcgaggagtgcctctctgagggcaaagaaggtgacttttgacagggtgcaggtgctggacacacattatgattcagtcttgcaggacgttaagcgggccgcctccaaggttagtgcgaggctcctctcaatagaggaagcctgcgcgctgaccccgccccactccgccaaatcacgatacggatttggggcaaaggaggtgcgcagcttatccaggagggccgtcaaccacatccggtccgtgtgggaggacctcctggaagaccaacatactccaattgacacaactatcatggccaaaaatgaggtgttctgtgtcgatcccaccaaaggcgggaaaaagccagctcgcctcatcgtataccccgaccttggggtcagggtgtgtgaaaagatggccctctatgacatcgcacaaaagcttcccaaggcaataatggggccatcctatgggttccaatactctcctgcagaacgggtcgattttctccttaaagcttggagaagtaagaaggacccaatggggttctcatatgacacccgctgctttgactcaactgtcacggagagggacataagaacagaagaatccatatatcaggcttgttccctgcctcaagaggccagaactgtcatacactcgctcactgagagactctacgtaggagggcccatgacaaacagcaaagggcaatcctgcggttacaggcgttgccgcgcaagcggtgttttcactaccagcatggggaataccatgacatgctacatcaaagcccttgcggcgtgtaaagctgcagggatcgtggaccctatcatgctggtgtgtggagacgacctggtcgtcatctcagagagccaaggtaacgaggaggacgagcgaaacctgagagctttcacggaggctatgaccaggtattccgcccctcctggtgaccttcccagaccggaatatgacttggagcttataacatcctgctcctcaaacgtatcggtagcgctggaccctcggggtcgccgccggtacttcctaaccagagaccctaccactccaatcacccgagctgcttgggaaacagtaagacactcccctgtcaattcttggctgggcaacatcattcaatacgcccctacaatctgggtccggatggtcataatgacccacttcttctccatactattggcccaggacactttgaaccaaaatctcaattttgagatgtatggggcagtatattcggtcaatccattagacctaccggccataattgaaaggctgcatgggcttgatgccttttcactgcacacatactctccccacgaactctcacgggtggcagcgactctcagaaaacttggagcgcctcccctcagagcgtggaagagtcgggcgcgtgctgtgagggcctcactcatcgcccagggagggagggcggccatttgcggtcgctacctcttcaactgggcggtgaagacaaagctcaaactcactccattgcccgaggcgagccgcctggatttatccgggtggttcaccgtgggcgccggcgggggcgacatttttcacagcgtgtcgcgcgcccgaccccgcctattactcctttgcctactcctacttagcgtaggagtaggcatctttttactccccgctcggtag

SEQ ID NO: 738 - DNA, 9406 bp, Hepatitis C Virus
cactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggataaacccactctatgtccggtcatttgggcgtgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacacaaaccgccgcccacaggacgtcaagttcccgggtggcggccagatcgttggcggagtttacttgctgccgcgcaggggccccaggttgggtgtgcgcgcgacaaggaagacttccgagcgatcccagccgcgtgggagacgccagcccatcccgaaagatcggcgctccgtcggcaagtcctggggaaagccaggatatccctggcccctgtacggaaacgagggttgcggttggacaggttggctcctgtccccccgcgggtctcgtcctacttggggccccactgacccccggcatagatcacgcaatttgggcaaagtcatcgacaccattacgtgtggttttgccgacctcatggggtacatccctgtcgttggcgccccggtcggaggcgtcgccagagctctggcacacggtgttagagtcctggaagacgggataaattatgcaacagggaatctacccggttgctctttttctatcttcttacttgctcttctgtcgtgcgtcacagtgccagtgtctgcagtggaagtcaggaacattagttctagctactacgccactaatgattgctcgaacaacagcatcacctggcagctctctaacgcagttctccaccttcctggatgcgtcccatgtgagaatgataacggcaccttgcgctgttggatacaagtgacacctaacgtggctgtgaagcatcgcggcgcactcactcataacctgcgaacacacgtcgacatgatcgtaatggcagctacggtctgctcggccttgtacgtgggagatgtgtgcggggccgtgatgatcgtgtcacaggctctcatagtgtcgccggaacgccacaacttcacgcaagagtgcaactgttccatctaccaaggtcacgtcaccggccaacgcatggcatgggacatgatgcttaactggtcaccaactcttaccatgatcctcgcctacgctgctcgtgttcccgagatggtccttgaaattattttcggcggccattggggtgtggtgtttggcttggcctacttctccatgcagggagcgtgggccaaagtcattgccatcctccttcttgtcgcgggagtggatgcaaccacctattccagcggcgcgcaagtgggtcgtgcccttggcgggctcactggtattttcagccctggtgccaagcagaatatccagttgatcaacaccaatggcagctggcacataaaccggaccgccctcaattgcaatgacagcttgcagacgggtttcatcgcttccctgttttacacccatagattcaacagctctggctgtcccgagcgcttgtcttcctgccgcgggctggacgattttcgtatcgggtggggaaccttggaatacgagaccaatgtcaccaatgacgaggacatgaggccatactgctggcattaccccccgaagccttgcggtatcgtctcggctaagacggtttgcgggccggtctattgttttacccctagccctgttgtcgtgggcaccaccgacaggcagggcgtgcccacctatagctggggggagaacgagaccgatgtctttctgctaaatagcactagacccccgcaaggagcttggttcggctgcacttggatgaacgggactgggttcactaagacatgcggagcaccaccttgccgcattaggagggactacaacagcactctcgatctattgtgccccacagactgttttaggaagcacccagatgctacctatcttaagtgcggagcagggccctggttgacccccaggtgcctggtagaatacccttatagactgtggcattatccgtgcactgtaaactttaccatcttcaaagtacggatgtatgtagggggggtggagcatcggttatccgcagcatgtaacttcacgcgcggggaccgatgcagattggaagatagggataggggtcagcagagcccactgctgcattccaccactgagtgggcggtgttgccatgctccttctccgacctacccgcactatctactggcctattgcacctccaccagaacatcgtggacgtgcagtacctctatggactttctccggctcttacaagatacatcgtaaagtgggaatgggtggtcctccttttcttgttgttggcagatgccagggtctgtgcatgtctttggatgctcatcatactgggccaagccgaggcggcgcttgagaagctcatcatcttgcactccgctagcgctgctagtgctaacgggccgttgtggtttttcatcttcttcacggcggcctggtacttaaagggcagggtggtccccgtggccacatactctgttctcggtttgtggtcctttcttctcctagtcctggccttaccacagcaggcttatgccatggacgccgctgaacaaggggaactagggctggtcatactagtaatcatatccatctttactcttactccagcatacaagattctcctgagccgttcagtgtggtggctctcctatatgctggtcttggccgaggcccagattcagcagtgggttccccccctggaggcccgaggggggcgtgacgggattatctgggtggctgtcattctacacccacgccttgtgtttgaggtcacgaaatggttgctagcaatcctggggcctgcctatctccttaaagcgtctctgctgcgggtaccatactttgtgagggcccacgccctgctacgagtgtgtaccctggtgaggcacctcgcaggagctaggtatgtccagatgctgttgcttaccatgggcaggtggacaggcacttacatctatgaccacctctcccctttgtcaacttgggccgcccagggtttgcgggacctggcagtcgccgtggagcctgttgtgttcagcccaatggagaagaaggtcattgtgtggggggctgagacagtggcatgcggagacatcctgcatggcctcccggtttccgcgaggctaggtagggaagtcctgctcggccctgccgatagctacacctcgaaggggtggaagctcctggctcccattactgcttacactcagcagactcgtggcctcttgggtgctatcgtggtcagtctaactggccgcgacaaaaatgagcaggctgggcaggtccaggtcctgtcctccgtcacacaatcttttttggggacatgtatttcgggggtcctctggacggtatatcacggggctggtaataagaccttggctggccccaagggaccagtcactcagatgtacaccagcgcggagggagacctcgtgggatggcctagcccccccgggactaagtcattagacccctgtacttgcggggccgtggacctctacctggtctcccgaaacgctgatgtcattccagtccggaggaaagatgaccgacggggcgcactactttcgccacggcctctctcaaccctcaaaggatcttctggcggacccgtactctgctctaggggacatgtcgtgggcttgttcagagctgccgtgtgcgccaggggtgtggccaaatctattgacttcatccctgttgaatctctcaatatcgccacacggacgcctagcttctctgacaacagtacgccaccggctgtgccccagacttaccaagtgggctacttgcacgcaccaacaggcagcgggaagagcaccaaggtcccggccgcatatgccagccaggggtataaagtacttggactgaatccctctgtcgcggccacgcttggttttggggcctacatgtccaaagcccacgggatcaaccctaatatcagaaccggggtgcggactgtgaccaccggggaccccatcacttactccacttatggcaagtttgtcgcagatggaggctgtcaagctggcgcctatgacatcatcatatgcgacgaatgccactcggtggacgctactaccatccttggtattggaacagtcctcgatcaggctgagactgcaggcgtcaggctggtggtcctggccacagctacgcctcctggtacggtgacaactccccacagcaacatagaggaggtggcccttggccatgaaggcgagatccctttttatggcaaggctattcctctagctttcatcaaagggggcagacacctgatcttttgccattcaaagaagaagtgcgacgagcttgcagcagcccttcgaggcatgggtgtcaacgccgttgcctactacaggggtctcgacgtctccgttataccaactcaaggagacgtggtggttgtagccaccgatgccctaatgactggatacaccggtgactttgactctgtcattgactgcaacgttgcagtcactcagattgttgactttagcctagacccaaccttcaccatcaccactcaaactgtccctcaggacgctgtctcccgtagtcaacgtagagggagaactgggaggggtcgactgggcacttacaggtatgtctcgtcaggcgagaggccgtctgggatgttcgacagcgtggtgctctgcgagtgctacgatgccggagcagcctggtacgagcttacgcctgctgagactacggtgagactccgggcttatttcaacacgcctggtttgcccgtgtgtcaagaccacctggagttctgggaggcagtcttcacaggtcttacacacattgatgcccacttcctctcccagacgaagcaaggaggggaaaactttgcgtatctaacggcctaccaggccacagtatgcgctagggcaaaggccccccctccttcgtgggacgtgatgtggaagtgtctaactaggctcaaacccacactgacaggtccaacccccctcctataccgcttgggtgccgtgaccaacgaggttaccttaacgcaccccgtgacgaaatacatcgccacgtgcatgcaagctgacctcgagatcatgacaagcacatgggtcctggcagggggggtgctagccgccgtggcagcttactgcctggcgactggctgcgtctccatcatcggccgcttacacctgaatgatcaggtagttgtagcccctgacaaagaaatcttatatgaggcctttgatgaaatggaagaatgcgcctccaaagccgccctcattgaggaagggcagcggatggcggagatgctcaagtccaagatacagggcctcttacaacaggccacaagacaggcccaagacgtacagccagtcatacagtcatcatggcctaagcttgaacaattttgggccaaacacatgtggaacttcatcagtggcatacagtacctggcgggactatccaccttaccggggaatcccgcagtggcatcaatgatggctttcagcgccgcattgactagcccgctacccaccagcaccaccatcctcttgaacatcatggggggatggttggcctcccagattgccccccctgctggggccactggcttcgttgtcagtggtctagtgggggcggccgtcgggagcataggcctgggtaagatactggtggacgttttggccgggtacggcgcaggcatttcaggggccctcgtagcttttaaaatcatgagcggcgagaagccctcggtggaagacgtcgtgaatctcctgcctgccattttgtctcctggcgctttggtagtaggggtcatctgtgcggcaatcctgcgccgccacatcggccagggagagggggcggtccagtggatgaacagactgatcgccttcgcctccagaggaaaccatgttgcccctacccactacgtcgcggagtcggacgcttcgcagcgcgtgacgcaggtgctgagttcactcacaatcaccagcttgcttaggagactacatgcctggatcactgaagattgcccagtcccatgttcggggtcttggctccaggacatttgggattgggtttgttccattctcacagactttaagaactggctgtcttcaaaattgctccccaaactgcccggccttcccttcatctcttgccaaaagggatacaggggtgtatgggctggcacgggagtcatgactactcggtgtccatgcggagcaaacatttcgggccatgtccgcatgggtaccatgaaaataacaggcccgaagacctgcctgaacctgtggcaggggaccttccccattaattgttacacagaagggccttgcgtgccaaagcccccccccaattataagaccgcaatttggagggtggcagcgtcggagtacgttgaggtcacgcagcatggctctttctcgtacgtaacggggttaaccagtgacaaccttaaggtcccttgccaggtgccagctccagagtttttctcttgggtggacggggtgcaaatacaccgattcgcccccactccaggccccttcttccgggatgaggtaacgttcaccgtaggcctaaattcctttgtggtcggctctcagctcccttgcgaccctgagccggacaccgaggtattggcctccatgttgacagacccgtcccatatcaccgcggaggcggcagccaggcgactggccaggggatctcccccttcacaggccagctcttcagcgagccagctctccgccccgtccttgaaggctacctgtaccacccataagacagcatatgactgtgacatggtggatgctaacctgttcatgggaggcgacgtgacccggattgagtctgactctaaggtgatcgttctcgactccctcgattccatgactgaggtagaggacgatcgtgagccttctgtaccatcagagtacttgatcaggaggagaaagttcccaccggcactacctccctgggcccgtccagactacaaccctcccgtgatcgagacatggaagaggccggactatgaaccacccactgtcctaggctgtgcccttccctccacacctcaagtgccagtgcccccacctcggaggcgccgcgccagagttctgactcaggacaatgtggagggggtcctcagggagatggcggacaaagtgctcagccctctccaagaccacaatgactccggtcactccactggagcggataccggaggagacagcgtccagcagccctctgacgagactgccgcctcagaaacgggatcactgtcctccatgcctccccttgagggagagccgggggaccctgacctggagtttgaaccagcaagatccgcccccccctctgagggggagtgcgaggtcattgattcggactctaagtcgtggtccacagtctctgatcaagaggattctgttatttgctgctccatgtcatactcctggacaggagccctcataacaccgtgtgggcccgaggaggagaagttgccgatcaaccctctgagtaactcgctcatgcggttccacaacaaggtgtactccacaacctcgaggagtgcctctctgagggcaaagaaggtgacttttgacagggtgcaggtgctggacacacattatgattcagtcttgcaggacgttaagcgggccgcctccaaggttagtgcgaggctcctctcaatagaggaagcctgcgcgctgaccccgccccactccgccaaatcacgatacggatttggggcaaaggaggtgcgcagcttatccaggagggccgtcaaccacatccggtccgtgtgggaggacctcctggaagaccaacatactccaattgacacaactatcatggccaaaaatgaggtgttctgtgtcgatcccaccaaaggcgggaaaaagccagctcgcctcatcgtataccccgaccttggggtcagggtgtgtgaaaagatggccctctatgacatcgcacaaaagcttcccaaggcaataatggggccatcctatgggttccaatactctcctgcagaacgggtcgattttctccttaaagcttggagaagtaagaaggacccaatggggttctcatatgacacccgctgctttgactcaactgtcacggagagggacataagaacagaagaatccatatatcaggcttgttccctgcctcaagaggccagaactgtcatacactcgctcactgagagactctacgtaggagggcccatgacaaacagcaaagggcaatcctgcggttacaggcgttgccgcgcaagcggtgttttcactaccagcatggggaataccatgacatgctacatcaaagcccttgcggcgtgtaaagctgcagggatcgtggaccctatcatgctggtgtgtggagacgacctggtcgtcatctcagagagccaaggtaacgaggaggacgagcgaaacctgagagctttcacggaggctatgaccaggtattccgcccctcctggtgaccttcccagaccggaatatgacttggagcttataacatcctgctcctcaaacgtatcggtagcgctggaccctcggggtcgccgccggtacttcctaaccagagaccctaccactccaatcacccgagctgcttgggaaacagtaagacactcccctgtcaattcttggctgggcaacatcattcaatacgcccctacaatctgggtccggatggtcataatgacccacttcttctccatactattggcccaggacactttgaaccaaaatctcaattttgagatgtatggggcagtatattcggtcaatccattagacctaccggccataattgaaaggctgcatgggcttgatgccttttcactgcacacatactctccccacgaactctcacgggtggcagcgactctcagaaaacttggagcgcctcccctcagagcgtggaagagtcgggcgcgtgccgtgagggcctcactcatcgcccagggagggagggcggccatttgcggtcgctacctctttaactgggcggtgaagacaaagctcaaactcactccattgcccgaggcgagccgcctggatttatccgggtggttcaccgtgggcgccggcgggggcgacatttttcacagcgtgtcgcgcgcccgaccccgcctattactcctttgcctactcctacttagcgtaggagtaggcatctttttactccccgctcggtag

SEQ ID NO: 739 - DNA, 9406 bp, Hepatitis C Virus
cactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccggaaagactgggtcctttcttggataaacccactctatgtccggtcatttgggcgtgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacacaaaccgccgcccacaggacgtcaagttcccgggtggcggccagatcgttggcggagtttacttgctgccgcgcaggggccccaggttgggtgtgcgcgcgacaaggaagacttccgagcgatcccagccacgtgggaggcgccagcccatcccgaaagatcggcgctccactggcaagtcctggggaaaaccaggatatccttggcctctgtacggaaacgagggctgcggctgggcaggttggctcctgtccccccgtgggtctcgtcctacttggggccccaccgacccccggcatagatcacgcaatttgggcagagtcatcgataccattacgtgtggttttgccgacctcatggggtacatccctgtcgttggcgccccggtcggaggcgtcgccagagctctggcacatggtgttagagtcctggaagacgggataaattatgcaacagggaacttgcctggttgctctttttctatcttcttgcttgctcttttatcatgctgcacagtgccagtgtctgcagtggaagttaggaacatcagtactagctactacgccactaatgattgctcgaacaccagcatcacctggcagctcaccaacgcagttctccaccttcctggatgcgttccatgtgagaatgacaatggcaccctgcgctgctggatacaagtgacacctaatgtggctgtgaaacaccgtggcgcactcactcacaacctgcgaacacatgtcgacgcgatcgtaatggcagctacggtctgctcggccttgtatgtgggagacatgtgcggggccgtgatgatagtgtcgcaggctctcataatatcgccagaacgccacaacttcacccaagagtgcaactgttccatgtaccaaggtcacatcaccggccaccgcatggcatgggacatgatgctaaattggtcaccaactcttaccatgatcctcgcctatgcggctcgtgttcccgagctagtccttgaggttatctttggcggccattggggcgtggtgtttggcttggcctatttctccatgcaaggagcgtgggccaaagtcattgccatcctccttcttgttgcaggagtggatgcaaacacctattcctccggcgtaacagtgggtcacaccacttccacgttcgccaacatctttacggtcggtcctagccagaaaatcaacctaatcaacaccaatggcagctggcacataaaccggaccgccctcaattgcaatgacagcttgcagacgggtttcctcgcttccctgttttacgtcaggaacttcaacagctctggctgccgcgagcgcttgtcttcctgccgcaggctggacgattttcgcatcgggtggggaaccttggaatatgagactaatgtcaccaatgatgaagacatgcggccatactgctggcattaccctccgaagccgtgcggtatcgtctcggctaggacggtttgcgggccggtttactgctttactcctagccctgttgttgtgggtactaccgacaggcagggcgtgcccacctatagctggggggaaaatgagaccgatgtcttcctcctaaacagcacgaggcccccgcgaggagcttggtttggctgcacttggatgaacgggactgggttcaccaagacatgcggcgcaccaccatgccgcattaggagggattacaacagcactctcgatctgttatgccctacagattgttttaggaaacatccagacaccacctatcttaagtgcggggcagggccttggttgacccccaaatgcctagtggattacccctatagattgtggcattatccgtgcaccgtgaactttaccatcttcaaggtgcggatgtatgtagggggggtggagcatcgattgtccgcagcatgcaacttcacgcgcggggaccgctgtgggttggaagatagggacaggggtcagcaaagtccactgctgcattctaccactgagtgggcggtgttgccatgctctttctccgacctaccggcgctatccactggtctattgcacctccaccaaaacatcgtggacgtgcagtatctctatggactttccccggctattacaagatacatcgtgaagtgggaatgggtggtcctccttttcttattattggcagacgccagggtctgtgcatgcctttggatgctcatcatactgggccaggccgaggcggcgcttgagaagctcatcatcttgcactccgctagtgccgctagtgccaatgggctgctgtggttcttcatcttctttacagcggcctggtacttaaagggcagagtggtccccgtggccacgtactctgttctcggcttgtggtccttcctcctcttagtcctggccttgccacggcaggcttatgccctggacgccactgaacaaggggaactgggactggtcatgattgtaatcatatccatctttactcttaccccagcatacaagactcttttgagccggtcagtatggtggctgtcctacatgctagtcttggccgaggccctgattcagcaatgggctccccccctggaggtacgaggggggcgtgacggaatcatctgggtggctgtcattctacatccacgccttgtgtttgaggtcacgaaatggttgttagcggtcctggggcctgcctacctcctcagggaatccctgctacgggtgccatactttgtgagggctcacgccctactacgagtgtgcaccctggtgagacacctcgcaggagctaagtacatccagatgctgttgatcaccataggtaggtggaccggcacttacatctatgaccacctctcccctttgtcaacttgggcagctcagggtctacgagacttggcagtcgccgtggagcctgtagtgtttagcccaatggagaagaaagtcattgtgtggggggctgagacagtggcatgtggggacatcctgcatggcctcccggtttccgcgaggctaggtagggaagttctgctcggccctgccgatggctacacctcgaaagggtggaagctcctagctcccatcactgcttatactcagcagactcgtggccttctaggtgctatcgtggtcagcctgactggtcgcgacaagaatgagcaggcagggcaggtccaggttctgtcctccgtcacacaatccttcttggggacatctatttcgggggtactctggacagtgtatcacggggctggtaataagaccttggccggtcccaaaggaccagtcactcaaatgtacaccagcgcagaaggggacctcgtgggatggcctagcccccccgggactaagtctttagacccctgcacctgcggggccgtggacctctacctggtcacccgaaacgccgatgtcattccagtccggaggaaagatgaccggcggggtgcactactctcgccgaggcctctttcaaccctcaagggatcatccggtggacccgtgctttgctccagaggacatgccgtgggcttgttcagagcagccgtgtgcaccaggggtgtggccaaatctattgacttcatccctgttgagtctctcgatattgctgcacggtcacccagtttttctgacaacagcacaccaccagctgtgcctcagtcttaccaggtaggctacttgcacgcaccaacaggcagtgggaagagcaccaaggtccctgccgcatatgccagtcaggggtataaagtacttgtactaaatccctctgtcgcggctacacttggttttggggcctacatgtccaaagcccacgggatcaaccccaatatcagaaccggagtacggactgtgaccactggggaccccatcacttattccacttatggcaaattccttgcagacgaaggttgctcagctggcgcctatgacgtcatcatatgcgatgaatgccatgcagtggactccaccaccatccttggcattgggacagtcctcgaccaggccgagactgcaggagtcaggctagtggttttggccacggccacgcctcctggtacagtgacaactccccatagtaacatagaggaggtggctcttggtcatgaaggcgagatccctttttacggcaaggctattcctctagctttcatcaaagggggcagacacctgatcttctgtcattcaaagaagaagtgcgatgaactcgcagcagcccttcggggcatgggtgtcaacgccgttgcttactacaggggcctcgacgtctccgtcataccaactcaaggcgacgtggtggttgttgccactgatgccctaatgactggatacaccggtgacttcgactctgtcatcgactgcaacgttgcagtcactcagattgttgactttagcctagacccaacctttaccatcactactcaaaccgtcccccaggacgctgtctcccgtagtcaacgtagagggagaactgggagggggagattgggcatttataggtatgtctcgtcgggcgaaaggccgtccgggatgttcgacagtgtagtgctctgcgagtgctacgacgctggggcagcctggtacgaacttacgcccgccgagactacagtgagactccgggcctatttcaacacgcccggcctgcccgtgtgtcaagaccacctggaattctgggaggctgtcttcacaggtctcacgcacattgatgcccacttcctctcccagacaaagcaaggaggagacaactttgcatatctaacagcctaccaggccacggtctgtgctagggcaaaggctccccctccttcgtgggacgtgatgtggaagtgtctaactaggctcaaacctacactgactggtcctacccccctcctgtaccgcttgggtgctgtgaccaacgaggttaccctcacacaccccgtgacaaaatacatcgccacgtgcatgcaagctgacctcgagatcatgacaagcacatgggtcttggcagggggggtgctggccgctgtggcagcttactgcctagcgaccggctgcgtttccatcattggccgcctacacctgaatgatcgggtggttgtgacccctgacaaggaaatcctatatgaggcctttgatgagatggaagaatgcgcctccaaagccgccctcattgaggaggggcagcggatggcggagatgctgaagtccaagatacaaggcctcttacaacaggccacaagacaggcccaagacatacagccagctatacagtcatcatggcctaagcttgaacaattttgggccaaacacatgtggaactttatcagcggtatacaatacctggctggactctccaccctaccgggaaatcccgcagtggcatcaatgatggcttttagcgccgcattgactagcccactacccaccagcaccaccatcctcttgaacatcatgggaggatggttggcctctcagattgccccccctgccggagccactggctttgttgtcagtggcctagtaggggcggccgtcgggagtataggcctgggtaagatactggtggacgttttggccgggtatggtgcaggcatctcaggggccctcgtagcttttaagatcatgagcggcgagaagccctcggtagaggatgttgtgaatctcctgcccgctatcctatctcctggcgctttggtggtgggagtcatctgtgcggcgatcttgcgccgccacgttggccagggagagggggcggtccagtggatgaacagactcattgcctttgcctccagagggaaccatgttgcccccacccactacgtggcagagtctgacgcctcgcagcgcgtgacgcaagtgttgagttcgctcacaattaccagcttgcttaggaggctacatacctggatcactgaagattgcccagtcccgtgctcggggtcttggctccgagacatttgggattgggtttgttccattctcacagactttaagaactggctgtcttcaaaattgctccccaaaatgcccggccttccttttatctcttgccaaaaggggtacagaggtgtatgggctggcacgggggtcatgacaactcggtgtccatgcggagcaaacatctcgggccatgtccgcatgggtaccatgaaaataacaggcccaaagacctgcttgaacttgtggcaggggaccttccccatcaatgcttacacagaagggccttgcgtgcccaaaccccctcctaattataagaccgcaatttggagggtagcagcgtcggagtacgttgaggttacgcagcatggctctttctcgtacgtaacggggttaaccagtgacaaccttaaggttccttgccaggtaccagctccagaattcttctcttgggtggacggggtgcagatacatcgattcgcccccactccgggtcccttcttccgggatgaggtaacgtttactgtaggcctcaattcctttgtggtcggctctcagctcccttgcgaccctgagccggacaccgaggtgttggcctccatgttgacagacccgtcccacattacggcggaggcggcagcgaggcggttggccaggggatctcccccctcacaggccagctcttcggcgagccagctctccgccccatccttgaaggctacctgtaccacccataaaatgggatatgactgtgacatggtggatgctaaccttttcatgggaggcgatgtgacccggatcgagtccaactcgaaggtgattgttctagactccctcgattccatgactgaggtagaggacgatcgtgagccttctgtaccatctgagtacttgatcaggaggaaaaagttcccaccggcactacctccctggggccgtccagactacaaccctcctgttattgagacatggaacaggccggactatgaaccacccactgtcctaggttgtgccttcccccccgcatcccaaacaccagtgcccccgccgcgaaggcgccgcgccaaggttctgactcaggacaatgtggagggggtcctcagggagatggcagacaaagtgctcagccctctccaagatctcaatgactccggtcactccactggagcggataccgggggggacagcgtccagcagccctccgatgagactgccgattcagaagcgggatcactgtcctccatgccccctcttgagggagagccgggggaccctgacctggagttcgagccagctggatccactcccccttccgagggggagtgtgaggccattgattcggactctaagtcgtggtccacagtctctgaccaagaggattctgttatctgctgctctatgtcatactcctggacgggagccctcataacaccatgtgggcccgaggaggagaagttgccaatcaaccctctgagcaattcgctcatgcgatttcataacaaggtgtactccacaacctcaaggagtgcctctctgagggcaaagaaggtgaccttcgacagggtgcaggtgctggacgcacactatgactcagtcttgcaggacgttaagcaggccgcctctaaagttagtgcgaggctcctctcagtagaggaagcctgcgcgctgaccccgccccattccgccagatcacgatacggatttggggcaaaagaggtgcgcagcttatccaggagggccgtcaaccacattcggtccgtgtgggaggacctcctggaagaccaacatactccaattgacacaactatcatggccaaaaatgaggtgttttgtattgatcccgctaaaggcgggaagaaggcagctcgccttatcgtgtaccctgaccttggggtcagggtgtgcgagaagatggccctctatgacattgcacaaaaacttcccaaggcaataatgggaccatcctatgggttccaatactctcctgcagagcgggtcgattttctcctcaaggcatggggaagtaaaaaggacccaatggggttctcgtatgacacccgctgctttgactcaaccgtcacggagagggacataagaacagaagaatccatataccaggcttgttccctgcctcaagaggccagaactgtcatacattcgctcactgagagactttacgtaggagggcccatgataaacagcaaagggcaatcctgtggttacaggcgttgccgcgcaagcggcgttttcactaccagcatggggaacaccatgacatgttacatcaaagcccttgcagcgtgcaaagctgcagggatcgtgaaccccgatatgttggtgtgtggagacgacctggtcgtcatctcagagagccaaggcaacgaggaggacgagcgaaacctgagagctttcacggaggctatgaccaggtattcagcccctcccggtgaccttcccagaccagaatatgacttggagctcataacatcctgctcctcaaatgtatcggtagcgctggaccctcggggtcgccgccggtactacctaaccagagaccctaccactccaatctcccgagctgcttgggaaacagtaagacactcccctgtcaattcttggctgggtaatatcatccaatacgcccctacaatctgggtccggatggtcataatgacccacttcttctccatactattggcccaggacactctgaaccagaatctcaattttgagatgtatggggcagtatattcggtcaatccattagacctaccagccataattgaaaggctacatgggctcgatgccttttcactgcacacatactctccccacgaactctcacgggtggcagcaactctcagaaagcttggagcgcctccccttagagcgtggaagagtcgggcgcgtgctgtgagggcctcactcattgcccagggagggagagcggccatttgtggacgctacctcttcaactgggcggtgaagacaaagctcaaactcactccattgcccgaggcgagccgcctggatttatccgggtggttcaccgtgggcgccggcgggggcgacatctttcacagcgtgtcgcatgcccggccccgcctattactcctttgcctactcctacttagcgtaggagtaggcatctttttactccccgctcggtag

SEQ ID NO: 740 - DNA, 9406 bp, Hepatitis C Virus
cactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggataaacccactctatgtccggtcatttgggcgtgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacacaaaccgccgcccacaggacgtcaagttcccgggtggcggccagatcgttggcggagtttacttgctgccgcgcaggggccccaggttgggtgtgcgcgcgacaaggaagacttccgagcgatcccagccacgtgggaggcgccagcccatcccgaaagatcggcgctccactggcaagtcctggggaaaaccaggatatccttggcctctgtacggaaacgagggctgcggctgggcaggttggctcctgtccccccgtgggtctcgtcctacttggggccccaccgacccccggcatagatcacgcaatttgggcagagtcatcgataccatcacgtgtggttttgccgacctcatggggtacatccctgtcgttggcgccccggtcggaggcgtcgccagagctctggcacatggtgttagagtcctggaagacgggataaattatgcaacagggaacttgcctggttgctctttttctatctttttgcttgctctcttatcatgctgcacggtgccagtgtctgcagtggaagttaggaacatcagtactagctactacgccactaatgattgctcaaacaccagcatcacctggcagctcaccaacgcagttctccaccttcctggatgcgttccatgtgagaatgacaatggcaccctgcgctgctggatacaagtaacacctaatgtggctgtgaaacatcgtggcgcactcactcacaacctgcgaacacatgtcgacgtgatcgtaatggcagctacggtctgctcggccttgtatgtgggagacatatgcggggccgtgatgatagtgtcgcaggctttcataatatcgccagaacgccacaacttcacccaagagtgcaactgttccatgtaccaaggtcacatcaccggccaccgcatggcatgggacatgatgctaaattggtcaccaactcttaccatgatcctcgcctacgcggctcgtgttcccgagctagtccttgaggttatctttggcggccattggggcgtggtgtttggcttggcctatttctccatgcaaggagcgtgggccaaagtcattgccatcctccttcttgttgcaggagtggatgcaaacacctattcctccggtgtaacagtgggtcacaccacctccacgttcgccaacatcttttcagtcggtcctagccagaaaatcaacctaatcaacaccaatggcagctggcacataaaccggaccgccctcaattgcaatgacagcttgcagacgggtttcctcgcttccctgttttacgtcaggaacttcaacagctctggctgccgcgagcgcttgtcttcctgccgcaggctggacgattttcgcatcgggtggggaaccttggaatatgagactaatgtcaccaatgatgaagacatgcggccatactgctggcattaccctccgaagccttgcggtatcgtctcggctaggacggtttgcgggccggtttactgctttactcctagccctgttgttgtgggtactaccgacaggcagggcgtgcccacctatagctggggggaaaatgagaccgatgtcttcctcctaaacagcacgaggcccccgcgaggagcttggtttggctgcacttggatgaacgggactgggttcaccaagacatgcggcgcaccaccatgccgcattaggagggattacaacagcactctcgatctgttatgccctacagattgttttaggaaacatccagacaccacctatcttaagtgcggggcagggccttggttgacccccaaatgcctagtggattacccctatagattgtggcattatccgtgcaccgtgaactttaccatcttcaaggtgcggatgtatgtagggggggtggagcatcgattgtccgcagcatgcaacttcacgcgcggggaccgctgtgggttggaagatagggacaggggtcagcaaagtccactgctgcattctaccactgagtgggcggtgttgccatgctctttctccgacctaccggcgctatccactggtctattgcacctccaccaaaacatcgtggacgtgcagtatctctatggactttccccggctattacaagatacatcgtgaagtgggaatgggtggtcctccttttcttattattggcagacgccagggtctgtgcatgcctttggatgctcatcatactgggccaggccgaggcggcgcttgagaagctcatcatcttgcactccgctagtgccgctagtgccaatgggctgctgtggttcttcatcttctttacagcggcctggtacttgaagggcagagtggtccctgtggccacgtactctgttctcggcttgtggtccttcctcctcttagtcctggccttgccacggcaggcttatgccctggacgccactgaacaaggggaactgggactggtcatgattgcaatcatatccatctttactcttaccccagcatacaagactcttttgagccggtcagtgtggtggctgtcctatatgctagtcttggccgaggccctgattcagcaatgggctccccccctggaggtgcgaggggggcgtgacggaatcatctgggtggctgtcattctacatccacgccttgtgtttgaggtcacgaaatggttgttagcggtcctggggcctgcctacctcctcagggaatccctgctacgggtgccatactttgtgagggctcacgccctactacgagtgtgtaccctggtgagacacctcgcaggagctaagtacatccagatgctgttgatcaccataggtaggtggaccggcacttacatctatgaccacctctcccccttgtcaacttgggcagctcagggtctacgggacttggcagtcgccgtggagcctgtagtgtttagcccaatggagaagaaagtcattgtatggggggctgagacagtggcatgtggggacatcctgcatggcctcccggtttccgcgaggctaggtagggaagttctgctcggccctgccgacggctacacctcgaaagggtggaagctcctcgctcccatcactgcttatactcagcagactcgtggccttctaggtgctatcgtggtcagcctgactggtcgcgacaagaatgagcaggcagggcaggtccaggttctgtcctccgtcacacaatccttcttggggacatctatttcgggggtactctggacagtgtatcacggggctggtaataagaccttggccggtcccaaaggaccagtcactcaaatgtacaccagcgcagaaggggacctcgtgggatggcctagcccccccgggactaagtctttagacccctgcacctgcggggccgtggacctctacctggtcacccgaaacgccgatgtcattccagtccggaggaaagatgaccggcggggtgcactactctcgccgaggcctctttcaaccctcaagggatcatctggtggacccgtgctttgctccagaggacatgccgtgggcttgttcagagcagccgtgtgcaccaggggtgtggccaaatctattgacttcatccctgttgagtctctcgacattgctgcacggtcgcccagtttttctgacaacagcacgccaccagctgtgcctcagtcttaccaggtaggctacttgcacgcaccaacaggcagtgggaagagcaccaaggtccctgccgcatatgccagtcaggggtataaagtacttgtactaaatccctctgtcgcggctacacttggttttggggcctacatgtccaaagcccacgggatcaaccccaatatcagaaccggagtacggactgtgaccactggggaccccatcacttattccacttatggcaaattccttgcagacgaaggttgctcagctggcgcctatgacgtcatcatatgcgatgaatgccatgcagtggactccaccaccatccttggcatcgggacagtcctcgaccaggccgagactgcaggcgccaggctagtggttttggccacggccacgcctcctggtacagtgacaactccccatagtaacatagaggaggtggctcttggtcatgaaggcgagatccccttttacggcaaggctattcctctagctttcatcaaagggggcagacacctgatcttctgtcattcaaagaagaagtgcgatgaactcgcagcagcccttcggggcatgggtgtcaacgccgttgcttactacaggggcctcgacgtctccgtcataccaactcaaggcgacgtggtggttgttgccactgatgccttaatgactggatacaccggtgacttcgactccgtcatcgactgcaacgttgcagtcactcagattgttgactttagcctagacccaacctttaccatcactacccaaaccgtcccccaggacgctgtctcccgtagtcaacgtagagggagaactgggagggggagattgggcatttataggtatgtctcgtcgggcgaaaggccgtccgggatgttcgacagtgtagtactctgcgagtgctacgacgctggggcagcctggtacgaacttacgcccgccgagactacagtgagactccgggcctatttcaacacgcccggcctgcccgtgtgtcaagaccacctggaattctgggaggctgtcttcacaggtctcacgcacattgatgcccacttcctctcccagacaaagcaaggaggagacaactttgcatatctaacagcctaccaggctacggtctgtgctagggcaaaggctccccctccttcgtgggacgtgatgtggaagtgtctaactaggctcaaacctacactgactggtcctacccccctcctgtaccgcttgggtgctgtgaccaacgaggttaccctcacacaccccgtgacaaaatacatcgccacgtgcatgcaagctgacctcgagatcatgacaagcacatgggtcttggcagggggggtgctggccgctgtggcagcttactgcctagcgaccggctgcgtttccatcattggccgcctacacctgaatgatcgggtggttgtgacccctgacaaggaaatcctatatgaggcctttgatgagatggaagaatgcgcctccaaagccgccctcattgaggaggggcagcggatggcggagatgctgaagtccaagatacaaggcctcttacaacaggccacaagacaggcccaagacatacagccagctatacagtcatcatggcctaagcttgaacaattttgggccaaacacatgtggaactttatcagtggtatacaatacctggctggactctccaccctaccgggaaatcccgcagtggcatcaatgatggcttttagcgccgcattgactagcccactacccaccagcaccaccatcctcttgaacatcatgggaggatggttggcctctcagattgccccacctgccggggccactggctttgttgtcagtggcctagtaggggcggccgtcgggagtataggcctgggtaagatactggtggacgttttggccgggtatggtgcaggcatctcaggggccctcgtagcttttaagatcatgagcggcgagaagccctcggtagaggatgttgtgaatctcctgcccgctatcctgtctcctggcgctttggtggtgggagtcatctgtgcggcgatcttgcgccgccacgttggccagggagagggggcggtccagtggatgaacagactcattgcctttgcctccagagggaaccatgttgcccccacccactacgtggcagagtctgacgcctcgcagcgcgtcacgcaagtgttgagttcgctcacaattaccagcttgcttaggaggctacatacctggatcactgaagattgcccagtcccgtgctcggggtcttggctccgagacatttgggattgggtttgttccattctcacagactttaagaactggctgtcttcaaaattgctccccaaaatgcccggccttccttttatctcttgccaaaaggggtacagaggtgtatgggctggcacgggggtcatgacaactcggtgtccatgcggagcaaacatctcgggccatgtccgcatgggtaccatgaaaataacaggcccaaagacctgctggaacttgtggcaggggaccttccccatcaatgcttacacagaagggccttgcgtgcccaaaccccctcctaattataagaccgcaatttggagggtggcagcgtcggagtacgttgaggttacgcagcatggctctttctcgtacgtaacggggttaaccagtgacaaccttaaggttccttgccaggtaccagctccagaattcttctcttgggtggacggggtgcagatacatcgattcgcccccactccgggtcccttcttccgggatgaggtaacgtttactgtaggcctcaattcctttgtggtcggctctcagctcccttgcgaccctgagccggacaccgaggtgttggcctccatgttgacagacccgtcccacattacggcggaggcggcagcgaggcggttggccaggggatctcccccctcacaggccagctcttcggcgagccagctctccgccccatccttgaaggctacctgtaccacccataaaacgggatatgactgtgacatggtggatgctaaccttttcatgggaggcgatgtgacccggatcgagtccaactcgaaggtgattgttctagactccctcgattccatgactgaggtagaggacgatcgtgagccttctgtaccatccgagtacttgatcaggaggaaaaagttcccaccggcactaccttcctggggccgtccagactacaaccctcctgttattgagacatggaacaggccggactatgaaccacccactgtcctaggttgtgccttcccccccacatcccaaacaccagtgcccccgccgcgaaggcgccgcgccaaggttctgactcaggacaatgtggagggggtcctcagggagatggcagacaaagtgctcagccctctccaagatctcaatgactccggtcactccactggagcggataccgggggggacagcgtccagcagccctccgatgagactgccgattcagaagcgggatcactgtcctccatgcctcctcttgagggagagccgggggaccctgacctggagtttgaaccagctggatccactcccccttccgaaggggagtgtgaggccattgattcggactctaagtcgtggtccacagtctctgaccaagaggattctgtcatctgctgctctatgtcgtactcctggacaggagccctcataacaccatgtgggcccgaggaggagaagttgccaatcaaccctctgagcaattcgctcatgcgatttcataacaaggtgtactccacaacctcaaggagtgcctctctgagggcaaagaaggtgaccttcgacagggtgcaggtgctggacgcacactatgactcagtcttgcaggacgttaagcaggccgcctctaaagttagtgcgaggctcctctcagtagaggaagcctgcgcgctgaccccgccccattccgccagatcacgatacggatttggggcaaaagaggtgcgcagcttatccaggagggccgtcaaccacattcggtccgtgtgggaggacctcctggaagaccaacatactccaattgacacaactatcatggccaaaaatgaggtgttttgtattgatcccgctaaaggcgggaaaaaggcagctcgcctcatcgtgtaccctgaccttggggtcagggtgtgcgagaagatggccctctatgacattgcacaaaagcttcccaaggcaataatgggaccatcctatgggttccaatactctcctgcagagcgggtcgatttcctcctcaaggcatggggaagtaaaaaggacccaatggggttctcgtatgacacccgctgctttgactcaactgtcacggagagggacataagaacagaagaatccatatatcaggcctgttctctgcctcaagaggctagaactgtcatacactcgctcactgagagactctacgtaggagggcccatgacaaacagcaagggacaatcctgcggttacaggagatgccgcgcaagcggtgttttcactaccagcatggggaacaccatgacatgctacatcaaagcccttgcggcatgtaaagctgcagggattgtggaccccattatgctggtgtgtggagacgacctggtcgtcatctcagagagccaaggtaacgaggaggacgagcgaaacctgagagctttcacggaggctatgaccaggtactccgcccctcccggtgaccttcccagaccagaatatgacttggagctcataacatcctgctcctcaaatgtatcggtagcgctggaccctcggggtcgccgccggtactacctaaccagagaccctaccactccaatctcccgagctgcttgggaaacagtaagacactcccctgtcaattcttggctgggtaacatcatccaatacgcccctacgatctgggtccggatggtcataatgacccacttcttctccatactattggcccaggacactctgaaccagaatctcaattttgagatgtatggggcagtatattcggtcaatccattagacctaccagccataattgaaaggctacatgggctcgatgccttttcactgcacacatactctccccacgaactctcacgggtggcagcaactctcagaaaacttggagcgcctccccttagagcgtggaagagtcgggcgcgtgctgtgagggcctcactcattgcccagggagggagggcggccatttgtggacgctacctcttcaactgggcggtgaagacaaagctcaaactcactccattgcccgaggcgagccgcctggatttatccgggtggttcaccgtgggcgccggcgggggcgacatctttcacagcgtgtcgcatgcccggccccgcctattactcctttgcctactcctacttagcgtaggagtaggcatctttttactccccgctcggtag

SEQ ID NO: 741 - DNA, 9406 bp, Hepatitis C Virus
cactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggacaaacccactctatgtccggtcatttgggcgtgcccccgcaagactgctagccgagtagcgttgggttgcgaaaggccttgtggtactgcctgatagggtgcttgcgagtgccccgggaggtctcgtagaccgtgcatcatgagcacaatccctaaacctcaaagaaaaaccaaaagaaacacaaaccgtcgcccacaggacgtcaagttcccgggtggcggtcagatcgttggcggagtttacttgctgccgcgcaggggccccaggttgggtgtgcgcgcgacaaggaagacttccgagcgatcccagccgcgtggaagacgccagcccatcccgaaagatcggcgctccaccggcaagtcctggggaaagccaggatatccttggcctctgtacggaaacgagggttgcggctgggcaggttggctcctgtccccccgcgggtctcgtcctacttggggccccaacgacccccggcacagatcacgcaacttgggtaaagtcatcgataccattacgtgtggttttgccgacctcatggggtacatccctgtcattggcgccccggtcgggggcgtcgccagagctctggcacacggtgttagggttctggaagacgggatgaattacgcaacagggaatctacccggttgctccttttctatcttcttacttgctcttctgtcatgcgtcacagtgccagtgtctgcagtggaagtcaggaacatcagttctagctactacgccactaatgattgctcgaacaacagcatcacctggcagctcactaacgcagttctccaccttcctggatgcgtcccatgtgagaatgataatggcaccttgctctgttggatacaagtaacacccaacgtggctgtgaaacaccgcggcgcactcactcacaacctgcgaacgcacgtcgacatgatcgtaatggcagctacggtctgttcggccttgtacgtgggagacgtgtgcggggccgcgatgatcgtgtcgcaggctctcatagtatcgccagagcgccacaacttcacccaagagtgcaactgttccgtctaccaaggccatatcaccggccatcgcatggcatgggacatgatgttaaactggtcaccgactctcaccatgatcctcgcctacgctgctcgtgttcctgagctagtccttgaaattgtcttcggcggccactggggtgtgatgtttggcttggcctatttctccatgcagggagcgtgggccaaagtcattgccatcctccttcttgttgcgggagtggatgcacaaacctataccagcggtgcgcaagcaggtcacaccgcttttggcattgctcacctctttgcccgtggtccccaacagaagctccatttagtcaatagcaatggcagctggcacataaaccggactgccctcaactgcaatgacagcttaaacacgggtttcatcgcttccctgttctacgccaacaatttcaacagttctggctgtcccgagcgcttgtcttcctgccgcaggctggacgattttcgcatcgggtggggaactttggaatacgagaccaatgtcaccaatgatgagggcatgaggccgtactgctggcattaccctccgaggccttgcggtatcgtctcggctaggacggtttgcgggccggtctactgttttactcctagccctgttgtcgtgggcaccactgacaggcagggcgtacccacctatacctggggggaaaatgagaccgatgtcttcctgctaaatagtacaagacccccgcgaggagcttggttcggctgcacttggatgaacgggactgggttcaccaagacatgcggagcaccaccttgccgcattaggagagactacaacagcactcttgatctattgtgccccacagactgttttaggaagcacccaagtgctacctatcttaagtgtggagcagggccttggttgacccccaggtgcctgatagactacccttataggctatggcattatccgtgcactgtaaattttaccatcttcaaggtgcggatgtatgtagggggggtggagcatcggttgtccgcagcatgtaacttcacgcgcggagaccgctgcagactagaagacagggataggggtcagcagagtccactgctgcattccaccactgagtgggcagtgttgccatgctccttctccgacctaccggcactatccactggcctattgcacctccaccaaaacatcgtggacgtgcagtatctctatgggctttctccggctcttacgaggtacatcgtgaagtgggaatgggtggtcctccttttcctgttgttggcagacgccagggtctgtgcatgcctttggatgctcatcatactgggccaagctgaggcggcgcttgagaagcttattatcctgcactccgctagcgccgctagtgccaatgggccgctgtggttcttcatcttctttacagcggcctggtacttaaagggcagggtggtccctgcggccacgtactctgtactcggcttgtggtcctttctcctcctggtcctggccctaccacggggggcttatgccctggacgctgctgagcaaggggaactagggctggttttgttagtaatcatatccatctttactcttaccccagcatacaaggttctcctcagccgttcagtgtggtggctgtcctacatgctggtcttggccgaggcccagattcagcaatgggtccccccccttgaggtccgaggggggcgtgacgggatcatctgggcggctgttattctacacccacgccttgtgtttgagatcacgaaatggttgttagcaatcctggggtctgcccacctccttaaagcgtctctgctacgggtaccatactttgtgagggctcacgctctgttacgagtgtgcaccctggtgagacacctcgcaggagctaggtacatccagatgctgttgatcactatgggcaggtggaccggcacttacatctatgaccacctctcccctttatcaacttgggcagcccaggggttgcgggacctggcagtcgccgtggagcctgtgatcttcagcccaatggagaagaaggtcattgtgtggggggctgagacagtggcgtgtggagacatcctgcatggcctcccggtttccgcgaggctaggcagggaagttttgctcggccctgccgatagctacacctcgaaggggtggaagctcctagcccccatcactgcttacacccagcagactcgtggtctcctgggcgccatcgtggtcagcctaacgggccgcgacaaaattgagcaggctgggcatgtccaggttctgtcctctgtcacacaatctttcttggggacgtccatctcgggggtcctctggacagtataccatggggctggcaataagaccttggccggccccaagggaccagtcactcagatgtacaccagcgcagagggggacctcgtgggatggcctagcccccccgggactaagtcattagacccctgtacctgcggggccgtggacctctacttggtcacccgaaacgctgatgtcattccggtccggaggaaagatgaccggcggggtgcactactctcgccaaggcctctctcaaccctcaaaggatcatccggaggacccgtgctctgccctaggggacacgccgttggcttgtttagagcggccgtgtgtgccaggggtgtggccaagtctattgacttcatccctgttgaatccctcgacatcgccacacggtcgcctagcttctctgacaacagcacgccaccagctgtgccccagtcataccaggtgggctacttgcacgcaccaacgggcagcgggaagagcaccaaggtccctgccgcgtatgccagtcaggggtacaaagtactcgtactaaacccctctgtcgcggctacgcttggtttcggggcctacatgtccaaagcccacgggatcaaccccaacatcagaaccggagttcggactgtgaccaccggggaccctatcacctactccacttatggcaagtttatcgcggatggaggctgctcagctggcgcctatgacatcatcatatgcgacgaatgccattcagtggacgccactaccatccttggcattggaacagtcctcgaccaggctgagaccgcaggtgtcaggctagtggttttagccacagccacgcctcccggtacggtgacgactccccacagtaacatagaggaggtggccctcggtcatgagggcgagatccctttctatggcaaggctatccccctagcttacatcaaggggggcaggcacctgatcttctgtcattcaagaaagaagtgcgacgagctcgcagcagcccttcggggcttaggtgtcaatgccgttgcctactataggggtctcgacgtttccgttataccaactcaaggagacgtggtagtcgtcgccaccgacgccctaatgactggatataccggtgactttgactctgttatcgactgcaacgttgcagtcactcagattgttgactttagcctagacccaacctttaccatcaccactcaaaccgtccctcaggacgctgtctcccgtagtcaacgtagagggagaactgggagggggcgactgggtatttacaggtatgtctcatcaggcgagaggccgtctgggatgttcgacagcgtggtactctgcgagtgctatgatgccggagcagcctggtacgagcttacgcctgctgagactacggtgagactccgggcatatttcaacacgcccggtttacccgtgtgtcaagaccacctggagttctgggaagcggtcttcacaggtctcacacacattgatgcccacttcctctcccagacgaagcaaggaggagaaaactttgcgtatctaacggcctatcaggccacagtgtgcgctagggcaaaggcccctcctccttcgtgggacgtgatgtggaagtgtttaactaggctaaaacctacactgactggtcctacccccctcctgtaccgcttgggtgccgtgaccaacgaggttactctgacgcaccccgtgacgaaatacatcgccacgtgcatgcaagctgacctcgagattatgacaagcacttgggtcctggcagggggggtgctggccgccgtggcagcttactgcttggcgaccggctgcatttccatcattggccgcatacacctgaatgatcgggtagttgtggcccctgacaaggaaattctatatgaggcctttgatgagatggaagagtgcgcctccaaagctgccctcattgaggaggggcagcggatggcggagatgctcaagtctaagatacaaggcctcctacaacaggccacaagacaggcccaagacatacagccagccatacagtcatcatggcccaagcttgaacaattttgggccaaacacatgtggaactttatcagtggcatacagtacctggcgggactctccaccctaccgggaaatcccgcagtggcatcaatgatggctttcagcgccgcattgactagcccactatccaccagcaccactatcctcttgaacatcatggggggatggttggcctcccagattgccccccctgccggggccactggcttcgttgtcagtggtctagtgggggcggccgtcgggagtataggcctaggtaagatactggtggacgttttggccgggtacggtgcaggcatttcaggggccctcgtatcttttaaaatcatgagcggcgaaaagccctcgatagaagatgttgtaaatctcctgcctgctattctgtctcctggtgctttggtagtgggagtcatctgtgcggcaatcttgcgccgccacgtcggccagggggagggggcggtccagtggatgaacagactgatcgcctttgcctccagaggaaaccatgttgcccccacccactacgtagcggagtctgacgcctcgctgcgtgtaacgcaggtgctaagttcactcacaattaccagcttacttaggaggctacatgcatggatcactgaagattgcccagtcccatgttcggggtcttggctccgggacatttgggattgggtttgttccattctcacagactttaagaactggctgtcttcaaaattgctccccaaactgcctggccttcccttcatctcttgccaaaagggatacaggggcgtgtgggctggcacgggagtcatgactactcggtgtccgtgcggagcaagcatctcgggccatgtccgcatgggtaccatgaaaataacaggcccaaagacctgcttgaacctgtggcagggaaccttccccattaattgttacacagaagggccttgcgtgccaaaaccccctcctaattataagaccgcaatttggagggtgtcagcgtcggagtacgttgaggtcacgcagcatggctctttctcgtacgtaacggggttaactagtgacaaccttaaggtcccttgccaggtaccagctccagaattcttctcttgggtggacggggtgcaaatacaccgattcgcccccactccaggtcccttcttccgggatgaggttacgttcaccgtaggcctcaattcctttgtggtcggctctcagctcccttgcgaccctgagccggacaccgaggtattggcctccatgttgacagacccgtcccacattaccgcggagacggcagccaggcggttggccaggggatcccccccttcacaggccagctcttcagcgagccagctctccgccccatccttgaaggctacctgtaccacccataagatggcatatgattgtgacatggtggatgccaacctcttcatgggaggcgatgtgacccggattgagtccgactccaaggtgatcgttctcgactccctcgatcccatgattgaggtggaggatgaccgcgagccttctgtaccatcagagtacttgatcaggaggaggaagttcccaccggcattacctccctgggcccgtccagactacaaccctcctgtgatcgagacatggaaaaggccggactacgaaccacccactgtcctaggctgtgcccttccccccacacctcaagcgccagtgcccccacctcggaggcgccgcgccaaaatcctgactcaggacaatgtggagggggttctcagggagatggcggacaaggcgttcggccctctccaagaccacaatgactccggtcactccactggagcggataccggaggagacagcgtccagcagccctctgacgaggctgccgcttcagaagcgggatcactgtcctccatgcctccccttgagggagagccgggggatcctgacctggagtttgaaccggcgggatccgcttccccttctgagggggagtgtgaggtcatcgattcagactccaagtcgtggtcaacagtctctgaccaagaggactctgttgtctgctgctccatgtcatactcctggacaggggccctcataacaccatgtgggcccgaggaggagaagttgccgatcaaccctctgagtaactcgctcatgcggttccataacaaggtgtactccacaacctcgaggagtgcctctctgagggcaaagaaggtgacctttgacagggtgcaggtgctggacgcacactatgacttagtcttgcaggacgttaagcgagccgcctctaaggttagtgcgaggctcctctcagtagaggaagcctgcgcgctgaccccgccccactccgccagatcacgatacggatttggggcaaaggaggtgcgtagcttatccaggagggccgtcaaccacatccggtccgtgtgggaggacctcctggaagaccaacatactccaattgatacaactatcatggccaagaatgaggtgttctgtgttgatcccactaaaggtgggaaaaagccagctcgcctcatcgtataccctgaccttggggtcagggtgtgcgaaaagatggccctttatgacattgcacaaaagcttcccaaagcagtaatggggccatcctatgggttccaatactctcctgcagagcgggtcgatttcctcctcaaagcttggggaagtacgaaggacccaatggggttttcatatgacacccgctgctttgactcaacagtcacggagagggccataagaacagaagaatccatataccaggcctgttctctgcctcaagaggctaaaactgtcatacactcgctcactgagagactctacgtaggagggcccatgacgaacagcaagggacagtcctgcggttacaggcgttgccgcgcaagcggtgtcttcactaccagcatggggaacaccatgacatgctacatcaaggcccttgcagcatgcaaagctgcagggatcgtggaccccactatgctggtgtgtggagacgacctggtcgtcatctcagagagccaaggtaacgaggaggacgagcgaaacctgagagctttcacagaagctatgaccaggtattccgcccctcccggtgaccttcccagaccggaatatgacttggagcttataacatcctgctcctcaaacgtatcggtagcgctggactctcggggtcgccgccggtacttcctaaccagagaccctaccactccaatcacccgagctgcttgggaaacagtaagacactcccctgtcaattcttggctgggcaacatcgtccaatacgcccctacaatctgggtccggatggtcataatgacccacttcttctccatactattggcccaggacactctgaaccaaaatctcaattttgagatgtacggggcagtatattcggtcaatccattagacctaccggccataattgaaaggctacatgggcttgaggccttttcactgcacacatactctccccacgaactctcgcgggtggcagcgactctcagaaaacttggagcgcctccccttagagcgtggaagagtcgggcgcgtgctgtgagggcttcactcatcgcccagggagggagggcggccatttgtggccgctacctcttcaactgggcggtgaagacaaagctcaaactcactccattgcccgaggcgagccgcctggatttatccgggtggttcactgtgggcgccggcgggggcgacatctttcacagcgtgtcgcatgcccgaccccgcctattactcctctgcctactcctacttagcgtaggggtaggcatctttttactccccgctcggtag

SEQ ID NO: 742 - DNA, 9406 bp, Hepatitis C Virus
cactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggacaaacccactctatgtccggtcatttgggcgtgcccccgcaagactgctagccgagtagcgttgggttgcgaaaggccttgtggtactgcctgatagggtgcttgcgagtgccccgggaggtctcgtagaccgtgcatcatgagcacaatccctaaacctcaaagaaaaaccaaaagaaacacaaaccgtcgcccacaggacgtcaagttcccgggtggcggtcagatcgttggcggagtttacttgctgccgcgcaggggccccaggttgggtgtgcgcgcgacaaggaagacttccgagcgatcccagccgcgtggaagacgccagcccatcccgaaagatcggcgctccaccggcaagtcctggggaaagccaggatatccttggcctctgtacggaaacgagggctgcggctgggcaggttggctcctgtccccccgcgggtctcgtcctacttggggccccaacgacccccggcacagatcacgcaacttgggtaaagtcatcgataccattacgtgtggttttgccgacctcatggggtacatccctgtcattggcgccccggtcgggggcgtcgccagagctctggcacacggtgttagggttctggaagacgggatgaattacgcaacagggaatctacccggttgctccttttctatcttcttacttgcccttctgtcatgcgtcacagtgccagtgtctgcagtggaagtcaggaacatcagttctagctactacgccactaatgattgctcgaacaacagcatcacctggcagctcactaacgcagttctccaccttcctggatgcgtcccatgtgagaatgataatggcaccttgctctgttggatacaagtaacaccaaacgtggctgtgaaacaccgcggcgcactcactcacaacctgcgaacgcacgtcgacatgatcgtaatggcagctacggtctgttcggccttgtacgtgggagacgtgtgcggggccgcgatgattgtgtcgcaggctctcatagtatcgccagagcgccacaacttcacccaagagtgcaactgttccgtctaccaaggccatatcaccggccatcgcatggcatgggacatgatgttaaactggtcaccgactctcaccatgatcctcgcctacgctgctcgtgttcctgagctagtccttgaaattgtcttcggcggccactggggtgtggtgtttggcttggcctacttctccatgcagggagcgtgggccaaagtcattgccatcctccttcttgttgcgggagtggatgcacaaacctataccagcggtgggcaagcaggtcacaccgcttttggcattgttcacctctttgcccgtggtccccaacagaagctccatttagtcaatagcaatggcagctggcacataaaccggactgccctcaactgcaatgatagcttaaacacgggtttcatcgcttccctgttctacgccaacagtttcaacagttctggctgtcccgagcgcttgtcttcctgccgcaggctggacgattttcgcatcgggtggggaactttggaatacgagaccaatgtcaccaatgatgagggcatgaggccgtactgctggcattaccctccgaggccttgcggtatcgtctcggctaggacggtttgcgggccggtctactgttttactcctagccctgttgtcgtgggcaccactgacaggcagggcgtacccacctatacctggggggaaaatgagaccgatgtcttcctgctaaatagtacaagacctccgcgaggagcttggttcggctgcacttggatgaacgggactgggtacaccaagacatgcggagcaccaccttgccgcattaggagagactacaacagcactcttgatctattgtgccccacagactgttttaggaagcacccaagtgctacctatcttaagtgcggagcagggccttggttgacccccaggtgcctgatagactacccttataggctatggcattatccgtgcactgtaaattttaccatcttcaaggtgcggatgtatgtagggggggtggagcatcggttgtccgcagcatgtaacttcacgcgcggagaccgctgcagactagaagacagggataggggtcagcagagtccactgctgcattccaccactgagtgggcagtgttgccatgctccttctccgacctaccggcactatccactggcctattgcacctccaccaaaacatcgtggacgtgcagtatctctatgggctttctccggctcttacgaggtacatcgtgaagtgggaatgggtggtcctccttttcctgttgttggcagacgccagggtctgtgcatgcctttggatgctcatcatactgggccaagctgaggcggcgcttgagaagcttattatcctgcactccgctagcgccgctagtgccaatgggccactgtggttcttcatcttctttacagcggcctggtacttgaagggcagggtggtccctgcggccacgtactctgtacttggcttgtggtcttttctcctcctggtcctggccctaccacggggggcctatgccctggacgccgctgagcaaggggaactagggctggttttgttagtaatcatatccatctttactcttaccccagcatacaaggttctcctcagccgttcagtgtggtggctgtcctacatgctggtcttggccgaggcccagattcagcaatgggtcccccccctcgaggtccgaggggggcgtgacgggatcatctgggcggctgttattctacacccacgccttgtgtttgagatcacgaaatggttgttagcaatcctggggtctgcccacctccttaaagcgtctctgctacgggtaccatactttgtgagggctcacgctctgttacgagtgtgcaccctggtgagacacctcgcaggagctaggtacatccagatgctgttgatcactatgggcaggtggaccggcacttacatctatgaccacctctcccctttatcaacttgggcagcccaggggttgcgggacctggcagtcgccgtggagcctgtgatcttcagcccaatggagaagaaggtcattgtgtggggggctgagacagtggcgtgtggagacatcctgcatggcctcccggtttccgcgaggctaggcagggaagttttgctcggccctgccgatagctacacctcgaaggggtggaagctcctagcccccatcactgcttacacccagcagactcgtggtctcctgggcgccatcgtggtcagcctaacgggccgcgacaaaattgagcaggctgggcatgtccaggttctatcctctgtcacacaatctttcttggggacatccatctcgggggtcctctggacagtataccatggggctggcaataagaccctggccggccccaagggaccagtcactcagatgtacaccagcgcagagggggacctcgtgggatggcctagcccccccgggactaagtcattagacccctgcacctgcggggccgtggacctctacttggtcacccgaaacgctgatgtcattccggtccggaggaaagatgaccggcggggtgcactactctcgccaaggcctctctcaaccctcaaaggatcatccggaggacccgtgctctgccctaggggacacgccgttggcttgtttagagcggccgtgtgtgccaggggtgtggccaagtctattgacttcatccctgttgaatccctcgacatcgccacacggtcgcctagcttttctgacaacagcacgccaccagctgtgccccagtcttaccaggtgggctacttgcacgcaccaacgggcagcgggaagagcaccaaggtccctgccgcgtatgccagtcaggggtacaaagtactcgtactaaacccctctgtcgcggctacgcttggtttcggggcctacatgtccaaagcccacgggatcaaccccaacatcagaaccggagttcgaactgtgaccaccggggaccctatcacctactccacttatggcaagtttatcgcggatggaggctgctcagctggcgcctatgacatcatcatatgcgacgaatgccattcagtggacgccactaccatccttggcattggaacagtcctcgaccaggctgagaccgcaggtgtcaggctagtggttttagccacagccacgcctcccggtacggtgacgactccccacagtaacatagaggaggtggccctcggtcatgagggcgagatccctttctatggcaaggctatccccctagcttacatcaaggggggcaggcacctgatcttctgtcattcaagaaagaagtgcgacgagctcgcagcagcccttcggggcttgggtgtcaatgccgttgcctactataggggtctcgacgtttccgttataccaactcaaggagacgtggtagtcgtcgccaccgacgccctaatgactggatataccggtgactttgactctgttatcgactgcaacgttgcagtcactcagattgttgactttagcctagacccaacctttaccatcaccactcaaaccgtccctcaagacgctgtctcccgtagtcaacgtagagggagaactgggaggggacgactgggtatttacaggtatgtctcatcaggcgagaggccgtctgggatgttcgacagcgtggtactctgcgagtgctatgatgccggagcagcctggtacgagcttacgcctgctgagactacggtgagactccgggcatatttcaacacgcccggtttacccgtgtgtcaagaccacctggagttctgggaagcggtcttcacaggtctcacacacattgatgcccacttcctctcccagacgaagcaaggaggagaaaactttgcgtatctaacggcctaccaggccacagtgtgcgctagggcaaaggcccctcctccttcgtgggacgtgatgtggaagtgtctgactaggctaaaacctacactgactggtcctacccccctcctgtaccgcttgggtgccgtgaccaacgaggttactctgacgcaccccgtgacgaaatacatcgccacgtgcatgcaagctgacctcgagattatgacaagcacttgggtcctggcagggggggtgctggccgccgtggcagcttactgcttggcgaccggctgcatttccatcattggccgcatacacctgaatgatcgggtagttgtggcccctgacaaggaaattctatatgaggcctttgatgagatggaagagtgcgcctccaaagctgccctcattgaggaggggcagcggatggcggagatgctcaagtctaagatacaaggcctcctacaacaggccacaagacaggcccaagacatacagccagccatacagtcatcatggcccaagcttgaacaattttgggccaaacacatgtggaactttatcagtggcatacagtacctggcgggactctccaccctaccgggaaatcccgcagtggcatcaatgatggctttcagcgccgcattgactagcccactatccaccagcaccactatcctcttgaacatcatggggggatggttggcctcccagattgccccccctgccggggccactggcttcgttgtcagtggtctagtgggggcggccgtcgggagtataggcctaggtaagatactggtggacgttttggccgggtacggtgcaggcatttcgggggccctcgtagcttttaaaatcatgagcggcgaaaaaccctcggtagaagatgttgtaaatctcctgcctgctattctgtctcctggtgctttggtagtgggagtcatctgtgcggctatcttgcgccgccacgtcggccagggggagggggcggtccagtggatgaacagactgatcgccttcgcctccagaggaaaccatgttgcccccacccactacgtagcggagtctgacgcctcgctgcgtgtaacgcaggtgctaagttcactcacaattaccagcttacttaggaggctacatgcatggatcactgaagattgcccagtcccatgttcggggtcttggctccgggacatttgggattgggtttgttccatcctcacagactttaagaactggctgtcttcaaaattgctccccaaactgcctggccttcccttcatctcttgccaaaagggatacaggggcgtgtgggctggcacgggagtcatgactactcggtgtccgtgcggagctagcatctcgggccatgtccgcatgggtaccatgaaaataacaggcccaaagacctgcttgaacctgtggcagggaaccttccccattaattgttacacagaagggccttgcgtgccaaaaccccctcctaattataagaccgcaatttggagggtgtcagcgtcggagtacgttgaggtcacgcagcatggctctttctcgtacgtaacggggttaactagtgacaaccttaaggtcccttgccaggtaccagctccagaattcttctcttgggtggacggggtgcaaatacaccgattcgcccccactccaggtcccttcttccgggatgaggttacgttcactgtaggcctcaattcctttgtggtcggctctcagctcccctgcgaccctgagccggacaccgaggtattggcctccatgttgacagacccgtcccacattaccgcggagacggcagccaggcggttggccaggggatcccccccttcacaggccagctcttcagcgagccagctctccgccccatccttgaaggctacctgtaccacccataagatggcatatgattgtgacatggtggatgccaacctcttcatgggaggcgatgtgacccggattgagtccgactccaaggtgatcgttctcgactccctcgatcccatgactgaggtggaggatgaccgtgagccttctgtaccatcagagtacttgatcaggaggaggaagttcccaccggcactacctccctgggcccgtccagactacaaccctcctgtgatcgagacatggaaaaggccggactacgaaccacccactgtcctaggctgtgcccttccccccacacctcaagcgccagtgcccccacctcggaggcgccgcgccaaaatcctgactcaggacaatgtggagggggttttaagggagatggcggacaaggcgttcggccctctccaagaccacaacgactccggtcactccactggagcggataccggaggagacagcgtccagcagccctctgacgaggctgccgcttcagaagcgggatcactgtcctccatgcctccccttgagggagagccgggggatcctgacctggagtttgaaccggcgggatccgcttccccttctgagggggagtgtgaggtcatcgattcagactccaagtcgtggtcaacagtctctgaccaagaggactctgttgtctgctgctccatgtcatactcctggacaggggccctcataacaccatgtgggcccgaggaggagaagttgccgatcaaccctctgagtaactcgctcatgcggttccataacaaggtgtactccacaacctcgaggagtgcctctctgagggcaaagaaggtgacctttgacagggtgcaggtgctggacgcacactatgacttagtcttgcaggacgttaagcgagccgcctctaaggttagtgcgaggctcctctcagtagaggaagcctgcgcgctgaccccgccccactccgccagatcacggtacggatttggggcaaaggaggtgcgtagcttatccaggagggccgtcaaccacatccggtccgtgtgggaggacctcctggaagaccaacatactccaattgatacaactatcatggccaagaatgaggtgttctgtgttgatcccactaaaggtgggaaaaagccagctcgcctcatcgtataccctgaccttggggtcagggtgtgcgaaaagatggccctttatgacattgcacaaaagcttcccaaagcagtaatggggccatcctatgggttccaatactctcctgcagagcgggtcgatttcctcctcaaagcttggggaagtaagaaggacccaatggggttctcatatgacacccgctgctttgactcaacagtcacggagagggacataagaacagaagaatccatataccaggcctgttctctgcctcaagaggctaaaactgtcatacactcgctcactgagagactctacgtaggagggcccatgacgaacagcaagggacagtcctgcggttacaggcgttgccgcgcaagcggtgtcttcactactagcatggggaacaccatgacatgctacatcaaggcccttgcagcatgcaaagctgcagggatcgtggaccccactatgctggtgtgtggagacgacctggtcgtcatctcagagagccaaggtaacgaggaggacgagcgaaacctgagagctttcacagaagctatgaccaggtattccgcccctcccggtgaccttcccagaccggaatatgacttggagcttataacatcctgctcctcaaacgtatcggtagcgctggactctcggggtcgccgccggtacttcctaaccagagaccctaccactccaatcacccgagctgcttgggaaacagtaagacactcccctgtcaattcttggctgggcaacatcgtccaatacgcccctacaatctgggtccggatggtcataatgacccacttcttctccatactattggcccaggacactctgaaccaaaatctcaattttgagatgtacggggcagtatattcggtcaatccattagacctaccggccataattgaaaggctacatgggcttgaggccttttcactgcacacatactctccccacgaactctcgcgggtggcagcgactctcagaaaacttggagcgcctccccttagagcgtggaagagtcgggcgcgtgctgtgagagcctcactcatcgcccagggagggagggcggccatttgtggccgctacctcttcaactgggcggtgaagacaaagcttaaactcactccattgcccgaagcgagccgcctggatttatccgggtggttcactgtgggcgccggcgggggcgacatctttcacagcgtgtcgcatgcccgaccccgcctattactcctctgcctactcctacttagcgtaggggtaggcatctttttactccccgctcggtag

SEQ ID NO: 743 - DNA, 9577 bp, Hepatitis C Virus
gccagcccccgattgggggcgacactccaccatgaaccactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggatcaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcacaacctcgtggaaggcgacaacctatccccaaggctcgccgtcccgagggaaggacctgggcgcagcccgggtacccttggcccctctatggcaatgagggcttggggtgggcaggatggctcctgtcaccccgaggctcccggcctagttggggcccctcggacccccggcgtaggtcgcgtaatttgggtaaggtcatcgataccctcacatgcggcttcgccgacctcatggggtacattccgctcgtcggcgcccccctagggggcgctgccagggccctggcacatggtgtccgggttctggaggacggcgtgaactatgcaacagggaatttgcccggttgctctttttctatcttcctcttggctctgctatcctgcttgaccattccagcttccgcttatgaagtgcgcaacgtatctgggatataccatgtcacgaacgactgttccaactcaagcattgtgtatgaggcagcggacatgatcatgcatagccccgggtgcgtgccctgcgttcgggagaacaactcttcccgttgctgggtagcgctcactcccacgctcgcggccaggaacgctagcgtccccaccaagacaatacgacgtcatgtcgacttgcttgttggggcggctgctttctgctccgctatgtacgtgggggatctctgcggatctgttttcctcgtctctcaactgttcactttctcgcctcgccggcacgagacagtgcaggactgcaattgctcactctatcccggtcatgtatcaggtcaccgcatggcttgggatatgatgatgaactggtcacctacagcagccctagtggtgtcgcagttactccggatcccacaagccgtcgtggatatggtggcgggggcccactggggagtcttggcgggccttgcctactattccatggtggggaactgggctaaggttctgattgtgatgctgctctttgcaggcgttgacgggcagacacgtgcggtgggggggatgcaaagccatttcacccagcgcttcgtgtccctcttttcacttgggccagctcagaaaatccagcttgtaaacaccaatggtagctggcacgtcaataggactgccctgaactgcaacgactccctccaaactggattcattgctgcgctgttctacgcaaacaggttcaactcatctggatgcccagagcgcttggccagctgccgtcccattgataagttcgctcagggatggggtcccatcacttatgctaagcctgacagcccggaccagaggccttattgctggcactacgcaccccagccctgcggtatcgtgcccgcgtcggaggtgtgtggtccagtgtattgcttcaccccaagccctgttgtggtggggacaccgatccgcttcggtgtccctacgtatacgtggggggcgaatgagacagacgtactgcttctcaacaacacgcggccgccgctaggaaactggttcggctgtacatggatgaatgccaccgggtttaccaagacatgcgggggccccccctgtaacatcgggggggtcggcaacaacgccttgacctgccccacggactgcttccggaagcaccccgaggccacttacgcaaaatgtggctcagggccgtggctgacacctagatgcatggttgattacccatacaggctctggcactacccctgtactgtcaacttcaccatcttcaaggttaggatgtatgtagggggcgtggagcacaggctcaatgctgcatgcaattggactcgaggagagcgctgtaatttggaggacagggatagatcagagctcagccctctgctgctgtctacaacagagtggcaggtactgccttgctccttcaccaccttaccggctttgtccactggtttgatccatctccatcagaacattgtggacgtacaatacctgtacggcgtggggtcagcggtcgtctccattgtagtaaaatgggagtatgtcctgctgcttttccttctcctagcggacgcgcgcgtctgcgcctgcttgtggatgatgctgctgatagctcaggcaaaggccgccttagagaacctggcggtcctcaacgcggcgtctgtggccggtgagcatggcgtgctctccttccttatgttcttctgtgccgcctggtacatcaaaggcaggctggtccctggggcggcatatgcactttacggcgtatggccgctgctcctgctcctgttggcgttaccaccacgggcttacgccatggaccgggagatggctgcatcgtgcggaggcgcggtttttgtaggtctgatgctcttgaccttgtcaccacactatagagtgttcctcgctaggctcatatggtggttgcaatatttcatcaccagagctgaggcgcacttgcatgtgtggatcccccccctcaacgttcgggggggccgcgatgccatcatcctcctcacgtgcgcggttcacccagagctgatatttgacatcaccaaactcctgctcgccatactcggtccgctcacggtgcttccaggtggcatagttagaatgccgtactttgtacgcgctcaggggctcatccgtgcatgcatgttggtgcggaaagtcgccgggggccattatgtccaaatggccctcatgaagctggccgcactgacaggtacgtacgtttatgaccatctcaccccactgcgggattgggcccacgcgggcttacgagatctcgcggtggcagtagagcctgtcatcttctccgacatggagattaagatcattacctggggggcagacactgcggcgtgtggggacatcatcttgggcctgcccgtctccgcccgaagggggaaggagatacttctgggaccggccgatagctttgaggggcaggggtggcggctcctcgcccccatcacagcctattcccaacagacgcggggcctacttggctgcatcatcactagcctcaccggccgggacaagaaccaggtcgagggggaggttcaagtggtttctactgcaacacaatctttcctggcaacctgcgtcaacggcgtatgttggactgtctatcatggcgccggctcaaagaccctagccggccccaaaggccctatcacccaaatgtacaccaatgtagaccaggacctcgtcggctggcgggcgccccccggggcgcgctccctgacaccatgcacctgcggtagctcggacctctacttggtcacgagacacgctgacgtcattccggtgcgccggcgaggcgatagtagggggagcctactctcccccaggcctgtctcctacctgaagggctcttcgggtggtccattgctctgcccttccgggcacgctgtgggcatcttccgggctgctgtgtgcacccggggggtcgcgaaggcggtggacttcgtacccgttgagtccatggagactactatgcggtctccggttttcacagacaactcgtcccccccggctgtaccgcagactttccaagtggcccacttacacgctcctactggcagcggcaagagcaccaaggtgccggccgcatatgcggcccaagggtacaaggtgctcgtcttgaacccatccgttgccgccaccttaggttttggagcgtatatgtccaaggcacatggtaccgaacctaacatcagaactggggtgaggaccatcaccacgggcgcccccatcacgtactccacctacggcaagttccttgccgacggtggttgctccgggggcgcctatgatatcataatatgtgatgagtgccactcaactgactcgactaccattttgggcatcggcacggtcttggaccaagcgaagacggttggagcgcggcttgtcgtgctcgctaccgccactcctccggggtcagtcaccgtgccacaccccaacatcgaggaggtggccttgtccaatactggggagattcccttctatggcaaagccatccccatcgagaccatcaaggggggaaggcatctcattttctgccattccaagaagaagtgtgacgagctcgccgcaaagctgtcaggcctcggactcaacgctgtggcgtattaccggggtcttgatgtgtccgtcataccgactagtggagacgtcgttgtcgtggcaacagacgctctaatgactggctttaccggcgactttgactcagtgatcgactgtaacacatgtgtcacccaaacagtcgatttcagcttggatcctaccttcaccattgagacgaccaccgtacccccaagacgcggtatcgcgctcgcaggacgaggtaggactggcaggggtagggggggcacctacaggtttgtgactccaggagaacgaccctcgggcatgttcgattcctcggtcctgtgtgagtgctatgacgcgggctgtgcttggtacgagctcacgcccgccgagacctcagttaggctgcgggcttacctaaatacgccagggttgcccgtttgccaggaccatctggagttttgggagagcgtcttcacaggcctcacccacatagatgcccacttcttgtcccagactaaacaggcaggggacaacttcccctacctggtagcataccaagctacagtgtgcgccagggctcaggctccacctccatcgtgggaccagatgtggaagtgtctcatacggctaaagcctacgctgcacgggccaacacccctgctgtataggctaggagccgtccaaaatgaggtcagcctcacacaccccataaccaaatacatcatggcatgcatgtcagctgacttggaggtcgtcaccagcacctgggtgctggtgggcggagtcctcgcagccctggccgcatattgcttgacaacaggcagcgtggtcattgtgggcaggatcaacttgtccgggagaccagccgtcatccccgatagggaggttctctaccaagagttcgatgagatggaggagtgcgcctcacacctcccttatatcgaacagggaatgcagctcgccgagcaattcaaacagaaagcgctcggtttgctgcagacagccaccaagcaagcagaggctgctgcacccgtagtggagtccaagtggcgagcccttgagaccttctgggcgaagcacatgtggaatttcatcagcgggatacagtacttagcaggcttgtccactctgcctggaaaccccgcgatagcatcactgatggcttttacagcctctatcaccagcccgcttaccacccaaagcaccctcctgtttaatatcctgggggggtgggtggctgcccaactcgcgcccccccagaacgccgcctcggcttttgtgggcgccggcatcgccggcgcagctgtcggcagcataggccttgggaaggtgcttgtggacatcttggcgggctatggggcaggagtggctggagcactcgtggccttcaaggtcatgagcggcgagatgccctctaccgaggatctggttaatttactccctgccatcctctctcctggtgccctggtcgtcggggtcgtgtgtgcagcaatactgcgtcgacatgtgggcccgggagagggggccgtgcagtggatgaaccggctgatagcgttcgcttcgcggggtaaccacgtttcccccacgcactatgtgcctgagagcgacgccgcagcgcgtgttacccagatcctctccagccttaccatcactcaactgctgaagaggctccatcagtggatcaatgaggactgctccacgccatgctccggctcgtggctaagagacatttgggactggatatgcacggtgttgactgacttcaagacctggctccagtccaagctcctgccgcggttacccggagtccctttcctctcctgccaacgagggtacaagggagtctggcggggggacggcatcatgcaaaccacctgcccatgtggagcacagatcaccggacatgtcaaaaatggttcgatgaggatcgtcgggcctaaaacctgcagcaacacgtggtgcggaacattccccatcaacgcatacaccacgggcccttggacaccctccccagcgccaaactattctaaggccctgtggcgggtggctgctgaggagtacgtggaggttacgcgggtgggggatttccactacgtgacgggcatgaccactgacaacgtaaagtgcccatgccaggttccggcccccgagttcttcacggaagtggatggggtgcggttgcacaggtacgctccggcatgcagacccctcttacgggacgaggtcgtattccaggtcgggctcaaccaatacctggtcgggtcacagctcccatgcgagcccgagccggatgtagcagtgctcacttccatgcttaccgacccctcccacatcacagcagaaacggctaagcgtaggctggccagggggtcccccccctctttggccagctcttcagctagccagttgtctgcgccttctctgaaggcgacatgcactacccatcatgactccacggacgctgacctcatcgaggccaacctcctgtggcggcaggagatgggcgggaatatcacccgcgtggagtcagagaataaggtagtaattctggactctttcgacccgcttcgagcggaggaggatgatagggaggtatccgttgcagcggagatcctgcggaaaaccaggaaataccccccagcgctgcccgtatgggcgcgcccggactacaaccctccattactagagtcctggaaggacccggactacgtccctccggtggtacacgggtgccccctgccgcctaccaaggcccccccaataccgcctccacggaggaagaggacggttgtcctgacagagtccaccgtgtcttctgccttggcggagctcgctactaaggccttcggcagctccaaatcatcggccaccgacggcggcacggcgaccgcccctcctgaccacgcctccgacgacggcgacaaaggatccgacgttgagtcgtactcctccatgcccccccttgagggagagccgggggaccccgatctcagcgacgggtcctggtctaccgtgagcgaggaggccagtgaggacgtcgtctgctgctcaatgtcctacacatggacaggcgccttgatcacgccgtgcgctgctgaggagagcaagctgcctatcaacccattgagcaactccttactgcgtcaccataatatggtctacgccgcaacatcccgcagcgcaagcctacggcagaagaaggtcacctttgatagactgcaagtcctggacgaccactaccgggacgtgctcaaggagatgaaggcgaaggcgtccacagtcaaggccaaacttctatccgtggaagaagcctgcaagctgacgcccccacattcggccaaatccaaatttggctatggggcaaaggacgtccggaacctatccagcagggccttgaaccacatccgctccgtgtggaaggacctgctggaagacactgagacaccaattgacactaccatcatggcaaagaatgaggttttctgcgtccaaccagagaaaggagggcgcaagccagctcgtctcattgtattcccagacttgggggttcgtgtgtgcgagaagatggccctttacgacgtggtctccactcttcctcaggccgtgatgggttcctcatacggattccagtactctcctggacagcgggtcgagttcctggtgaatgcctggaaatcaaagaagtgtcctatgggctcctcgtatgacacccgctgttttgattcaacagttactgagagtgacatccgtgttgaggagtcaatctaccaatgttgtgacttggcccccgaagccagacaggccataaggtcgctcaccgagcggctttacatcgggggtcccctgactaattcaaaagggcaaaactgcggctatcgccggtgccgcgcgagcggcgtactgacaactagctgcggtaacacccttacatgttacttgaaggcctctgcggcctgtcgagttgcaaagctccaggactgcacaatgctcgtgaacggcgacgaccttgtcattatctgtgagagcgcgggaactcaagaggatgcggcaagcctacgagccttcacggaggctatgactaggtactctgccccccccggggacccgccccaaccagcatatgacttggagctgataacatcatgctcctccaacgtgtcggtcgcgcacgatgcatccggcaagagggtatactacctcacccgtgaccccaccacccccctcgcgcgggctgcgtgggagacagctaggcacactccagtcaactcctggctaggcaacatcattatgtatgctcccaccttatgggcaaggatgattttgatgactcacttcttctccatccttctagctcaggaacaacttgaaaaagccctggattgtcagatctacggggcctgttactccattgagccacttgacctacctcagatcattggacgactccatggtcttagcgcattttcactccatagttactctccaggtgagatcaatagggtggcttcatgcctcaggaagcttggggtaccacccttgcgagtctggagacaccgggccagaagtgtccgcgctaagctactgtcccggggggggagggctgccatttgcggcacgtacctcttcaactgggcagtaaagaccaagcttaaactcactccaattccaggtgcgtcccggttggacttgtccggctggttcgttgctggttacagtgggggagacatatatcacagcctgtctcgcgcccgaccccgctggttcatgttgtgcctactcctactttccgtaggggtaggcatctacctgctccccaaccggtgaacggggagctaaacactccggcccactaggccatttttcctttttttttttttttttttttttcttttttttttcctttttttctttttttttcttttctttggtggctccatcttagccctagtcacggctagctgtgaaaggtccgtgagccgcatgactgcagagagtgctgatactggcctctctgcagatcatgt

SEQ ID NO: 744 - DNA, 9379 bp, Hepatitis C Virus
ccagccccctgatgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcatcatgagcacaaatccaaaaccccaaagaaaaatcaaacgtaacaccaaccgccgcccacaggacgttaagttcccgggcggtggtcagatcgttggtggagtttacctgttgccgcgcaggggccccaggttgggtgtgcgcgcgactaggaagacttccgagcggccgcaacctcgtggaaggcgacaacctatccccaaggctcgccaacccgagggtagggcctgggctcagcccgggtacccttggcccctctatggcaatgagggcttggggtgggcaggatggctcctgtcaccccgcggctcccggcctagttggggccccacggacccccggcgtaggtcgcgtaatttgggtaaggtcatcgataccctcacatgcggcttcgccgacctcatggggtacattccgctcgtcggcgcccccctagggggcgctgccagggctctagcgcatggcgtccgggttctggaggacggcgtgaactatgcaacagggaatctgcctggttgctccttttctatcttccttttggctttgctgtcctgtttgaccatcccagcttccgcctaccaagtgcgcaacgcgtccggggtgtaccatgtcacgaacgactgctccaactcaagtattgtgtatgaggcggcggacgtgattatgcacacccccgggtgcgtgccctgcgtccgggagaacaattcctcccgctgctgggtagcgctcactcccacgcttgcggccaggaacagcagcatccccactacgacaatacggcgtcatgtcgacttgctcgttggggcagctgctctctgttccgctatgtatgtgggggatttttgcggatctgttttcctcgtctcccagctgttcactttctcacctcgccggtatgagacggtgcaagactgcaattgctcaatctatcccggccatgtatcaggccatcgcatggcttgggatatgataatgaattggtcacctacaacagccctagtggtatcgcagctactccggatcccacaagccgtggtggatatggtggcaggggcccactggggagtcctggcgggccttgcctactattccatggtggggaactgggctaaggtcttggttgtgatgctgctcttcgccggtgttgacggggggacccacgtgacaggggggaaggtagcctacaccacccagggctttacatccttcttttcacgagggccgtctcagaaaatccaacttgtaaacactaacggcagctggcacatcaataggactgccctcaattgcaatgactcccttaacaccgggttccttgccgcgctgttctacacccacagcttcaacgcgtccggatgtccggagcgtatggccggttgccgccccattgacgagttcgctcaggggtggggtcccatcactcatgttgtgcctaacatctcggaccagaggccctattgctggcactacgcgcctcgaccgtgtggtatcgtacccgcgtcgcaggtgtgtggtccggtgtattgcttcaccccaagccctgttgtggtggggacgaccgatcgtttcggcgcccccacgtacaactggggaaacaatgagacggatgtgctactcctcaacaacacacggccgccgcagggcaactggttcggttgtacctggatgaatggcactgggttcacaaagacgtgcgggggccccccgtgcaacatcgggggggtcggcaacaataccttgacttgccccacggactgcttccggaagcaccccgaggccacttacacaaaatgtggttcggggccttggttgacacctaggtgcctagttcattacccatacaggctctggcactatccctgcactgtcaactttaccatcttcaaggttaggatgtatgtggggggcgtggaacacaggcttgaagctgcatgcaattggacccgaggagagcgttgtgacttggaggacagggatagatcagagcttagcccgctattgctgtccacaacagagtggcaggtactgccctgttccttcaccaccctgccggctctgtccactggtttgattcatctccatcagaacatcgtggacgtgcaatatctgtacggcatagggtcggcggttgtctccttcgcaatcaaatgggaatatattctgttgcttttcctccccctggcggacgcgcgcgtctgtgcctggttgtggatgatgctgctgatagcccaagctgaggccgccttggagaacctggtggtcctcaatgcagcatccatggcgggagcgcatggcatcctctctttccttgtgttcttctgtgccgcctggtacatcaaaggcaggctggtccctggggcggcatacgctttctatggcgtatggccgctgctcctgctcttgatggcgctaccgccacgggcgtacgccatggaccgggagatggctgcatcgtgcggaggcgcggtttttgtaggtctggtactcttgaccttgtcaccatactacaaagtgttcctcgctaagctcatatggtggttgcaatatctcatcaccagggccgaggcgcacttgcaagtgtggatcccccccctcaacgttcgggggggccgcgatgccatcatccttctcacatgtgcggtccacccggagctgatctttgacatcaccaagctcttgctcgccatactcggtccgctcatggtgctccaggctgccataactagagtgccgtacttcgtacgcgctcaagggctcatccgtgcgtgcatgttagtgtggaaagccgccggaggtcattatgttcaaatggcctttgtgaagctggccgcgctgacaggtacgtacatttatgaccatcttaccccactgcgggactgggcccacgcgggcctacgagaccttgcggtagcagttgagcccgttgtcttctctgatatggagactaagatcatcacctggggggcagacaccgcggcgtgtggggacatcattttgggcctacctgtctccgcccggagggggaaggagatacttctgggaccggccgatagtcttgaagggcaggggtggcgactccttgcgcccatcacggcctactcccaacagacgcggggcctacttggttgcatcatcactagcctcacaggccgggacaagaaccaggtcgagggggaggttcaggtggtttccaccgcaacacaatctttcctggcgacctgtatcaacggcgtgtgttggactgtctatcatggtgccggctcaaagaccctagctggcccaaaaggcccaatcacccaaatgtacaccaatgtagaccaagacctcgttggctggccggcgccccctggggcgcgttccatgacaccatgcacctgcggcagctcggacctttacttggtcacgagacatgctgatgtcattccggtgcgccggcggggcgacagcagggggagcctcctctccccccggcccatctcctacctgaagggttcctcgggtggtccgctgctttgcccctcgggccatgttgtgggcatcttccgggctgctgtgtgcacccggggggttgcgaaggcggtagactttgtgcccgttgagtctatggaaaccactatgcggtctccggtcttcacggataactcaacccccccggccgtaccgcagtcattccaagtggcccacctacacgctcccactggcagcggcaaaagcaccaaggtgccggctgcgtatgcggcccaagggtacaaggtactcgtcctgaacccgtccgttgctgccactttgggctttggggcgtatatgtccaaggcacatggtgttgaccctaacatcagaactggggtgaggaccatcaccacgggcgctcccatcacgtactccacctacggtaagttcctcgccgacggtggctgttctgggggtgcctatgacatcataatatgtgatgagtgtcattcaactgactcgacttccatcttgggcattggtacagtcctggaccaagcggagacggctggagcgcgccttgtcgtgctcgccaccgctacgcctccgggatcggtcaccgtgccgcatcctaatattgaggaggtggccttgtccaacactggagagatccccttctatggcaaggccatccccctcgaggccatcaagggggggaggcatctcattttctgccattccaagaagaaatgtgacgagctcgctgcgaagctgtcggccctcggagtcaacgctgtagcatattaccggggtcttgatgtgtccatcataccgacaagcggggacgtcgttgtcgtggcaacagacgctctaatgacaggctataccggtgactttgactcggtgatcgactgcaacacatgtgtcacccaaacagtcgatttcagcttggaccctactttcaccatcgagacgacgaccgtaccccaagatgcggtgtcgcgctcgcagcggcgaggcaggactggtaggggcagggggggcatatacaggtttgtaactccaggggaacggccctcaggcatgttcgattcttcggtcctgtgtgaatgttatgacgcgggctgtgcttggtacgagctcacgcccgccgagacctcggttaggttgcgggcttacctaaatacacctgggctgcccgtctgccaggaccatctggagttctgggagagcgtcttcaccggcctcacccacatagatgcccacttcttgtcccagaccaaacaggcaggagacaacttcccctacctggtagcataccaggctacagtgtgcgccagggccaaggctccacctccatcgtgggatcagatgtggaagtgtctcatacggctgaagcctacgctacacgggccaacgcccctgttgtataggttaggagccgttcagaacgaggttaccctcacacaccccataaccaagttcatcatggcatgcatgtcggctgacctagaggtcgtcactagcacttgggtgctggtaggcggggtcctcgcggctctggccgcgtactgcctgacaacgggcagcgtggtcattgtgggcaggatcatcttgtccgggaggccggccgttattcccgacagggaagttctctaccaagagttcgatgaaatggaagagtgcgcctcgcacctcccttacatcgaacaaggaatgcagctcgccgagcaattcaagcagaaggcgctcggtttgctgcaaacagccaccaagcaagcggaggctgctgctcccgtggtggagtccaagtggcgagcccttgagaccttctgggcgaagcacatgtggaatttcatcagcgggatacagtacttagcaggcttgtccactctgcctggaaaccccgcaatagcatcactgatggcattcacagcctctatcaccagcccgctcaccacccaatataccctcctgtttaacatcttggggggatgggtggccgcccaactcgccccccccagtgccgcttcagccttcgtgggcgccggtatagctggcgcggctgttggcagcataggcctcgggaaggtgcttgtggacattctggcgggttatggagcaggggtggcaggcgcgctcgtggcctttaaggtcatgagcggtgacatgccctccaccgaggacctggtcaacttactccccgccatcctctctcctggtgccctggtcgtcggggtcgtgtgcgcagcaatactgcgtcggcatgtgggcccaggggagggggctgtgcagtggatgaaccggctgatagcgtttgcttcgcggggcaaccatgtctcccccacgcactatgtgcctgaaagcgacgccgcagcgcgcgtcacccagatcctctccaaccttaccatcactcagctgttgaagaggcttcaccagtggattaatgaggactgctccacgccatgctccggctcgtggctcagggatgtttgggactggatatgcacggtattggctgatttcaagacctggctccagtccaagctcctgccgcggttaccgggggtcccttttttctcatgccagcgtgggtacaagggggtttggcggggagatggcatcatgtataccacctgcccatgtggagcacaaatcaccggacatgtcaaaaacggttctatgaggatcgttgggcctagaacctgtagcaacacgtggcacggaacatttcccatcaacgcgtacaccacaggcccctgcacaccctccccggcgccaaactattccagggcgttgtggcgggtggccgctgaggagtatgtggaggtcacgcgggtgggggatttccactacgtgacgggcatgaccactgacaacgtgaaatgcccatgccaggttccggcccccgaattcttcacagaattggatggggtgcggctgcacaggtacgctccggcgtgcaaacctctcctgcgggatgaggtcacattccaggtcgggctcaaccaatatacggttgggtcacagctcccatgtgagcccgaaccggatgtaacagtggtcacctccatgctcaccgacccctcccacattacagcagaggcggctaggcgtaggctggccagagggtctcccccttccttggccagttcttcagctagtcagttgtctgcgctttctttgaaggcgacatgcactacccatcatggcgccccagacactgacctcatcgaggccaacctcctgtggcggcaggagatgggcggaaacatcacccgcgtggagtcagagaacaagatagtaattctagactcttttgaaccgcttcgagcggaggaggatgagagggaagtgtccgttgcggcggagatcctgcggaagaccaggaaattccccgcagcgatgcccgtatgggcacgcccggactacaacccaccattactagagtcttggaagaacccggactacgtccctccagtggtacacgggtgcccattgccgcctaccaaggcccctccaataccacctccacggagaaagagaacggttgtcctgacagaatccaccgtgtcctctgccttggcggagcttgctacaaagacctttggcagttccggatcgtcggccgtcgacagcggcacggcgaccggccctcctgaccaggcctccgccgaaggagatgcaggatccgacgctgagtcgtactcctccatgcccccccttgagggagagccgggggaccccgatctcagcgacgggtcttggtctaccgtaagcgaggaggccagcgaggacgtcgtctgctgctcgatgtcctacacatggacaggcgccttaattacaccatgcgccgcggaggagagcaagctgcccattaatgcgctgagcaaccctttgctgcgccaccacaacatggtctatgccacaacatcccgcagcgcaagccagcggcagaaaaaggtcacatttgacagactgcaagtcctggatgaccactaccgggacgtgctgaaggggatgaaggcgaaggcgtccacagttaaggctaaacttctatctgtagaggaagcctgcaagctgacgcccccacactcggccagatctaaatttggctacggggcaaaggacgtccggagcctgtccagcaaggccgttaaccacatccgctccgtgtggaaggacttgctggaagacactgagacaccaattgacaccaccatcatggcaaaaaatgaggttttctgtgttcaaccagagaaaggaggccgcaagccagctcgccttatcgtattcccagacttgggggttcgtgtgtgcgagaaaatggccctctacgacgtggtctccactcttcctcaggccgtgatgggctcctcatacggattccagtactcccctggacagcgggtcgagttcctggtgaatgcctggaagtcaaagaagagccctatgggctttgcatatgacacccgctgttttgactcaacggtcaccgagaacgacatccgtactgaggagtcaatttatcaatgttgtgacttggaccccgaggccagacaggccataaggtcgctcacagagcggctttatatcgggggccccctgactaattcaaaggggcagaactgcggttatcgccggtgccgcgccagcggcgtgctgacgactagctgcggtaataccctcacatgttacttgaaggcctctgcagcctgtcgagctgcaaagctccaggactgcacgatgcttgtgtgcggagacgaccttgtcgttatctgtgatagcgcgggaactcaggaggacgcggcgagcctacgagtcttcacggaggctatgactaggtactctgccccccccggggacccgccccaaccagaatacgacttggagctgataacatcatgctcctccaatgtgtcggtcgcgcacgacgcatcaggcaaacgggtgtactatctcacccgtgaccccaccacccccctagcgcgggctgcgtgggagacagctagacacactccagtcaactcctggctaggcaacatcatcatgtacgcgcccaccttatgggcaaggatgattctgatgacccacttcttctccatccttctagcccaggagcaacttgaaaaagccctagattgtcagatctacggggccacttactccattgagccacttgacctgcctcagatcattcaacgactccacggtcttagcgcattttcactccatagttactctccaggtgagatcaatagggtggcttcatgcctcaggaaacttggggtaccgcccttgcgagtctggagacatcgggccagaagcgtccgcgctaagctactgtcccagggggggagggccgccacctgtggcaaatacctcttcaactgggcagtaaagaccaagctcaaactcactccaatcccagaagcgtcccagctggacttgtccggctggttcgttgctggttacagcgggggagacatatatcacagcctgtctcgtgcccgaccccgctggttcatgtggtgcctactcctactttccgtaggggtaggcatctacctgctccccaaccgacttaagatg

SEQ ID NO: 745 - DNA, 9365 bp, Hepatitis C Virus
aactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggtggtggtcagatcgttggtggagtttacctgttgccgcgcaggggccccaggttgggtgtgcgcgcgactaggaagacttccgagcggtcgcaacctcgtggaaggcgacaacctatccccaaggctcgccagcccgagggcagggtctgggctcagcccgggtacccttggcccctctatggcaatgagggcatggggtgggcaggatggctcctgtcaccccgcggctctcggcctagttggggccccacggacccccggcgtaggtcgcgtaatttgggtaaggtcatcgataccctcacatgcggcttcgccgacctcatggggtacattccgctcgtcggcgcccccctagggggcgttgccagggccctggcacatggtgttcgggttctggaggacggcgtgaactatgcaacagggaatttgcccggttgctctttctctatcttcctcttggctttgctgtcctgtttgaccatcccagcttccgcctacgaagtgcgcaacgtatccggggtttaccatgtcacgaacgactgctccaactcaagcattgtgtatgaggcagctgacgtgatcatgcacacccccgggtgcgtgccctgcgttcgggagaataactcctcccgctgctgggcagcgctcacccccacgctcgcggccaggaacgccagcgtccccactatggcaatgcgacgccatgtcgacttgctcgttggggcggctgctttctgctccgctatgtacgtgggggatctttgcggatctgtcctcctcgtctcccagctgttcaccttctcgcctcgcctgcatgagatagtgcaggactgcaattgctctatctatcctggccacgtaacaggtcatcgcatggcttgggatatgatgatgaactggtcgcctacaacagctctagtggtgtcgcagttactccggatcccacaagctgtcatggatatggtggcgggggcccactggggggtcctagcgggcctcgcctactattccatggtggggaactgggctaaggttttgattgtgatgctactttttgccggcgtcgacgggagcacccacgtgacagggggggaggcgggccataccaccagcatcctcacatccatgttttcatctgggtcggctcagaaggtccagctcataaacaccaatggcagctggcacatcaacagaaccgcattgaactgcaatgattccctccagactgggtttattgccgcgctgttctacgtacgcagtttcaactcgtccggatgcccagagcgcatggccagctgccgccccattagcgagttcgctcaggggtggggtcccatcacttacgctgagcctaacgacctggaccagaggccctattgctggcactacgcacctcgacagtgtggtatcgtacccgcgtcgcaggtgtgtggtccggtgtattgcttcaccccgagccctgttgtagtggggacaaccgatcattccggtgtccctacgtatagctggggggagaatgagacggacgtgctgctcctcaacaacacgcggccgccgcagggcaactggttcggctgtacgtggatgaatagcactgggttcaccaagacatgcgggggccccccgtgtaaaatcgggggggtcggcaacaacaccttgatctgccccacggactgtttccggaagcaccccgaggccacctacgcgaaatgcggttcggggccttggttgacacctaggtgcctagttgactacccatacaggctttggcactacccctgcactgtcaactttaccatcttcaaggttaggatgtatgtggggggcgtggagcacaggctcgatgccgcgtgcaattggactcgaggtgagcggtgtgacttggaggacagggatagatcagagctcagcccgctgctgctgtctacaacagagtggcagatactaccctgctccttcaccaccctaccggctctatccactggcttaatccatctccatcagaacatcgtggacgtgcaatacctatacggtgtagggtcggcggttgcctcccttgcaatcaaatgggagtatgtcctgctgcttttcctcctcctggcggacgcgcgcgtctgcgcctgcttgtggatgatgctgttgatagcccaggctgaggccgccttagagaacctggtggtcctcaacgcagcgtccgtggccggagcgcacggcattctctccttccttgtgtttttctgcgccgcctggtacattaagggcaggctggtccctggggcggcatatgctctctatggcgtatggccgctgctcctgctcctgttggcgttaccaccacgagcttacgccatggaccgggagatggctgcatcatgtgggggcgcggtcttcgcaggcctgatgctcttgaccttgtcacctcactataaagtgctcctcgctaggctcatatggtggttgcaatattttatcaccagggccgaggcgcacttgcaagtgtgggccccccctctcaacgttcggggaggccgcgatgccatcatccttctcacgtgcgcggtccacccagagctgatttttgacatcaccaagatcttgcttgccatactcggtccgctcatggtgctccaggccggcataaccagagtgccgtacttcgtacgcgctcaagggctcattcgtgcatgcatgttagtgcggaaagttgccgggggtcattatgtccaaatggccttcatgaagctagccgcgctgacaggtacgtacgtttatgaccaccttactccactgcgggattgggcccatgggggcctgcgagaccttgcggtggcagttgagcctgtcatcttctctgacatggagaccaagatcatcacctggggggcagataccgcggcatgtggggacattatctcgggcctacccgtctccgcccgaagggggagggagatacttctgggaccagccgatagttttgaggggcaagggtggcgactcctcgcgcccatcacggcctacgcccaacaaacgcgaggcctacttggttgcatcatcactagtctcacaggccgggacaagaaccaggtcgagggggaggttcaagtggtctccaccgcaacacagtctttcctagcgacctgtgtcaacggcgtgtgctggactgtctaccatggcgccggatcaaagaccctagccggcccaaagggtccaatcacccaaatgtacaccaatgtagaccaagacctcgttggctggcaggcgcccccgggggcgcgttctttgacaccatgcacctgcggcagctcggacctctacttggtcacgagacatgccgacgtcatcccggtgcgccggcggggcgacagcagggggagcttgctctcccccaggcccgtctcctatctgaagggctcttcgggtggcccgctgctctgcccctcggggcatgccgtgggcatcttccgagccgccgtgtgcacccggggggttgcgaaggcggtggactttgtgcctgttgagtctatggaaaccactatgcggtccccggtcttcacggacaattcatctcccccggccgtaccgcagacattccaagtggcccacctacacgctcccactggcagcgggaagagcaccaaggtgccagctgcgtatgcagcacaagggtacaaggtactcgtcctgaacccttccgttgccgccacattgggttttggggcgtacatgtccaaggcacacggtgtcgaccctaacatcagaactggggtaaggaccattaccacgggtgcccccattacgtattccacctatggcaagttccttgctgacggtggttgctccgggggcgcctatgacatcataatatgtgatgagtgccactcgactgactcgactaccatcttgggtattggcacagtcctggaccaagcagagacggctggagcgcggcttgtcgtgctcgccactgctacgcctccgggatcggtcaccgtgccacaccccaatatcgaggaggtggctctgtctaacgctggagagatctccttctatggcaaagccatccccatcgaggtcatcaagggagggaggcatctcatcttctgccattccaagaagaagtgtgatgagctcgccgcaaaactgtcagccctcgggctcaacgctgtagcgtactaccggggtcttgatgtgtccgtcataccgactagcggagacgtcgtcgtcgtggcaacggacgctctaatgacgggctttaccggcgactttgactcagtgattgactgtaatacgtgtgtcacccagacagtcgatttcagcttggaccccaccttcaccattgagacaacgactgtgccccaagacgcggtgtcacgctcccagcggcgaggtaggactggcaggggcaggggaggtatctataggtttgtgactccaggagaacggccctcgggcatgttcgattcctcggtcctgtgtgagtgctatgatgcgggctgcgcttggtacgagctcacgcccgctgagacctcagttaggttgcgggcttacctaaatacaccagggttgcccgtctgccaggaccatctggagttttgggagagcgtcttcacaggcctcacccatatagatgctcactttttgtcccagactaaacaagcaggagacaacttcccctacctggtagcataccaagctacggtgtgcgccagagctcaggccccacctccatcatgggatcaaatgtggaagtgtctcatacggctaaagcctacgctacacgggccaacacccctgttgtataggctgggagccgtccaaaatgagatcacactcacacaccccgtgactaagtacatcatggcatgcatgtcggctgacctggaggtcgtcacgagcacctgggtgctggtgggcggagtccttgcagctctggccgcgtattgtctgacaacaggcagcgtggtcattgtgggcaggattattttgtccgggaagccggctgtcattcccgatagggaagtcctctaccaggagttcgatgagatggaggagtgcgccacacatctcccttacatcgaacaggggatgcagctcgccgagcaattcaaacaaaaagcgctcgggttgctgcaaacagcctccaagcaagcggaggctgccgctcccgtggtggagtccaagtggcgagcccttgagaccttctgggcgaagcatatgtggaatttcatcagcgggatacaatacctagcgggcttgtccaccctgcccgggaaccccgcaatagcatcattgatggctttcacagcctctgtcaccagcccgctcaccacccaaagtaccctcttgtttaacatcttagggggttgggtggccgctcaactcgctcctcccagtgctgcttcggctttcgtaggcgctggcattgccggtgcagctgttggcagcataggcctcgggaaggtgcttgtggacatcctcgcgggctatggggcaggggtagctggcgcgctcgtggcctttaaggtcatgagcggcgaggtgccctccaccgaggacctggttaacttactccccgccatcctctctcctggtgccctggtcgtcggggtcgtgtgcgcagcaatactgcgtcggcacgtgggcccaggagagggggctgtgcaatggatgaaccggctgatagcgttcgcttcgcggggtaaccatgtttcccccacgcactatgtgcccgaaagcgacgctgcggcgcgtgttacccagatcctctccagccttaccatcactcagttgctgaaaaggctccaccagtggatcaatgaggactgctccacaccatgctccggttcgtggctaagggatgtctgggactggatatgcacggtgttgactgatttcaagacctggctccagtccaagctactgccgcgactgccgggagtccctttcctctcatgccaacgcgggtacaagggagtgtggcggggagatggcatcatgctaaccacctgcccgtgtggagcacagatcaccggacatgtcaaaaatggttccatgaggatcgtcgggcctaagacctgcagcaacacgtggcatggaacattccctatcaacacgtacaccacgggcccctgcacacccaccccggcgccaagctattccagggcgctgtggcgggtggctgctgaggagtacgtggaggtcacgcgggtgggggatttccactacgtgacgggcatgaccactgacaacgtaaaatgcccgtgccaggttccggcccccgaattcttcacggaggtggatggggtacggttacacaggtacgctccggcgtgcaaacccctcctacgggaggaggtcacattccaggtcgggctcaaccaatacctggtcgggtcacagctcccatgcgagcccgagcctgatgtagcagtgctcacttccatgctcactgacccctcccacattactgcagaggcggctaagcgtaggctgggcagggggtctcccccttccttggccagctcttcagccagccagttgtctgcgccttctctgaaggcaacatgcactacccgccacgactccccggacgctgacctcatcgaggccaacctcctgtggcggcaggagatgtgcgggaacatcacccgcgtggagtcagaggctaaggtagtgattctggactctttcgaaccgcttcgagcggaggaggatgagagggaaatatccgttccggcggagatcctgcggaaatccaggaagtttcccccagcgctgcccatatgggcacgcccggattacaaccctccactactagagccatggaaggacccggactacgttcctccggtggtacatgggtgcccactgccacctaccaaggcccctccaataccaccaccgcggaaaaagaggacggttgtcctgacagagtccactgtgtcttctgccttggcggagctcgccactaagaccttcggcagctccgaatcgtcggccgtcgacagcggcacggcgaccgcccctcctgaccaggcctccgacgacggcgacaaagaatccgatgtcgagtcgtactcctccatgccccctcttgagggagagccgggagaccccgatctcagcgatgggtcttggtctaccgtgagcgaagaggccagtgaggacgtcgtctgttgttcgatgtcctacacatggacgggcgccctgatcacgccatgcgcagcggaggaaagcaagttgcccatcaacccattgagcaactctttgctacgtcaccataacatggtctatgccacaacatctcgcagcgcaagtcagcggcagaagaaggtcacttttgacagactgcaagtcctggacgaccactaccgggacgtgctcaaggagatgaaggcgaaggcgtccacagttaaggctagacttctatctatagaagaagcctgtaagctgacgcccccacattcggccagatccaaatttggctatggggcaaaggacgtccggagcctatccagcaaggccgttaaacacatccgctccgtgtgggaggacttgctggaagacactgatacaccaattgatactaccatcatggcaaaaaacgaggttttctgcgtccaaccagagaaaggaggccgtaagccagctcgccttatcgtatacccagacctgggtgttcgtgtatgcgagaaaatggctctctacgacgtggtctccacccttcctcaggccgtgatgggcccctcatacggatttcagtactctcctggacagcgggtcgagttcctggtgaacgcctggaaatcaaagaaaacccctatgggtttcgcatatgacacccgctgttttgactcaacggtcactgagaacgacatccgtgttgaggagtcaatttaccaatgttgtgacttagcccccgaggccagacaggccataaggtcgctcacagagcggctttacatcgggggtcccctgactaattcaaaagggcaaaactgcggctatcgccggtgccgcgcgagcggcgtactgacgactagctgcggtaataccctcacatgctacttgaaggcctctgcagcctgtcgagctgcgaagctccaggactgcacgatgctcgtgtgcggagacgaccttgtcgttatctgtgaaagcgcgggaacccaagaggacgcggcgagcctacgagtcttcacggaggctatgactaggtattctgccccccccggggacccgcctcaaccagaatacgacttggagttgataacatcatgctcctccaatgtgtcggtcgcgcacgatgcgtctggcaaaagggtgtactacctcacccgtgaccccaccacccccctcgcacgggctgcgtgggagacagctagacacactccagttaactcctggctaggcaacatcatcatgtatgcgcccaccttatgggcaaggatgattctgatgactcacttcttttccatccttctagcccaggagcaacttggaaaagccctggattgccagatctacggggcctgttactccattgagccactcgatctacctcagatcattgaacgactccatggtcttagcgcattttcactccatagttactctccaggtgagatcaatagggtggcttcgtgcctcaggaaacttggggtaccacccttgcgagtctggagacatcgggccagaagtgtccgcgctaagttactgtcccaaggagggagggccgccacttgtggcagatacctcttcaactgggcagtaaggaccaagcttaaactcactcctatcccggccgcgtcccagttggacttgtctggctggttcgttgctggttacagcgggggagacatatatcacagcctgtctcgtgcccgaccccgttggtttatgttctgcctactcctactttctgtaggggtaggcatctacctgctccccaaccgatgaacggggagctaaacactccaggccaataggcatcctgtttttt

SEQ ID NO: 746 - DNA, 9357 bp, Hepatitis C Virus
agcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacacaaaccgccgcccacaggacgtcaagttcccgggcggtggccagatcgttggcggagtatacttgttgccgcgcaggggccccaggttgggtgtgcgcgcgacgaggaagacttccgaacggtcccagccacgtggaagacgccagcccatccccaaagatcggcgctccactggcaggtcctggggacgtccaggatacccttggcccctgtacgggaatgagggcctcgggtgggcaggatggctcctgtccccccggggctctcgcccttcgtggggccccacggacccccggcatagatcacgcaatttgggcaaggtcatcgataccctcacgtgtggttttgccgacctcatggggtacatacccgtcgttggcgccccagttggtggcgtcgccagagcactcgcgcatggcgtgagggtcctggaggacgggataaattatgcaacagggaatttacccggttgctctttttctatcttcctactagctctcttgtcttgtatatctgtaccagtatccgctgtggaggtcaagaacaccagtcagacctacatggccaccaatgattgctctaacagcagcatcacgtggcaactcgagggtgcggtactacatgttcctggatgcatcccctgtgagttagtgggcaacgtgtcgcggtgctggataccagtcacgcctaacgtcgccgtgagagagcgcggggcgcttactaagggtctgcggacgcatatcgatttgatcgtggtgtccgctacgctttgctccgccctttacataggggatgtttgtggcgcggccatgatagcggcccaagcagtcatcatttcgccggagcgccacgcttttgttcaggactgcaactgttccatttacccgggccacattacaggacaccgcatggcatgggatatgatgatgaactggtccccgacgaccacgatggtcgtggcgtacctcatgcgcatccctgaaatcgttctggacatcatcaccggagcgcactggggcgtaatgttcggcctagcctacttctctatgcagggggcgtgggccaaggtcgtcgtcatcctcctattgaccgcgggagtagaagccagcacgatcaccatgggtggtcaggcgtctcacactatggctggccttgtcagcattttcagccccggggcccgtcaaaatattcaactcatcaacaccaacggcagctggcacatcaaccgcactgccttgaattgcaatgattcattgcaaacggggttcattgcgtcgttgttctatgtccacagattcaactcctcgggttgtcctgaacgaatgtcctcctgccgccctatcgaggggtttaggatagggtggggcagcctaaagtatgaagagaatgttaccaacgacgaggacatgaggccctattgctggcattatccacccaaaccatgtggcattgttcctgctcggaccgtgtgtggcccagtgtattgcttcacccccagtccagttgtggtaggcaccaccgataaatacggggcgccaacctacacctggggggagaatgaaacggatgtgttcttactaaacagcacgcggcctccgcggggcgcttggtttggatgcacgtggatgaatggcactgggttcactaagacttgcggcgcaccaccttgccgcataagaccagacttcaactccaccgaggacttgctgtgccccactgactgcttcaggaagcaccctgaggctacttacaccaaatgtggggccgggccatggttgactcccaaatgcctggttgattacccctatagattgtggcattacccgtgtactgtcaactttaccatcttcaaaatacggatgttcatagggggagtcgagcataggctcaacgcggcgtgcaattttacccgtggggaccgttgcaatctggaagaccgggataggagtcagctcagccccttgctgcattccaccactgaatgggctatactaccttgcacctactctgacatgccggctttatctaccggtctcttacacctccaccaaaacattgtggacgtgcagtacctgtatggcctatcgccggctattaccaagttcattgtcaagtgggaatgggtggtcctcttgtttctgctccttgcggacgccagagtctgcgcgtgcttgtggatgcttcttctgctggggcaagccgaggcggcgctggagaagctagtcattttgcatgcggccagcgccgcaagctttaatggcataatctgcttcaccatcttcttcatagccgcctggcacatcaagggtcgagtggtccccctggctacttactcgtacctcggcttgtggtccttcagccttctactcctggcacttccccaacaggcctatgcccttaatacaacagaacaggggcaactgggcttggtccttctagtggtcatatcagtccttacactcagcccggcttataagatcctcctctgccgcagcctatggtggctgtcctatctattggtccgagcggaagctttgatccaagagtgggtaccgcccttgcaggcgcgaggcggccgcgatggcatcatatgggccgccgtcatactctgtccgggcatagtgtttgacataaccaagtggctcctggcagtcttaggacctggtcacctccttaggagtgtcctaacaagcgtgccatacttcgtcagggcgcaagctctgttgaggatatgcgctgctgtgagacatctctcaggtggcaagtacgtccagatgatgctgctgacccttggcagatggaccggcacctacatttatgaccatctcactccactgcaggactgggcccacgcgggcctacgagaccttgcggtggcagttgagcctgttgtcttctctgacatggagaccaagatcatcacctggggggcagaaaccgcggcgtgtggggacatcattctgggcttacccgtctccgcccgaagggggagagagatacttctggggccggccgatagccttgagggccaggggtggcggctcctcgcgcctatcacggcttactcccaacagacgcggggcttacttggctgcatcgtcactagcctcacaggccgggacaggaaccaggtcgagggggaggtccaagtggtctccactgcaacacaatctttcctcgcgacctgtgtcaatggtgtgtgttggactgtttaccacggtgccggctcaaagaccttagctggcccaaagggtccaatcatccaaatgtataccaatgtagaccaggacctcgtcggctggccggcgccccccggggcgcgttccttgacaccatgcacctgcggcagctcggacctttacttggtcacgaggcatgccgatgtcattccggtgcgccggcggggcgacagcagggggagcctactctcccccaggcccatctcctacttgaagggttcttcgggtggtccgctgctttgcccctcggggcacgctgtgggcatcttccgggctgctgtgtgcacccggggggttgcaaaggcggtggactttgtacccgttgagtccatggaaactactatgcggtctccggtcttcacggacaactcgtcccccccggccgtaccgcagacattccaagtggcccatctacatgctcccactggcagcggcaagagcaccaaggtgccggctgcgtatgcggcccaggggtacaaggtgctcgttttgaacccatccgttgccgccaccttaggttttggagcatacatgtccaaggcatatggtgtcgaccctaacatcagaactggggtcaggaccattaccacgggcgcccccatcacatattccacctatggcaagttccttgctgacggcggttgctctgggggcgcctatgacatcataatgtgtgatgagtgccactcaacagactcgacttccatcttgggcatcggtacggtcttggaccaggcggagacggctggagcgcggctcgtcgtgctcgccaccgctacacctccgggatcggtcaccgtgccacatcccagtatcgaggaggtggccctgtccaacatcggggagatccctttttatggtaaggccatccccattgaggtcatcaaggggggaaggcatctcattttctgccattccaaaaagaaatgtgatgagctcgctgcaaagctgtcggccctcggactcaatgctgtagcatattaccggggtcttgatgtgtccgttataccgaccagcggagacgtcgttgttgtggcaacagacgctctaatgacgggctataccggcgactttgactcagtgatcgactgtaatacatgtgtcacccagacagtcgatttcagcttggatcccaccttcaccattgagacgacgaccatgccccaggacgcagtgtcgcgctcgcaacggcgaggcaggactggtaggggcaggggaggcatctacaggtttgtgactccaggagaacggccctcgggcatgtttgactcctcggtcctgtgtgagtgctatgacgcgggctgtgcttggtatgagctcacgcccgccgagacctcggttaggttgcgggcttacctaaatacaccagggttacccgtctgccaggaccatctggagttctgggagagcgtcttcacaggcctcacccacatagacgcccacttcttgtctcagaccaagcaggccggagagaacttcccctacctaatagcataccaggccacagtgtgcgccagagcgcaggccccacctccatcgtgggatcaaatgtggaaatgtctcatacggctaaagcctacgctgcacgggccgacgcccctgctgtacaggctgggagccgtccaaaacgaggtcaccctcacacaccccataaccaaatttatcatggcatgcatgtcggctgacctggaagtcgtcactagcacctgggtgctggtaggcggggtcctcgcagctctggccgcgtactgcctgacaacgggcagcgtggtcattgtgggcaggatcgtcttgtccgggaaaccggccatcattcctgacagggaggctctctaccaagagttcgatgaaatggaagagtgcgcctcgcaccttccttatatcgaacagggaatgcagctcgccgagcagttcaagcagaaggcgctcgggttgctgcacacagctaccaaacaagcggaggctgctgctcccgtggtggagtccaaatggcgagcccttgagaccttctgggcgaagcacatgtggaatttcatcagcgggatacagtacttggcagggctgtctactctgcccgggaaccccgcgatagcatcactgatggcattcacagcctctatcaccagcccgctcaccacccaacataccctcytgtttaacatcttgggggggtgggtggccgcccaactcgccccccccagcgctgcttcggctttcctgggcgctggcatcgctggtgcggctgttggcagcataggtcttggaaaggtgcttgtggacatcctggcgggctatggagcaggggtggcaggcgcgctcgtggcctttaaggttatgagcggcgagatgccctccaccgaggacctggtcaacttgctccctgccatcctctctcctggcgccctggtcgtcggggtcgtgtgcgcagcaatactgcgtcggcacgtgggcccgggagagggggccgtgcagtggatgaaccggctgatagcgttcgcttcgcggggcaaccacgtctcccccacgcactatgtgcctgagagcgacgccgcagcgcgtgtcactcagattctctccagccttaccatcactcagctgttgaagaggctccaccagtggattaatgaggactgctctacgccatgctccggctcgtggctcagggatgtttgggactggatatgcacggtgttgactgacttcaagacctggctccagtccaagctcctgccgcagttgccgggggtccctttcttctcatgccaacgtgggtacaagggagtctggcggggagacggcatcatgcaaaccacttgcccatgtggtgcacaaatcaccggacatgtcaagaacggctccatgaggatcgtggggcctaaaacctgcagcaacacgtggcatgggacattccccatcaacgcgtacactacgggcccctgctcaccctctccggcgctcaattattctagagcgctgtggcgggtggctgctgaggagtacgtggaggtcacgcgggtgggggatttccactacgtgacgggcatgaccactgacaacgtaaagtgcccatgccaggttccggcccccgaatttttcacggaagtggatggggtacggttgcacagatacgctccggcgtgcaaacctctcctacgggaagaggtcacattccaggtcgggctcaaccaatatttggtcgggtcgcagctcccatgcgagcccgaaccggatgtggcagtgctcacttccatgcttaccgacccctcccacattacagcagaaacggctaagcgtaggctggccagagggtcccccccctccttggctagctcctcagctagtcagttatctgcaccttctttgaaggcaacatgcactacccatcatgactccccagacgctgacctcatagaggccaacctcctgtggcggcaggagatgggcggaaacatcacccgcgtggagtcagagaataaggtagtagttttggactcttttgacccgatccggccggaagaggacgagagggaagtatccgttccggcggagatcctgcggaaatccaggaaattcccccgagcgatgcccatatgggcacggccggattacaaccctccgctgttagcgtcctggaaggacccggactacgtccatccggtggtgcacgggtgcccactgccacctaccaaggcccctccaataccacctccacggaggaagaggacagttgtcctgacagagtccaccgtctcttctgctctggcggagcttgctacaaagacctttggcagctccggatcgtcggccgtcgacagcggcacggcgtccgcccctcaaaaccagacctccaacgacggcgacacaggatccgacgttgagtcgtactcctccatgcccccccttgagggggagccgggggaccccgatctcagcgacgggtcttggtctaccgtgagtgaggaggctagtgaggacgtcgtctgctgttcgatgtcctacacatggacaggcgctctgatcacgccgtgcgccgcggaggaaagcaagctgcccatcaatgcgttgagcaactctttgctgcgtcaccacaatatggtctatgccacaacatcccgcagcgccagccaacggcagaaaaaggtcacctttgacagactgcaggtcctggacgatcattaccgggacgtgctcaaggagatgaaggcaaaggcgtccacagtcaaggccaaacttctatccgtggaagaagcctgcaagctgacgcccccacattcggccagatctaaatttggctatggggcgaaggacgtccggaacctatccagcaaggccgtcaaccacatccactccgtgtggaaggacttgctggaagacattgaaacaccaattgacaccaccatcatggcaaaaaatgaggttttctgcgtccagccagagaagggaggccgcaagccagctcgccttatcgtatacccagatttgggggttcgtgtgtgcgagaagatggctctttatgacgtggtctccaccctccctcaggccgtgatgggcccctcatacggattccaatactctcctggacagcgggtcgagttcctggtgaatgcctggaaatcaaagaaaagccctatgggcttcgcatatgacacccgctgttttgactcaacggtcactgagaatgatatccgtgttgaggagtcaatttaccaatgttgtgacttggcccctgaggccagacaggccataaagtcgctcacagagcggctttatatcgggggtcccctgactaattcaaaagggcagaactgcggctatcgccggtgccgcgcgagcggcgtgctgacgactagctgcggcaacaccctcacatgttacttgaaggcctctgcagcctgtcgagctgcaaagctccgggactgcacgatgctcgtgtgcggagacgaccttgtcgttatctgtgagagcgcgggaacccaagaggacgcggcgagcctacgagtcttcacggaggctatgactaggtactcagccccccccggggacccgccccaaccagaatacgacttggagttgataacatcatgctcctccaatgtgtcggtcgcgcacgacgcatctggcaaacgggtgtactacctcacccgtgaccccaccaccccccttgcgcgggctgcgtgggagacagctagacacactccagtcaactcctggctaggcaacatcattatgtatgcgcccaccttatgggcaaggatgattctaatgactcatttcttctccatccttctagcccaggagcagcttgaaaaagccctagattgtcagatctacggggcctgttactccattgagccacttgacctacctcagatcattcaacgactccatggtcttagcgcattttcactccacagttactctccaggtgaaatcaatagggtggcttcatgcctcaggaagcttggggtaccgcccttgcgagcctggagacatcgggccaggagtgtccgcgccaagctactgtcccagggggggagggctgccacttgtggcaagtacctcttcaactgggcagtaaagaccaagcttaaactcactccaatcccggctgcgtctcagttggacttgtccggctggttcgttgctggatacagtgggggagacatatatcacagcttgtctcgtgcccgaccccgctggttcatgtggtgcctactcctactttctgtaggggtaggcatctacttgctccccaaccgatgaacggggagctaaacactccaggccaataggccatcctgtttttt

SEQ ID NO: 747 - DNA, 8791 bp, Hepatitis C Virus
aggccttgtggtactgcctgatagggtgcttgcgagtgccccgggaggtctcgtagaccgtgcaccatgagcacgaatcctaaacctcaaagaaaaaccaaacgtaacaccaaccgtcgcccacaggacgttaagttcccgggcggcggccagatcgttggtggagtttacttgttgccgcgcaggggccctagattgggtgtgcgcgcgacgagaaagacttccgagcggtcgcaacctcgaggtagacgtcagcctatccccaaggcgcgtcggcccgagggcaggacctgggctcagcccgggtatccttggcccctctatggcaacgagggctgcgggtgggcgggatggctcctgtccccccgtggctctcggcctagctggggccccacagacccccggcgcaggtcgcgcaatctgggtaaggtcatcgataccctcacgtgtggcttcgccgacctcatggggtacattccgctcgtcggcgcccctcttggaggcgctgccagggccctggcgcatggcgtccgggttctggaagacggcgtgaactacgcaacagggaatcttcctggttgctctttctctatcttccttctggccctgctctcttgcctgaccgtgcccgcgtcagcctaccaagtacgcaactcctcgggcctctaccatgtcaccaatgattgccccaactcgagtattgtgtacgagacggccgatgccattctacactctccggggtgtatcccttgcgttcgcgagggtaacgcctcgaagtgttgggtggcggtggcccccacagtggccactagggacggcagactcccctcaacgcagcttcgacgccacatcgatctgctcgtcgggagcgccaccctttgttcggccctctatgtgggggacttgtgcgggtctgtcttccttgtcggccaactgttcactttctcccccaggcgccactggacaacgcaagactgcaactgttctatctaccccggccacataacgggtcaccgcatggcatgggatatgatgatgaactggtcccctacaacagcgctggtagtggctcagctgctcaggatcccccaagccatcttggacatgatcgctggtgcccactggggagtcctagcgggcatagcgtatttctccatggtggggaactgggcgaaggtcctggtggtgctgttgctgtttgccggcgtcgacgcggaaacttcaaccactgggggggctgctgctaggaccgcgtatagattcacctctttctttgcacccggtcccaagcagaatgttcagctgatctacaccaacggcagctggcacatcaatcgcacggccttgaattgtaatgcaagcctcgacactggctggttagcggcgctcttctactacaacagcttcaattcttcaggttgccccgagaggatggccagctgtagaccccttgccagtttcgaccagggctggggccctatcagctacgccaacggaagcggccccgaacaccgcccctactgctggcactaccccccaaaaccttgtggtatcgtgccggcacagagcgtatgtggcccagtatattgcttcacccccagccctgtggtggtggggacaaccgacaagttcggcgtgcctacctacaactggggtgctaatgacacggacgtcttcgtcctcaacaacaccaggccaccgttgggcaattggttcggctgcacctggatgaattcaacagggtttactaaagtgtgcggagcgcctccttgtgtcatcggcggggtgggcaacaacaccttgcactgtcccactgactgtttccgcaagcacccggaagccacatactcgcggtgcggctccggtccctggattacgcccaggtgcctggtcgactatccttacaggctttggcattatccctgtactatcaactacaccctgttcaaagtcaggatgtacgtgggaggggttgagcacaggttggaagctgcttgcaactggacgcggggagagcgttgtgatctggacgacagggacaggtccgagctcagcccgctgctgctgaccaccacacagtggcaggtccttccgtgctccttcacgaccctgccagccttgactaccggcctcatccacctccaccagaacatcgtggacgtacagtatttgtacggggtagggtcaagcattgtgtcctgggccatcaagtgggagtacgtcatcctcttgtttctcctgcttgcggacgcgcgcatctgctcctgcttgtggatgatgctactcatatcccaagcggaggcagctttggagaacctcatagtactcaatgcggcgtccttggccgggacgcacggccttgcgtccttcctcgtatttttctgctttgcgtggtatctgaagggaaagtgggtgcccgggatggcctacgccttcttcgggatgtggcctctcctcctgctcttgttggcgttgccccaacgggcgtacgcgctggacacggagatggccgcgtcgtgtggcggcgttgttcttgtcgggttaatggcgctgactctgtcgccgcattacaagcgctatatcagctggtgcttatggtggcttcagtatttcctgaccagagcagaagcgctactgcaggtgtgggttcctcccctcaacgtccgagggggccgcgacgctgtcatcctactcatgtgtgttgtacacccggccttagtatttgacatcaccaagctactgctggccgccctcggacccctttggatccttcaaaccagtctgctcaaggtgccctacttcgtgcgcgtccaaggcctcatccggatctgcgcgctagcgcgtaagatggccgggggccattacgtgcagatggccatcatcaaggcgggggcgcttaccggcacctacatttataaccatctcactccccttcgggactgggcgcacaacggcctacgagacctggccgtggctgtggagccagtcgtcttttcccaaatggagaccaagctcatcacgtggggggcggacaccgctgcatgcggtgacatcatcaacggcttgcccgtctccgcccgcaggggccgagagatactgctcgggccggccgatggaatggcctccaaggggtggaggttgctggcgcccatcacggcgtatgcccarcagacaaggggcctcttaggatgcataatcaccagtctgaccggccgggacaaaaaccaggtggagggtgagattcagattgtgtcaactgctgcccagactttcctggcaacatgcatcaacggggtgtgctggactgtctaccacggggccggaacaaggaccatcgcgtcacccaagggtcctgtcatccagatgtatactaatatagaccaagacctcgtaggctggcccgctccccaaggcgcccgctcattgacgccctgcacttgtggctcctcggacctttacctggtcacgaggcatgctgatgtcattcccgtgcgccggcggggtgatagcaggggcagcctgctttcgccccggcctatctcttacctgaaaggctcctcggggggcccactgctgtgccccgcggggcacgccgtaggcatattcagggccgcggtgtgcacccgtggagtggctaaggcggtggactttattcccgtagagaacctagagacaaccatgaggtccccggtgttcacagacaactcctccccaccggcggtgccccagagcttccaggtggcccacctgcatgctcccaccggcagtggtaagagcaccaaggtcccggccgcgtatgcggcccagggctacaaggtgctggtgctcaacccctccgttgccgctacactgggcttcggcgcttatatgtccaaggcccacggggttgatcctaacatcaggactggggtgaggacaattactactggcagccccatcacgtactccacctacggcaagtttcttgccgacggcgggtgctcagggggtgcttatgacataataatttgcgacgagtgccattccacggatgcaacatccatcttgggcatcggcaccgtccttgaccaagcagagactgcaggggctagactggttgtgctcgccaccgctacccctccgggctccatcactgtgccccatcctaacatcgaggaggttgctctgtccaccaccggagagatccctttttatggcaaggctatcccccttgaggcaatcaagggggggagacatctcattttctgtcactcaaagaagaaatgcgacgagctcgccgcaaaactggtcgcgttgggcatcaacgccgtggcttactaccgcggccttgacgtgtccgtcatcccgaccagtggcgacgttgtcgtcgtagcaactgatgctctcatgaccggctttaccggcgactttgactcggtgatagactgcaacacgtgtgtcacccagacagtcgacttcagccttgaccctaccttcaccattgagacaaccacacttccccaggatgctgtctcccgcactcaacgccggggtaggaccggcagggggaagccaggcatctacagatttgtggcgccgggggagcgcccttccggcatgtttgactcgtccgtcctctgcgagtgctatgacgcgggttgtgcttggtatgagctcacacccgccgagaccacagttaggctacgagcatacatgaacaccccggggcttcccgtgtgccaagaccatcttgaattttgggagggcgttttcacgggtcttacccacatagacgcccacttcctatcccagacaaagcagagtggggagaaccttccttacctggtggcgtaccaagccaccgtgtgcgctagagctcaagccccccccccgtcgtgggaccagatgtggaagtgcttgatccgcctcaagcccacactccatgggccaacacctctgctatacaggctgggtgccgttcagaatgaagtcaccctgacgcacccagtcaccaagtacatcatgacatgcatgtcggccgacctggaggtcgtcacgagtacctgggtgctcgtcggtggcgttctggctgctttggccgcgtactgcctatccacaggctgcgtggtcataataggcaggattgtcttgtccgggaagccggcagtcatacccgacagggaggtcctctaccgagagttcgatgaaatggaagagtgctctcagcacttgccgtacatcgagcaggggatgatgctcgccgagcagttcaagcagaaggcccttggcctcctgcagaccgcgtcccgccaggcagaggtcatcgctcctgctgtccagaccaactggcagaaactcgaggccttctgggcgaagcatatgtggaacttcatcagtgggatacaatacctggcgggcctgtcaacgttgcctggcaatcccgctattgcatcattgatggcttttacagccgccgtcaccagcccactaaccactagccaaaccctcctcttcaacattttggggagttgggtggctgcccaacttgcagcccccggtgccgctaccgccttcgtgggcgctggtttagctggcgccgccatcggcagtgttggactggggaaggttctcgtggacatccttgcagggtatggtgcgggcgtggcgggggccctcgtagcattcaagatcatgagcggtgagccccctaccacagaggacctggtcaatctactgcccgccatcctctcgcccggagcccttgtagtcggtgtggtctgcgcagcaatactacgccggcacgttggcccgggcgagggagcggtgcagtggatgaaccggttgatagctttcgcctcccgggggaatcatgtttcccccacgcactacgtgccggagagcgatgcagctgcccgcgtcactgccatacttagcagccttactgtgaccmagctcctaaggcgattacaccagtgggtaagctcggagtgcaccactccatgctccggttcctggctaagggacatctgggactggatatgcgaggtgctgagcgattttaagacctggctgaaggccaagctcatgccacaactgcctgggatccccttcgtgtcctgccaacgcgggtataggggggtctggcgaggcgatggcattatgcatactcgctgccactgtggagctgaaatcaccggacatgtcaagaacgggacgatgaggatcgtcggtcctaagacctgcaggaacatgtggagtgggaccttccccatcaacgcctacaccacgggcccctgtactcccctccctgcgccgaactacacgttcgcgctgtggagggtgtccgcggaggaatacgtggagataaggcgggtgggggacttccactacgtgacgggcatgactgctgacaatctcaaatgcccatgccaggtcccatcgcctgaatttttcacagaactggatggggtgcgcctgcacaggtttgcgcccccgtgcaagcctttgctacgagatgaggtgtcgttcagagtaggactacacgattacccggtggggtcgcaattaccttgcgagcctgaaccggacgtggccgtgttaacgtccatgctcactgatccctcccacataacggcagaggcggctaggagaaggttagcgaggggatcgcccccctctgaggccagctcctcggccagccaactgtccgctccatctctcagggcaacttgcaccaccaaccacgactcccctgacgccgagctcatagaggctaacctcctgtggaggcaggagatgggcggcaacattaccagggttgagtcagagaacaaagtggtgattctggactctttcgatccgcttgtggcggaggaggatgaacgggaggtctccgtggccgcagaaatcctgcggaagtctcggagattcacccctgccctgcccatctgggcacggccggactacaatcccccgctgttggaggagtggaaaaaaccggactacgaaccacctacggtccatggctgcccgcttccacctccacagtcgcctcctgtgcctccgccgcgcaagaagcggacggtggtcctctccgaatcaaccgtatccactgccttggccgagcttgccaccaagagctttggcagctcctcaacttccggcattacgggcgacaatacggcgtcatcctccgagccccccccctctatctgcctccctgactccgacgctgagtcctgttcttccatgcccccccttgagggggagcctggggatccggatctcagcgacgggtcgtggtcgacggttagtagtgaggcgggcacggaggacgtcgtgtgctgctcaatgtcctattcctggacaggcgcacttgtcaccccgtgcgccgcggaagagcaaaaactgcctatcaacgcactgagcaactcgctattgcgtcaccacaatctcgtgtattctaccacctcacgcagtgcttgccaaaggcagaagaaagtcacatttgacagactgcaggtcctggacagccactaccaggacgtgctcaaggaggtaaaggcggcggcgtcgaaagtgaaggctaacttgctatccgtagaggaagcgtgcagcctgacgcccccacattcagccaagtccaaatttggctatggggcgaaagacgtccgttgccatgccagaaaggccgtgaaccacatcaactccgtgtggaaagaccttctggaagccagtgtaacaccaatagatactaccatcatggctaagaacgaagttttctgcgttcagcctgaaaagggaggttgtaagccagctcgtctcattgtgttccccgacctgggtgtgcgcgtgttcgagaagatggccctgtacgacgtggttagcaagctccccctggccgtgatgggaagctcctacggattccaatactcaccaggacagcgggttgaattccttgtgcaagcgtggaagtccaagaagaccccaatggggttttcatatgatacccgctgctttgactctacagtcactgagagcgatatccgtacggaggaagcaatctaccagtgttgtgacctggacccccaagcccgcgtggccatcaagtccctcactgagaggctttatgtcgggggccctcttaccaattcaagaggggaaaactgcggctatcgcaggtgccgcgcgagcggcgtactgacaactagctgtggcaacaccctcacttgctacatcaaggcccaagcagcctgtcgagcagcagggctccgggactgcaccatgywskkkkssggcgacgacttggtcgtcatctgtgaaagtcagggagtccaggaggatgcggcgagcctgagagccttcacggaggctatgaccaggtactccgctccccccggggaccccccccaaccagaatacgacttggagcttataacatcatgctcctctaacgtgtcagtcgcccacgacggcgctggaaagagggtctattacctcacccgtgaccctacaacccccctcgcgagagccgcgtgggagacagctagacacactccagtcaactcctggctaggcaacataatcatgtttgcccccacactgtgggtgagaatgatactgatgactcacttcttcagtgtcctcatagccagggatcagcttgaacaggccctggattgcgagatctacggagcttgttactccatagaaccactggacctacctccaatcattcaaagactccatggccttagcgcgttctcactccacagttactctccaggtgaaatcaatagggtggccgcatgcc

SEQ ID NO: 748 - DNA, 9441 bp, Hepatitis C Virus
gccagccccctgatgggggcgacactccgccatgaatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggataaacccgctcaacgcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgtcgcccacaggacgtcaagttcccgggtggcggacagatcgttggtggagtttacttgttgccgcgcaggggccctagattgggtgtgcgcgcgacgaggaagacttccgagcggtcgcaacctcgaggtagacgtcagcctatccccaaggcacgtcggcccgagggcaggacctgggctcagcccgggtacccttggcccctctatggcaatgagggctgcgggtgggcgggatggctcctgtctccccgcggctctcggcctagttggggccccacagacccccggcgtagatcgcgcaatttgggtaaggtcatcgatacccttacgtatggcttcgccgacctcatggggtacataccgctcgtcggcgccccccttgggggcgctgccagggccctggcgcacggcgtccgggtcctggaagacggcgtgaactatgcaacagggaaccttcctggttgctctttctctatcttccttctggccctgctctcttgcttgactgtgcccgcttcggccgtcggagtgcgcaactcttcgggggtgtaccatgtcaccaatgattgccccaatgcgtctgttgtgtacgagacagatagcttgatcatacatctgccggggtgtgtgccctgcgtacgcgagggcaacggttcgaggtgctgggtctcccttagtcctactgttgccgctaaggatccgggcgtcccggtcaacgagattcggcgtcacgtcgacctgattgccggggccgctgcattctgttcggctatgtatgtagggcacttatgcggttccatcttcctcgttggccagcttttcaccctctcccctaggcgccactggacaacacaagactgtaattgctccatctacccaggacatgtgacaggccatcgaatggcttgggacatgatgatgaactggtcccctacgacggcgctggtagtagcccagctgctccggatcccacaagccatcttggacatgatcgctggtgctcactggggagtcctggcgggcatagcgtatttctccatggtggggaactggacgaaggtcctggtagtgctgctgctatttgccggcgtcgacgcgacgaccatcgtctccgggggaagtgccggccgcagcacggctggacttgttgggctcttctcaccaggcgcccggcagaacatccagctgatcaacaccaacggcagttggcacatcaaccgcacggccctgaactgcaatgatacccttcaaaccggctgggtagcagggcttttctataccaacaaattcaactcttcgggttgccccgagaggttggccagctgccgaccccttgccgactttgaccagggctggggccctatcagttataccaacggaagcggccccgaccaacgcccctactgctggcactaccccccaaaaccttgtggtattgtgcccgcagagagcgtgtgtggcccagtatactgcttcactcccagccccgtggtggtgggaacgaccgacaggtcgggcgcgcccacctacaactggggtgaaaatgaaacggacgttttcgtcctcaacaacaccaggccacggctgggcaattggttcggtggtacctggatgaactcaactggattcaccaaggtgtgcggagcgcccccttgtgccatcggaggggtgggcaacaacaccttgtactgccccactgattgtttccgcaaacatccggaagccacgtactctcggtgcggctccggtccttggattacacccaggtgcttgatccactacccgtataggctttggcattatccttgtaccatcaattacaccatattcaagatcaggatgtttgtgggcggggttgagcacaggctcgacgccgcgtgcaactggacgcggggagagcgctgcgacttggacgacagggatcgggccgagttgagccctctgttgctgtccactacgcaatggcaggtcctcccctgctcattcacaacactgcccgccctgtcaactggcctgatacatctccaccagaacatcgtggacgtgcagtacctctatgggttgagctcggcagtcacatcctgggtcataaagtgggagtacgttgtgctcctcttcttgctgctagcagatgctcgcatttgtgcctgcttgtggatgatgcttctcatatctcaggtagaggcggcgctggagaacttgatagttctcaacgctgcttccctagtcgggacacatggcatcgtccccttcttcatctttttttgtgcagcttggtacctaaaaggcaagtgggcccctggactcgcctattccgtctatgggatgtggccactgctcctgcttctcctggcgttgccccaacgggcatacgccttggatcaggagttggccgcgtcgtgtggggccacggtcttcatctgcctagcggtgctcactctatcgccatattacaaacagtacatggcccgcggcatctggtggctgcagtacatgctgaccagagcagaggcgctcctacaggtttgggtccccccgctcaacgcccgaggagggcgcgacggagtcgtactgctcacgtgtgtgctccacccgcacttgctctttgaaatcaccaagatcatgctggccattctcgggcctttgtggatcttgcaggccagtctgctcaaggtaccgtacttcgtgcgcgttcagggccttctccggatctgcgcgctagcgcggaagatggtcggaggccattacgtgcaaatggtcaccatcaagttaggggcgctcactggcacctatatttataaccatctcactcctcttcgggactgggcgcacaacggcttgcaagacctagccgtagctgtggagccagtcgtcttctcccaaatggagaccaagctcatcacgtggggggcagacacagccgcgtgtggtgacatcatcaacggcttgcccgtctccgcccgcaggggccaggagatactgctcggaccagccgatggaatggcctctaggggatggaggttgctggcgcccatcacggcgtacgctcagcagacaaggggcctcctagggtgtataatcaccagcctgactggccgggacaagaaccaagtggagggtgaagtccagattgtgtcaactgctgcccaaacgttcttggcgacgtgcatcaacggggtatgctggactgtctaccacggggccggaaccaggaccattgcatcatccaagggtcctgttattctaatgtataccaatgtagaccaagacctcgggggctggaccgctcctcaagtgctcggctcactgacaccctggagctgcggctcctcggacctttacctggtcacgaggcatgccgatgtcattcccgtgccgcggcgaggtgaaaccaggggcagcctgctttcgccccggcccatttcctatctaaagggatcctcgggaggccccctgctctgtcccatgggacatgccgtgggcattttcagggccgcggtgtgcacccgtggggtcgcaaaggcggtcgactttgtgcccgttgagtccttagagaccaccatgaggtccccagtgtttactgacaattccagccctctaacagtgccccagagttaccaggtggcgcatctacatgcacccactgggagtggcaagagcacgaaggtgccggccgcttacgcagctcaggggtacaaggtacttgtgctgaacccgtctgttgctgccaccttagggttcggtgcttatatgtcaaaggcccatgggatcgacccaaacatcaggaccggcgtgaggaccatcaccacaggctcccccatcacctactccacctacggcaaatttttggctgatggcggatgcccaggaggtgcgtacgacatcataatatgtgacgaatgtcactcagtggacgccacctcgattctgggcatagggaccgtcttggaccaagcggagacggcgggggtcaggctcactgtcctcgccaccgctacaccacctggttccgtcaccgtgccacattccaacatcgaggaagttgcactgtccgctgacggggaaataccattttatggtaaggccatccccctaaactacatcaagggggggaggcacctcattttctgccactccaagaagaagtgcgacgagctcgctgcaaagctggtcggtccgggcgtcaacgcggtggccttttaccgtggcctcgacgtatctgtcattccaactacaggagacgtcgttgttgtagcgaccgacgccttgatgactggcttcaccggagatttcgactctgtgatagactgcaacacctgtgtcgtccagacagtcgacttcagcctagaccctatattctctattgagacttccaccgtgccccaggacgccgtgtcccgctcccaacggaggggtaggaccggtcgagggaagcatggtatttacagatatgtgtcacccggggagcggccgtctggcatgttcgactccgtggtcctctgtgagtgctatgacgcgggttgtgcttggtacgagcttacacccgccgagaccacagtcaggctacgggcatacctcaacaccccaggattgcccgtgtgccaggaccacttggagttctgggagagtgtcttcaccggcctcacccacatagatgcccacttcctgtcccagacgaaacagagtggggagaacttcccctacctagtcgcataccaagccaccgtgtgcgctagagctagagctcctcccccgtcatgggaccaaatgtggaagtgcctgatacggctcaagcccaccctcactggggctaccccattactatacagactgggtagtgtacagaatgagatcaccttaacacacccaatcacccaatacatcatggcttgcatgtcggcggacctggaggtcgtcactagcacgtgggtgttggtgggcggcgtcctagccgctttggccgcttactgcctgtccacaggcagcgtggtcatagtgggcaggataatcctaggtgggaagccggcagtcatacctgacagggaggttctctaccgagagtttgatgagatggaggagtgcgccgcccacgtcccctacctcgagcaggggatgcatttggcggagcagttcaagcagaaagctcttgggttgctccagacggcatccaaacaaacagagacgatcactcccattgtccagtctaattggcagaagctcgagtctttctgggctaaacacatgtggaacttcgttagcgggatacaatatctggcgggcctatcaacgctgcccgggaaccccgctatagcatcgctgatgtcgtttacggccgcagtgacgagtccactaaccactcagcagaccctcctctttaacatcttgggggggtggctggctgcccagcttgccgccccagccgccgccacagccttcgttggcgcaggcattactggcgccgttgttggcagtgtgggcctagggaaggtcctggtggacattcttgccggctacggggctggtgtggccggggccctcgtggctttcaaaatcatgagcggggagacccccaccacggaggatctagtcaaccttctgcctgccatcctatcgccaggagctctcgttgtcgccgtggtgtgcgcagcaatactacgccggcacgtgggccttggcgagggcgccgtgcagtggatgaaccggctgatagcgtttgcttctcggggtaaccacgtctcccctacacactacgtgccggagagcgacgcgtcggctcgtgtcacaccaattctcaccaggctcactgttactcagcttctgaaagggctccacgtgtggataagctcgaattgcatcgccccgtgtgctagttcttggcttaaagatgtctggaactggatatgcgaggtgctgagcgacttcaagaattggctgaaggccaaacttgtaccacaactgcccgggatcccattcgtatcctgccaacgcgggtaccgtggggtctggcggggcgagggcatcgtgcacactcgttgcccgtgtggggccaatataactggacatgtcaagaacggttcgatgagaatcgtcgggcctaagacttgcagcaacacctggcgtgggtcgttccccattaacgcttacactacaggcccgtgcacgccctccccggcgccgaactatacgttcgcgctatggagggtgtctgcagaggagtatgtggaggtaaggcggctgggggacttccattacgtcacgggggtgaccactgataaactcaagtgtccatgccaggtcccctcacccgagttctccacagaggtggacggggtgcgcctgcataggtacgcccctccctgcaaacccctgctacgggatgaggtgacgtttagcgtcgggttcaatgaatacctggtggggtcccagttgccctgcgagcccgagccagacgtagcagcattaacatcaatgcttacagacccttcccacatcactgcaaagacggcggcgcgtaggctgaagcgggggtctcccccctccctggccagttcttctgccagccagctgtccgcgccgtcactgaaagcaacatgcaccactcaccatgactctccagacgccgacctcatagaagccaacctcctgtggagacgggagatgggggggaacatcaccagagtggagtcggagaacaagattgttgttctggattctttcgacccgctcgtggcagaggaggatgaccgggagatttctattccagctgagattctgcggaaatttaagcagtttccccccgccatgcccatatgggcacggccggattataatcctccccttgtggaaccgtggaagcgcccggactgtgatccacccttagtccacgggtgccccctaccacctcccaagccgactccggtgccgccaccccggaaaaagaggacggtggtgctggacgagtctacagtatcatctgctctggctgagcttgccactaagaccttcggcagctctacaacctcaggcgtgacaagtggtgaagcggccgaatcgtccccggcgctttcctgcgacggtgagctggactccgaagctgaatcttactcctccatgccccctctcgagggggaaccgggggaccccgatctcagcgacgggtcttggtctaccgtgagcagtgatggcggtacggaggatgtcgtgtgctgctcgatgtcctactcgtggacgggcgccttaattacgccctgtgccgcagaggaaaccaaactccccatcaacgcactgagtaactcgctgctgcgccaccacaatttggtgtattccaccacctctcgcagcgctggcaagaggcagaaaaaagtcacatttgacaggctgcaggtcctggacgatcattaccgggacgtgctcaaggaggctaaggccaaggcatccacagtgaaggctaaattgctatccgtagaggaggcatgtagcctgacgcccccgcactccgccagatcaaaatttggctatgggccgaaggatgtccgaagccattccagtaaggctatacgccacatcaactccgtgtggcaggaccttctggaggacaatacaacacctatagacactaccatcatggccaagaatgaagtcttctgcgtgaaggccgaaaaagggggtcgcaagcccgctcgccttatcgtgtaccccgacctgggggtgcgcgtgtgcgagaagagagctttgtatgacgtagtcaaacagctccccattgccgtgatgggaccctcctacgggttccagtactcgccagcgcagcgggtcgacttcctgcttaacgcgtggaaatcaaagaaaaaccctatggggttttcctatgacacccgttgctttgactcaacagtcactgaggctgatatccgtacggaggaagacctctatcaatcttgtgacctggtccctgaggcccgcgcggccataaggtctctcacagagaggctttacatcgggggcccacttaccaattctaagggacaaaactgcggctatcggcgatgccgcgcaagcggcgtgctgaccactagctgcggtaacaccataacttgctaccttaaggctagtgcggcctgtcgagctgcaaagctccaggactgcaccatgctcgtgtgcggcgacgacctcgtcgttatctgtgaaagcgccggtgtcaaggaggacgctgcgagcctgagagccttcaccgaggctatgaccaggtactccggccccccgggagacccggctcaaccagaatacgacttggagcttataacatcctgctcctccaatgtgtcggtcgcgcgcgacggcgctggccaaagggtctattatctgacccgtgaacctgagactcccctcgcgcgtgccgcttgggagacagcaagacacactccagtgaactcctggctaggcaacatcatcatgtttgcccccactctgtgggtacggatggtcctcatgacccacttattctccatactcatagttcaggagcaccttgaaaaggctctagattgtgaaatctatggagccacacactccgtcccaccgttggacctacctgaaatcattcaaagactccatggcctcagcgcgttttcgctccacagttactctccaggtgaaatcaatagggtggcttcatgcctcaggaaacttggggttccacccttgcgagcttggagacaccgggcccggagcgtccgcgccacactcctatcccagggggggaaagccgccatatgcggtaagtacctcttcaactgggcggtgaaaaccaaactcaaactcattccattaccgctcgcgtctcatttggacttgtccaattggttcacgggcggctacagcgggggagacatttatcacagcgtgtctcatgcccggccccgttggtttctctggtgcctactcctactctcagtaggggtaggcatctacctccttcccaaccgatagacggttgggcaaccactccaggcctttaggccctatttaaacactccaggcctttaggccccgt

SEQ ID NO: 749 - DNA, 8484 bp, Hepatitis C Virus
ccatggcgttagtatgagtgtcgtacagcctccaggaccccccctcccgggagagccatagtggtctgcggaaccggtgagtacaccggaattgccaggacgaccgggtcctttcttggataaacccgctcaatgcctggagatttaggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcgcgtcggcccgagggcaggacctgggctcagcccgggtatccttggcccctctatggcaatgagggctgcgggtgggcgggatggctcctgtctccccgtggctctcggcctagctggggccccacagacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttctggaggacggcgtgaactatgcaacagggaaccttcctggttgctctttctctatcttccttctggccctgctctcttgcctgaccgtgcccgcttcagcctaccaagtgcgcaactccacggggctttaccatgtcaccaatgattgccctaactcgagtattgtgtacgaggcggccgatgccatcctgcacactccggggtgcgtcccttgcgttcgcgagggtaacacttcgaggtgttgggtggcgttaacccccacggtggccaccagggacggcaaactccccacaacgcagctacgacgtcacatcgatctgcttgtcgggagcgccactctctgttcggccctctacgtgggggacctgtgcgggtctgtctttcttgtaggtcaactgtttaccttctctcccaggcgccactggacaacgcaaggctgcaattgttccatctatcccggccatataacgggtcaccgcatggcatgggatatgatgatgaattggtcccctacgacggcgttggtagtagctcagctgctccggatcccacaagccatcttggacatgatcgctggtgctcactggggagtcctggcgggcatagcgtatttctccatggtggggaactgggcgaaggtcctggtagtgctgctgctattcgccggcgtcgatgcgggaacctacgtcaccgggggagccgctggccacgctacggctggatttgctggcatctttaaacaaggcgccaagcagaatatccagctggtcaataccaacggcagttggcacatcaacaggacggccttgaactgcaacgctagccttgacaccggctggttagcagggcttttctattaccacaagttcaactcctcaggctgtcccgagaggttggccagctgccggccccttaccgattttgaccagggctggggccctatcggttataccgatggaaatggctctgaccaacgcccctactgctggcactaccccccacgaccatgcggtattgtgcccgcagagagcgtgtgtggcccggtatattgtttcactcccagccccgtggtggtgggaacgaccgacaggtcgggcgtgcctacctacagctggggtgcaaatgacacggacgtcttcgtccttaacaacactaggccaccgctgggcaattggttcggttgtacctggatgaactcaactggattcaccaaagtgtgcggagcgcccccctgtgtcatcggagggatgggcaacaacaccttacactgccccactgattgtttccgcaagcatccagaagccacatactctcggtgcggctccggtccctggattacacccaggtgcttggtccactacccgtataggctttggcattacccttgtaccatcaactacaccatattcaaagtcaggatgtacgtgggaggggtcgagcacaggctggaagctgcctgcaattggacgcgaggtgaacgctgcgacctggaagacagggacaggtccgagctcagcccgctgctgctgtccaccacacagtggcagatccttccgtgttccttcacgaccctgccagccttgtccaccggcctcatccatctccaccagaacattgtggacgtgcagtacttgtacggggtggggtcaagtgtcgcgtcctgggccattaagtgggactacgtcgttctcctgttccttctgcttgcagatgcgcgcatctgctcctgcttgtggatgatgttactcatatcccaagcggaggcggccttggagaacctcgtagtactcaacgcagcatccctggccgggacgcacggtcttgtctccttcctcgtgttcttctgcttcgcgtggtatctgaagggtaggtgggtgcccggagcggtctacgccctctacgggatgtggcctctcctcctgctcctgttggcgttgccccagcgggcgtacgcgctggacacggaggtggccgcgtcgtgtggcggcgttgttctcgtcgggttaatggcgctgactctgtcaccatattacaagcgctatattagctggtgcttttggtggcttcagtattttctgaccagagtagaagcgcaactgcacgtgtgggttccccccctcaacgttcgaggggggcgtgacgccgtcattttactcatgtgtgctatacacccgactttggtattcgacatcaccaaactgctgctggccatcttcggacccctttggattctccaagccagtctgcttaaagtaccctacttcgtgcgcgttcaaggccttctccggatctgcgcgctagcgcggaagatggttggaggccattacgtgcaaatggccatcatcaagctaggggcgcttactggcacctatgtttataaccatctcactcctcttcgggactgggcgcacaacggcctgcgagatctggccgtggctgtagagccagtcgtcttctcccggatggagaccaagctcatcacgtggggggcagataccgccgcgtgcggtgacatcatcaacggcttgcccgtctccgcccgtaggggccgggagatactgctcgggccagccgatggaatggtctccaaggggtggaggttgctggcgcccattacggcgtacgcccagcagacaaggggcctcctagggtgtataatcaccagcctgactggccgggacaaaaaccaagtggagggtgaggtccagattgtgtcaactgctgcccaaactttcctggcaacgtgtatcaatggggtatgctggactgtctatcacggggccggaacaaggaccatcgcatcatctaagggccccgttatccagatgtataccaatgtagaccaagaccttgtgggctggcccgctccgcaaggagcccgctcattgacaccctgcacctgcggctcctcggacctttacctggtcacgaggcacgccgatgtcattcccgtgcgccggcggggtgatagtaggggcagcctgctttcgccccggcccatttcctacttgaaaggctcctcggggggtccgttgttgtgccccgcgggacacgccgtaggcatattcagggccgcggtatgcacccgtggagtggctaaggcggtggactttatccctgtggagaacctggagacaactatgaggtccccggtgttcacggacaactcctctccaccagcagtgccccagagctaccaggtggcccacctgcacgctcccacaggcagcggtaagagcaccaaggtcccggccgcatacgcggctcagggctacaaggtgctagtgctcaacccctccgttgctgcaacactgggctttggtgcttacatgtctaaggcccatggaatcgatcctaacatcaggaccggggtgagaacaattaccacaggcagccccatcacgtactccacctacggcaagttccttgccgacggcgggtgctcggggggtgcttatgacataataatttgtgacgagtgccactccacggatgctacatccatcttgggcatcggcaccgtccttgaccaagcagagactgcgggggcgaggctggttgtgctcgccaccgctacccctccgggctccatcaccgtgccccatcctaacatcgaggaggttgctctgtccaccaccggagagatccctttttatggcaaggccatccccctcgaagtaatcaagggggggaggcacctcatcttctgtcactcaaagaaaaagtgcgacgagctcgccgcaaaactggtcgcattaggcatcaatgccgtggcttactaccgcggtcttgacgtgtccgtcatcccgaccagcggcgatgttgtcgtcgtggcaactgacgccctcatgaccggctttaccggcgacttcgactcggtgatagactgcaacacgtgtgtcacccagacagtcgatttcagccttgatcctactttcaccattgacacatccacgcttccccaggatgctgtctcccgcactcaacgtcggggcaggactggcagggggaagccaggcatctacagatttgtggcaccgggggagcgcccctccggcatgttcgactcgtccgtcctctgtgagtgctatgacgcgggctgtgcttggtatgagctcacacccgccgagactacagtcaggctgcgagcgtacatgaacaccccggggcttcccgtgtgccaggaccatcttgaattttgggagggcgtctttacgggcctcactcatatagatgcccacttcctatcccagacaaagcagagtggggaaaactttccttacctggtagcgtaccaagccaccgtgtgcgctagggctcaagcccctcccccatcgtgggaccagatgtggaagtgcttgatccgcctcaagcccactctccatggaccaacacccctgttatacagactgggcgctgttcagaatgaagtcaccctgacgcacccagtcaccaaatacatcatgacatgcatgtcagccgacctggaggtcgtcacgagcacctgggtgctcgttggcggcgtcctggccgctttggccgcgtactgcctgtcaacaggctgcgtggtcatagtgggcagggttgttctgtccgggaagccggcaattatacctgacagggaggtgctctaccgggagttcgatgagatggaagagtgctctcagcacctaccgtacatcgagcagggaatgatgctcgccgagcagttcaagcagaaggccctcggcctcctgcagactgcgtcccatcaggcagaggttatcggccctgctgtccagaccaactggcaaaaactcgaggtcttctgggcaaagcatatgtggaacttcatcagtgggatacaatatttggcgggcctgtcaacgttgcctggcaaccccgccattgcttcattgatggcctttacagctgctgtcaccagcccactaaccactggccaaaccctcctcttcaacatattaggggggtgggtggctgcccagctcgccgcccccggtgcagctactgcctttgtgggcgctggcttggccggcgccgccattggcagtgttggactggggaaggtcctcgtggacattcttgcagggtatggcgcgggcgtggcgggagctcttgtagcattcaagatcatgagcggcgaggttccttccacggaggacctggtcaatctactgcccgccatcctctcgcctggagccctcgtagtcggcgtggtctgtgcagcaatactgcgccggcacgttggcccgggcgagggggcggtgcaatggatgaaccggctaatagccttcgcctcccgggggaaccacgtttcccccacgcactacgtgccggagagcgatgcagctgcccgcgtcactgccatactcagcagcctcactgtgacccagctcctgaggcgactgcaccagtggataagctcagagtgtaccaccccatgctccggttcctggctaagggacatctgggactggatatgcgaggtgctgagcgactttaagacctggctaaaagccaagctcatgccacaactgcctgggattccctttgtgtcctgccagcgcgggtataagggggtctggcggggggacggcatcatgcacactcgctgccactgtggagctgaaatcactggacacgtcaaaaacgggacgatgaggatcgtcggtcctaggacctgcaggaacatgtggaatggaactttccccatcaacgcctacacaacgggcccctgtaccccccttcctgcgccgaactataagttcgcgctatggagggtgtctgcagaggaatacgtggagataaggcaggtgggggactttcactacgtgacgggtatgactactgacgaccttaaatgcccgtgccaggtcccatcgcccgaatttttcacagaattggacggggtgcgcctacataggtttgcgcccccctgcaagcccttgctgcgggaggaggtatcattcagagtaggactccacgcgtacccggtggggtcgcaattaccttgcgagcccgaaccggatgtggccgtgttgacgtccatgctcactgatccctctcatataacagcagaagcggccgggagaaggttggcgaggggctcccccccttctgtggccagctcctcggctagccagctgtccgctccatctctcaaggcaacttgcaccatcaaccatgactcccctgacgccgagctcatagaggccaacctcctgtggaggcaggcgatgggcggcaacatcaccagggttgagtcagagaacaaagtggtgattttggactctttcgatccgcttgtggcggaggaggacgagcgggagatctccgtccccgcagaaatcctgcggaagtctcggagattcgcccaggccctgcccgtttgggcacggccggactataaccccccgctaatagagacgtggaaaaagcctgactacgaaccacctgtggtccatggctgcccacttccacctccaaagtcccctcctgtgcctccgcctcggaagaagcggacggtggtcctcaccgaatcaaacctacctactgccttggccgagcttgccaccaaaagttttggcagctcctcaacttccggtattgcggctgacaacacgacaacgtcctctgagcccgccccttctggctgccccccagactccgacgctgaatcctattcttccatgccccccctggagggggagcctggggatccggatctcagcgacgggtcatggtcgacggtcagtagcgaggccggtacagaggatgtcgtgtgctgctcaatgtcttattcctggacgggcgcactcatcaccccgtgcgctgcggaagagcagaaactgcccatcaacgcactgagcaactcgttgctacgccaccacaatttggtatattccaccacctcacgcagtgcttgccaaaggcagaagaaagtcacatttgacagactgcaggtcctggacagccattaccaggacgtgctcaaggaggttaaagctgcggcgtcaaaagtgaaggctaacttgctatccgtagaggaagcttgcagcctgacgcccccacactcagccagatccaagtttggctatggggcaaaagacgtccgttgccatgccagaaaggccgtaaaccacatcaactccgtgtggaaagaccttctggaagacagtgtaacaccaatagacactaccatcatggctaagaacgaggttttctgcgttcagcctgagaaggggggtcgtaagccagctcgtctcatcgtgtttcccgacctgggtgtacgcgtgtgcgagaagatggccctgtacgacgtggtcagcaagctccccttggccgtgatgggaagctcctacggattccaatactcaccaggacagcgggttgaattcctcgtgcaagcgtggaagtccaagaagaacccaatggggttctcgtatgatacccgctgctttgactccacagtcactgagagcgatatccgtacggaggaggcaatctaccaatgttgtgacctggacccccaagcccgcgtggccatcaagtccctcactgagaggctttatgttgggggccctcttaccaattcaaaaggggagaactgcggctatcgcaggtgccgcgcaagcggcgtactgacaactagctgtggtaacaccctcacttgctacatcaaggcccgagcagcctgtcgagccgcagggctccaggactgcaccatgctcgtgtgtggcgacgacttagtcgt

SEQ ID NO: 750 - DNA, 8475 bp, Hepatitis C Virus
agtatgagtgtcgtacagcctccaggaccccccctcccgggagagccatagtggtctgcggaaccggtgagtacaccggaattgccaggacgaccgggtcctttcttggataaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcgcgtcggcccgagggcaggacctgggctcagcccgggtatccttggcccctctatggcaatgagggctgcgggtgggcgggatggctcctgtctccccgtggctctcggcctagctggggccccacagacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttctggaggacggcgtgaactatgcaacagggaaccttcctggttgctctttctctatcttccttctggccctgctctcttgcctgaccgtgcccgcttcagcctaccaagtgcgcaactccacggggctttaccatgtcaccaatgattgccctaactcgagtattgtgtacgaggcggccgatgccatcctgcacactccggggtgcgtcccttgcgttcgcgagggtaacacttcgaggtgttgggtggcgttaacccccacggtggccaccagggacggcaaactccccacaacgcagctacgacgtcacatcgatctgcttgtcgggagcgccactctctgttcggccctctacgtgggggacctgtgcgggtctgtctttcttgtaggtcaactgtttaccttctctcccaggcgccactggacaacgcaaggctgcaattgttccatctatcccggccatataacgggtcaccgcatggcatgggatatgatgatgaattggtcccctacgacggcgttggtagtagctcagctgctccggatcccacaagccatcttggacatgatcgctggtgctcactggggagtcctggcgggcatagcgtatttctccatggtggggaactgggcgaaggtcctggtagtgctgctgctattcgccggcgtcgatgcgggaacctacgtcaccgggggagccgctggccacgctacggctggacttgctggcatctttaaacaaggcgccaagcagaatatccagctggtcaataccaacggcagttggcacatcaacaggacggccttgaactgcaacgctagccttgacaccggctggttagcagggcttttctattaccacaagttcaactcctcaggctgtcccgagaggttggccagctgccggccccttaccgattttgaccagggctggggccctatcggttataccgatggaaatggctctgaccaacgcccctactgctggcactaccccccacgaccatgcggtattgtgcccgcagagagcgtgtgtggcccggtatattgtttcactcccagccccgtggtggtgggaacgaccgacaggtcgggcgtgcctacctacagctggggtgcaaatgacacggacgtcttcgtccttaacaacactaggccaccgctgggcaattggttcggttgtacctggatgaactcaactggattcaccaaagtgtgcggagcgcccccctgtgtcatcggagggatgggcaacaacaccttacactgccccactgattgtttccgcaagcatccagaagccacatactctcggtgcggctccggtccctggattacacccaggtgcttggtccactacccgtataggctttggcattacccttgtaccatcaactacaccatattcaaagtcaggatgtacgtgggaggggtcgagcacaggctggaagctgcctgcaattggacgcgaggtgaacgctgcgacctggaagacagggacaggtccgagctcagcccgctgctgctgtccaccacacagtggcagatccttccgtgttccttcacgaccctgccagccttgtccaccggcctcatccatctccaccagaacattgtggacgtgcagtacttgtacggggtggggtcaagtgtcgcgtcctgggccattaagtgggactacgtcgttctcctgttccttctgcttgcagatgcgcgcatctgctcctgcttgtggatgatgttactcatatcccaagcggaggcggccttggagaacctcgtagtactcaacgcagcatccctggccgggacgcacggtcttgtctccttcctcgtgttcttctgcttcgcgtggtatctgaagggtaggtgggtgcccggagcggtctacgccctctacgggatgtggcctctcctcctgctcctgttggcgttgccccagcgggcgtacgcgctggacacggaggtggccgcgtcgtgtggcggcgttgttctcgtcgggttaatggcgctgactctgtcaccatattacaagcgctatattagctggtgcttttggtggcttcagtattttctgaccagagtagaagcgcaactgcacgtgtgggttccccccctcaacgttcgaggggggcgtgacgccgtcattttactcatgtgtgctatacacccgactttggtattcgacatcaccaaactgctgctggccatcttcggacccctttggattctccaagccagtctgcttaaagtaccctacttcgtgcgcgttcaaggccttctccggatctgcgcgctagcgcggaagatggttggaggccattacgtgcaaatggtcatcatcaagctaggggcgcttactggcacctatgtttataaccatctcactcctcttcgggactgggcgcacaacggcctgcgagatctggccgtggctgtagagccagtcgtcttctcccggatggagaccaagctcatcacgtggggggcagataccgccgcgtgcggtgacatcatcaacggcttgcccgtctccgcccgtaggggccgggagatactgctcgggccagccgatggaatggtctccaaggggtggaggttgctggcgcccattacggcgtacgcccagcagacaaggggcctcctagggtgtataatcaccagcctgactggccgggacaaaaaccaagtggagggtgaggtccagattgtgtcaactgctgcccaaactttcctggcaacgtgtatcaatggggtatgctggactgtctatcacggggccggaacaaggaccatcgcatcatctaagggccccgttatccagatgtataccaatgtagaccaagaccttgtgggctggcccgctccgcaaggagcccgctcattgacaccctgcacctgcggctcctcggacctttacctggtcacgaggcacgccgatgtcattcccgtgcgccggcggggtgatagtaggggcagcctgctttcgccccggcccatttcctacttgaaaggctcctcggggggtccgttgttgtgccccgcgggacacgccgtaggcatattcagggccgcggtatgcacccgtggagtggctaaggcggtggactttatccctgtggagaacctggagacaactatgaggtccccggtgttcacggacaactcctctccaccagcagtgccccagagctaccaggtggcccacctgcacgctcccacaggcagcggtaagagcaccaaggtcccggccgcatacgcggctcagggctacaaggtgctagtgctcaacccctccgttgctgcaacactgggctttggtgcttacatgtctaaggcccatggaatcgatcctaacatcaggaccggggtgagaacaattaccacaggcagccccatcacgtactccacctacggcaagttccttgccgacggcgggtgctcggggggtgcttatgacataataatttgtgacgagtgccactccacggatgctacatccatcttgggcatcggcaccgtccttgaccaagcagagactgcgggggcgaggctggttgtgctcgccaccgctacccctccgggctccatcaccgtgccccatcctaacatcgaggaggttgctctgtccaccaccggagagatccctttttatggcaaggccatccccctcgaagcaatcaagggggggaggcacctcatcttctgtcactcaaagaaaaagtgcgacgagctcgccgcaaaactggtcgtattaggcatcaacgccgtggcttactaccgcggtcttgacgtgtccgtcatcccgaccagcggcgatgttgtcgtcgtggcaactgacgccctcatgaccggctttaccggcgacttcgactcggtgatagactgcaacacgtgtgtcacccagacagtcgatttcagccttgatcctactttcaccattgacatatccacgcttccccaggatgctgtctcccgcactcaacgtcggggcaggactggcagggggaagccaggcatctacagatttgtggcaccgggggagcgcccctccggcatgttcgactcgtccgtcctctgcgagtgctatgacgcgggctgtgcttggtatgagctcacacccgccgagactacagtcaggctgcgagcgtacatgaacaccccggggcttcccgtgtgccaggaccatcttgaattttgggagggcgtctttacgggcctcactcatatagatgcccactttctatcccagacaaagcagagtggggaaaactttccttacctggtagcgtaccaagccaccgtgtgcgctagggctcaagcccctcccccatcgtgggaccagatgtggaagtgcttgatccgcctcaagcccactctccatggaccaacacccctgttatacagactgggcgctgttcagaatgaagtcaccctgacgcacccagtcaccaaatacatcatgacatgcatgtcagccgacctggaggtcgtcacgagcacctgggtgctcgttggcggcgtcctggccgctttggccgcgtactgcctgtcaacaggctgcgtggtcatagtgggcagggttgttctgtccgggaagccggcaattatacctgacagggaggtgctctaccgggagttcgatgagatggaagagtgctctcagcacctaccgtacatcgagcagggaatgatgctcgccgagcagttcaagcagaaggccctcggcctcctgcagactgcgtcccatcaggcagaggttatcggccctgctgtccagaccaactggcaaaaactcgaggtcttctgggcaaagcatatgtggaacttcatcagtgggatacaatatttggcgggcctgtcaacgttgcctggcaaccccgccattgcttcattgatggcctttacagctgctgtcaccagcccactaaccactggccaaaccctcctcttcaacatattaggggggtgggtggctgcccagctcgccgcccccggtgcagctactgcctttgtgggcgctggcttggccggcgccgccattggcagtgttggactggggaaggtcctcgtggacattcttgcagggtatggcgcgggcgtggcgggagctcttgtagcattcaagatcatgagcggcgaggttccttccacggaggacctggtcaatctactgcccgccatcctctcgcctggagccctcgtagtcggcgtggtctgtgcagcaatactgcgccggcacgttggcccgggcgagggggcggtgcaatggatgaaccggctaatagccttcgcctcccgggggaaccacgtttcccccacgcactacgtgccggagagcgatgcagctgcccgcgtcactgccatactcagcagcctcactgtgacccagctcctgaggcgactgcaccagtggataagctcagagtgtaccaccccatgctccggttcctggctaagggacatctgggactggatatgcgaggtgctgagcgactttaagacctggctaaaagccaagctcatgccacaactgcctgggattccctttgtgtcctgccagcgcgggtataagggggtctggcggggggacggcatcatgcacactcgctgccactgtggagctgaaatcactggacacgtcaaaaacgggacgatgaggatcgtcggtcctaggacctgcaggaacatgtggaatggaactttccccatcaacgcctacacaacgggcccctgtaccccccttcctgcgccgaactataagttcgcgctatggagggtgtctgcagaggaatacgtggagataaggcaggtgggggactttcactacgtgacgggtatgactactgacgaccttaaatgcccgtgccaggtcccatcgcccgaatttttcacagaattggacggggtgcgcctacataggtttgcgcccccctgcaagcccttgctgcgggaggaggtatcattcagagtaggactccacgcgtacccggtggggtcgcaattaccttgcgagcccgaaccggatgtgaccgtgttgacgtccatgctcactgatccctctcatataacagcagaagcggccgggagaaggttggcgaggggctcccccccttctgtggccagctcctcggctagccagctgtccgctccatctctcaaggcaacttgcaccatcaaccatgactcccctgacgccgagctcatagaggccaacctcctgtggaggcaggcgatgggcggcaacatcaccagggttgagtcagagaacaaagtggtgattttggactctttcgatccgcttgtggcggaggaggacgagcgggagatctccgtccccgcagaaatcctgcggaagtctcggagattcgcccaggccctgcccgtttgggcacggccggactataaccccccgctaatagagacgtggaaaaagcctgactacgaaccacctgtggtccatggctgcccacttccacctccaaagtcccctcctgtgcctccgcctcggaagaagcggacggtggtcctcaccgaatcaaacctatctactgccttggccgagcttgccaccaaaagttttggcagctcctcaacttccggtattgcggctgacaacacgacaacgtcctctgagcccgccccttctggctgccccccagactccgacgctgaatcctattcttccatgccccccctggagggggagcctggggatccggatctcagcgacgggtcatggtcgacggtcagtagcgaggccggtacagaggatgtcgtgtgctgctcaatgtcttattcctggacgggcgcactcatcaccccgtgcgctgcggaagagcagaaactgcccatcaacgcactgagcaactcgttgctacgccaccacaatttggtatattccaccacctcacgcagtgcttgccaaaggcagaagaaagtcacatttgacagactgcaggtcctggacagccattaccaggacgtgctcaaggaggttaaagctgcggcgtcaaaagtgaaggctaacttgctatccgtagaggaagcttgcagcctgacgcccccacactcagccagatccaagtttggctatggggcaaaagacgtccgttgccatgccagaaaggccgtaaaccacatcaactccgtgtggaaagaccttctggaagacagtgtaacaccaatagacactaccatcatggctaagaacgaggttttctgcgttcagcctgagaaggggggtcgtaagccagctcgtctcatcgtgtttcccgacctgggtgtacgcgtgtgcgagaagatggccctgtacgaagtggtcagcaagctccccttggccgtgatgggaagctcctacggattccaatactcaccaggacagcgggttgaattcctcgtgcaagcgtggaagtccaagaagaacccaatggggttctcgtatgatacccgctgctttgactccacagtcactgagagcgatatccgtacggaggaggcaatctaccaatgttgtgacctggacccccaagcccgcgtggccatcaagtccctcactgagaggctttatgttgggggccctcttaccaattcaaaaggggagaactgcggctatcgcaggtgccgcgcaagcggcgtactgacaactagctgtggtaacaccctcacttgctacatcaaggcccgagcagcctgtcgagccgcagggctccaggactgcaccatgctcgtgtgtggcgacgacttagtcgtt

SEQ ID NO: 751 - DNA, 9689 bp, Hepatitis C Virus
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagaccgggtcctttcttggataaacccgctctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaacccaaagaaacactaaccgtcgcccacaagacgttaagtttccgggcggcggccagatcgttggcggagtatacttgttgccgcgcaggggccccagattgggtgtgcgcacagcaaggaagacttcggagcggtcccagccacgtggaagacgccagcccatccctaaagatcggcgttccactggcaagtcctggggaagaccaggatacccctggcccctatacgggaatgagggcctcggttgggcaggatggctcttgtccccccgaggttcccgtccctcttggggccccactgacccccggcataggtcgcgcaatgtgggtaaggtcatcgataccctaacgtgcggctttgccgacctcatggggtacatccccgtcgtgggcgccccgctcggcggcgtcgccagagctctcgcgcatggcgtgagagtcctggaggacggggttaattatgcaacagggaacctacctggttgctccttttctatcttcttgctagccctgctgtcctgcatcaccatcccggcctccgctgttgaggtgaagaacaccagcaccggttacatggtgactaatgactgtgccaatagcagcatcacctggcagctccacgctgcggtcctccacgtccccgggtgcgtcccgtgtgagagggtggacaataatacatcccggtgctggataccggtctcaccaaacatagctgtgcagcggcccggcgccctcacgcagggcttgcggtcgcacattgacatagttgtgatgtccgccacgctttgctccgccctctacgtgggggacctctgcggcggggtgatgctcgcagcccagatgttcgttgtctcgcctgagcaccattggttcgtgcaagaatgcaattgctccatctaccctggtaccatcacgggacaccgcatggcatgggacatgatgatgaactggtcgcccacggctaccatgattctggcctacgcgatgcgcgtccccgaggtcattatagacatcattggcggggcccactggggcgtcatgtttggcttggcctacttctctatgcagggggcgtgggcgaaagtcgttgtcatccttttgctggccgctggggtggacgcgtacacccacactgttgggggggctgccgcgtccaccgccaattccatcgccggccttctcagccgaggccccaggcagaatcttcagctcattaactccaatggcagttggcacatcaaccgcactgctctgaactgccatgactccttgcaaactggcttcatcacggcactgttctacgcccgccacttcaactcgtcgggatgccctgaacgcttggctgcctgtcgcaacatcgaggccttccgagtagggtggggtgccttgcaatacgaggacaatgtcaccaacccggaagatatgagaccatattgctggcactacccaccaaaacagtgcggcatagtccccgcgagatctgtgtgtggcccagtatactgtttcacccccagcccagtcgtagtgggcacgaccgacaagcttggagtgcctacctacacgtggggggagaatgagacagatgtcttcctattgaacagcactcgaccaccgcaggggccgtggttcggctgcacatggatgaactccactggtttcactaagacttgcggtgcgccaccatgtcgtactagagctgacttcaacgccagcacggacctgctgtgccccacggactgttttaggaagcatcctgacgccacttacaacaagtgtggctctggaccctggctcacgccaaggtgcctgatcgactacccctacagactctggcattacccctgcacagtgaactataccaccttcaaaataaggatgtatgtggggggggtcgagcacaggctcatggccgcgtgcaatttcacccgtggggattcctgcgacttgtcgcaaagagacaggggtcaattgtctcccttgctacactccaccacggaatgggctattttaccctgctctttctcagacctgcccgctttgtcaaccggccttctccacctccaccaaaacatcgtggacgtccagtacatgtacggcctgtcacccgctctcacaaagtatatcgtccgatgggagtgggtagtactcttattcctgctcctagcggacgccagggtttgcgcctgtatatggatgctcatcttgctgggccaagctgaggcagcactagagaagctggttgtcttgcacgccgcaagtgcggccagttgcaatggccctctatattttgtcatcttctttgtagctgcctggtatttcaagggtcgggtggttcccttggctgcctattccctcaccggcctatgggccttctgcctactgctcctagcattgccccaacaggcttatgcctatgatgcatctgtgcatgggcagataggtgcgactctgttgatattgatcaccctttttacactcaccccggggtataagaccctcctcagccggtttctgtggtggttgtgctaccttctgaccctgggggaagtcatggtccaggagtgggtaccaccaatgcaggcgcgtggtggccgcgacggcatcatatgggtcgccaccatgttctgcccgggtgtagtgtttgacataaccaagtggctcttggcaatacttgggcctgcttgcctcctaggagatgctttgacgcgcgtgccgtacttcgtcagagctcacgctctgctgaggatgtgcgctatggtaaggcacctcgcggggggcaagtacgtccagatggctctactagcccttggcaggtggactggtacttacatctatgatcacctcagccccatgtcggactgggccgctaatggcctgcgggaccttgcggtcgccgtagaacctatcatcttcagtccgatggagaagaaagtcatcgtctggggggcggagacggccgcatgcggggacatcctacacggacttcccgtgtccgcccgactcggccgggaggtcctcctcggcccagctgatggctatacctccaaggggtggagtcttctcgcccccatcacagcttacgctcagcaaacacggggtcttttgggcactatagtggtgagtatgacggggcgcgacaagacggaacaggccggggaaatccaggtcctgtccacggtcactcagtccttcctcggaacatccatatcgggggttttatggaccgtctaccatggagctggcaacaagaccctagccggctcacggggcccggtcacgcagatgtattccagcgctgagggggacttggtaggatggcccagccctcccgggactaagtccttggagccgtgcacgtgtggagcggtcgacctgtacctggtcacgcggaacgctgacgtcatcccggctcgaagacgcggggacaagcggggagcgctactctccccgagacccctttcgaccttgaaggggtcctcggggggaccggtgctttgccccaggggccacgctgtcgggatcttccgggcagctgtgtgctctcggggcgtggctaagtccatagatttcatccccgtcgaggcgcttgacatcgtcacgcggtcccccaccttcagtgataacagcacgccacctgctgtgccccagacctaccaggtcgggtacttacatgctccaactggcagtggaaagagcaccaaagtccctgtcgcatacgcctcccaggggtataaagtgctagtgcttaatccctcggtggctgccaccctggggtttggggcatacctgtctaaggcacatggcatcaatcccaacattaggactggggtcaggactgtgacgaccggagaacccatcacgtactccacatatggtaaattcctcgccgatgggggctgcacaggcggcgcctacgacatcatcatatgcgatgaatgccattccatggatgccaccaccatcctcggcatcggaacagtccttgatcaagcagagacagccggggtcaggttaactgtgctggctacggccacgccccctgggtcggtgacaaccccccaccccaatatagaggaggtagccctcgggcaggagggtgagatccccttctatgggagggcgattcccctatcttacatcaagggggggagacacttgatcttctgccattcaaagaagaagtgcgacgagctcgcggcggcccttcggggcatgggcttgaacgcagtggcatattacagagggctggacgtctccataattccaactcagggagatgtggtggtcgtcgccaccgacgccctcatgacggggtacactggggactttgactccgtgatcgactgtaacgtagcggtcactcaagttgtagacttcagcctggaccccaccttcactataaccacacagactgtccctcaggacgccgtctcgcgtagccagcgccgggggcgcacgggtaggggacgattgggcatttataggtatgtttctactggtgagcgagcctcaggaatgtttgatagtgtagtgctctgtgagtgctacgacgcgggggccgcgtggtatgagctcacaccagcagagaccaccgtcaggctcagagcgtatttcaacacacccggcctgcctgtgtgccaggaccatcttgagttttgggaggcagttttcaccggcctcacacacatagatgcccacttcctttcccaaacaaagcaagcaggggacaatttcgcgtacctaacagcctatcaggctacggtgtgcgccagagccaaagcccctcccccgtcctgggacgtcatgtggaagtgcttgactcgactcaagcccacgctcgtgggccccacgcctctcctataccgcttaggcactgttaccaatgagatcaccctcacacatcctgtgacgaaatacatcgccacttgcatgcaagccgaccttgagatcatgaccagcacgtgggtcttggctgggggagtcttggcggctgtcgctgcgtactgcctggcaaccgggtgtgtttccatcatcggccgcttgcacatcaatcagcgagctgtcgtcgcaccggacaaggaggtcctctatgaggctttcgatgagatggaggaatgcgcctctagagcggctctcattgaggaggggcagcggatagccgaaatgttgaagtccaagatccagggcttattgcagcaagcttctaaacaggcccaggacatgcaacccaccgtgcaggcctcatggcccaaggtggagcaattctgggccaaacacatgtggaacttcatcagtggcattcaatacctcgctggactgtcaacattgccggggaatcctgctgtggcctctatgatggcattcagtgccgccctcactagtccgttgtcaactagtaccactatccttctcaacattctgggaggctggctggcgtcccaaattgcgccacccgcgggggccaccggcttcgtcgtcagcggcctggtgggggctgccgtgggcagcataggcttgggtaaggtgctggtggacatcctggcggggtatggtgcgggcatttcgggggctctcgtggcattcaagatcatgtctggcgagaagccctccatggaggatgtcgtcaatctgctgcctggaattctgtctccgggtgctctggtggttggagtcatttgcgcggccatcctgcgccgccacgtgggaccgggggaaggtgctgtccaatggatgaataggctcattgcctttgcttccagaggaaaccacgtcgcccccacccactacgtgacggagtcggacgcgtcgcagcgcgtgacccagctgctaggctcccttaccataactagcctgctcagaaggctccacaattggatcactgaggactgccccatcccatgcagcggctcatggctccgcgatgtgtgggactgggtttgcaccatcctaacagactttaaaaactggctgacctccaagttgttcccaaaaatgcccggcatcccctttatttcctgccaaaaggggtacaggggggtgtgggcaggcactggtatcatgaccacgcgatgtccttgcggcgccaacatctctggcaatgtccgcttgggctccatgaggatctgggggcctaaaacctgtatgaacacctggcaggggacctttcctatcaattgttacacggagggccagtgcgtgccgaaacccgcgccaaacttcaagaccgccatctggagggtggcggcctcggagtacgcggaggtgacacggcacgggatatactcctacataacaggactgaccaccgataacctgaaggttccttgccaaataccttctccagagttcttttcctgggtggacggagtgcaaatccataggtttgcccccacaccaaagccgtttctccgggatgaggtcacgttctgcgttgggcttaattcatttgtcgtcgggtctcagcttccttgtgatcctgaacccgacgtggatgtattggcgtccatgctaacggatccatcccatatcacggcagaaaccgcagcgcggcgtttggcgcgggggtcacccccatccgaggcaagctcctcagcaagccagctatcagcgccttcgctgcgagccacctgcaccacctatggcagggcccatgatgtggacatggtggatgcaaacctgttcatggggggcggtgaggtttggatagagtccgagtccaaggtggtcgtcctggactcactcgactcaatggccgaggaaaagagcgacctcgagccttccataccatcggaatacatgctccccaagaagaggtttccaccagccttaccggcctgggctcgccctgactacaacccaccgcttgtggaatcatggaagaggccagattaccagccgcccgttgttgcgggctgcgctctccccccccctaagaagaccccgacgcctcccccaaggagacgccggacagtgggtttgagtgagagcgttgtagcagaagccctccaacagctggccattaagtcctttggccagcctcccccaagcggcaattcaggcctttccacgggggcggacgccgccggttccggtggtcggacgccccctgatgagttggccctctcggaaacaggttctacctcctccatgccccccctcgagggggagcctggggatccagacctggagcctgagcgggtagagccacaacctcccccccagggggggggggtggcccccggctcggactcggggtcctggtctacctgttccgaggagggcgactccgtcgtgtgctgctccatgtcatactcctggacaggggctctgataactccttgtagccccgaagaggaaaagttgccggtcaaccccttgagcaactcgttgttgcgataccacaacaaggtgtacagtaccacatcaaagaccgcctcactgagggccaaaaaggtaacttttgataggatgcaagtgctcgacgctcattacgactcagtcttaaaggacatcaagctagcggcctccaaggtctccgcgaggctcctcaccctggaggaggcatgccagctaactccaccccattctgcaagatccaaatatgggtttggggctaaggaggtgcgcagcttgtccgggagggccgttaaccacatcaagtccgtgtggaaggacctcctggaagactcacaaacaccaattcccacaaccatcatggccaaaaatgaagtgttctgcgtggaccccaccaaggggggtaagaaagcagctcgcctcatcgtttaccctgacctcggcgtcagggtctgcgagaagatggccctttatgatgtcacacaaaagcttcctcaggcggtgatgggggcttcttatggattccagtactcccccgctcagcgggtggagtttctcttgaaggcatgggcggataagagagaccctatgggtttttcgtatgatacccgatgctttgactcaaccgtcactgagagagacattaggactgaggagtccatataccgggcctgctccctgcccgaggaggcccacactgccatacactcgctaactgagagactttacgtgggagggcccatgttcaacagcaagggccaggcctgcgggtaccggcgttgtcgcgccagcggggtgctcaccaccagcatgggaaacaccatcacatgctacgtgaaagccctagcggcctgtaaggccgccgggttagttgcacccacgatgctggtatgcggcgacgacctggttgtcatctcggaaagccagggggttgaggaggacgagcggaacctgagagccttcgcgcaggctatgaccaggtactccgcccctcctggtgaccctcccagaccggaatacgacctggagctaataacatcttgttcctcaaatgtgtccgtggcgatgaaccctcaaggccgccgcaaatattacctgaccagagaccctaccactccaatcgcccgggctgcctgggaaacagttagacactcccctgtcaattcatggctgggaaatatcatccagtacgctccaaccatatgggctcgcatggtcctgatgacacacttcttctccatcctcatggcccaagacactctggaccagaacctcaattttgagatgtacggagcggtgtactccgtgagtcccttggacctcccagccataattgaaaggctacacgggcttgacgctttctctctgcacacatactctccccacgaactgacgcgggtggcagcagccctcagaaaacttggggcgccacccctcagagcgtggaagagtcgggcgcgtgcagttagggcgtccctcatctcccgtggagggagagcggccatttgcggtcgatatctcttcaactgggcggtgaagaccaagctcaaactcactccattgccggaagcgcgcctcctggatttatccagctggttcactgtcggcgccggcgggggcgacatttatcacagcgtgccgcgtgcccgaccccgcttattactccttggcctactcctactttttgtaggggtaggccttttcctactccccgctcggtagagcggcacacattagctacactccatagctaactgtccctttttttttgttttttttttttttttttttttttttttttcttttttttttttttttttgtttcttttccttctcatttccttcttatcttaattacttcctttcctggtggctccatcttagccctagtcacggctagctgtgaaaggtccgtgagccgcatgactgcagagattgccgtaactggtatctctgcagatcatgt

SEQ ID NO: 752 - DNA, 9355 bp, Hepatitis C Virus
gtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccctgcatcatgagcacacttccaaaaccccaaagaaaaaccaaaagaaacaccaaccgtcgcccaatggacgtcaagttcccgggtggcggtcagatcgttggcggagtttacttgttgccgcgcaggggcccccggttgggtgtgcgcgcgacgagaaagacttccgagcgatcccagcccagaggcaggcgccaacctataccaaaggcgcgccagcctcagggcaggcactgggctcagcccggatacccttggcctctttatggaaacgagggttgcgggtgggcaggttggctcctgtccccccgcggctcccggccacattggggccctaatgacccccggcgtcgatcccggaatttgggtaaggttatcgataccctaacgtgtgggttcgccgatctcatggggtacattcccgtcgtgggcgcgcccttgggcggcgtcgcggctgcgctcgcgcatggtgtgagggcaatcgaggacgggatcaattatgcaacaggaaatcttcccggttgctctttctctatcttccttttggcactactctcgtgcctcacaacgccagcttcggctcttacctacggcaactccagtgggctataccatcttacaaatgattgccctaactccagcatcgtgctggaggcggatgctatgatcttgcatttgcctggatgcttgccatgtgtaaaggtcggcaatcagtccacctgctggcatgctgtgtcccccaccctagccataccaaatgcttccacgcccgcaacgggattycgcaggcatgtggatcttctcgcgggcgccgcagtggtttgctcatccttgtacatcggggatctgtgcggctctctcttcttggcgggacaactattcaccttccagccccgccgtcattggaccgtgcaggaatgcaactgctccatttatacaggccacgttaccggccacaggatggcttgggacatgatgatgagctggtcgcccacaaccactctggtcctatctagcatcttgagggtacctgagatctgtgcgagtgtgatatttggtggccattgggggatactactagccgttgcctactttggtatggctggcaactggctaaaagttctggctgttctgttcttatttgcaggggttgaagcaaccaccaccgtcggccacggagtggcccgcactactgccggtattaccggccttttctcccccggtgccagccagaatctacaactcatcaagaacggtagcagctggcacataaacaggactgctttgaactgcaatgattccctccagacggggttcttagcgtcactcttctacgtccgcaaattcaactcctcgggctgcccagagcggatggctgtgtgtaagtccctcgcggactttcggcaggggtggggccaaatcacctacaaagtcaacatctcgggcccctctgacgaccgtccctactgttggcattacgctcctaggccatgtgacgtggtgccggccagcacggtgtgcggccctgtttactgcttcacgcccagccctgttgtgataggaaccactgacaggcggggcaaccccacatacacctggggggagaatgagacggatgtattcatgctggaaagccttcggccccctactggaggatggtttgggtgcacgtggatgaactctacgggctttaccaagacctgtggtgctccgccatgtcagataatcccaggagattacaatagctctgccaatgagcttttgtgccccaccgactgcttccgtaaacatccggaagctacataccagcggtgtggatcgggaccctgggtaacacctaggtgtctggtggattacccttacaggctgtggcactacccctgcactgtcaacttcaccgtgcataaagtcaggatgttcgtgggaggcattgagcaccggttcgacgccgcatgtaattggaccaggggcgagcggtgcgagctacatgacagagacaggattgaaatgagcccgctgcttttctcaacgacgcagctcgccatacttccctgttcattttccaccatgccggctttatcaactggcctcatccacctgcatcagaacatagtggacgtgcagtacctctacggagtctcctcgagcgtcacctcgtgggtagtgaagtgggagtacattgtcctgatgttcctggttctggcagatgctcggatttgtacgtgtctctggttgatgctgctcataagcaacgttgaagcagcagtggagaggcttgtcgtcctcaacgcggctagcgccgccggcactgccggctggtggtgggcggtgcttttcctgtgctgtgtttggtatgtgaaaggccgccttgtgcctgcgtgtacctacatggcactgggaatgtggccgttgctcctgacaatcttggccttgcctcaccgagcatacgccatggacaatgagcaagcggcatcccttggagctgttggtctattggctatcaccatcttcaccatcacccccacgtacaagaagttgttgacctgcttcatttggtggaatcagtatttcctcgcccgagctgaggccatggtgcacgagtgggtgcccgacctacgggttaggggtggtagggattccatcatcttacttacctgcttgttacatccacagctggggtttgaggtcactaagatcctactagctatcctggcccctctatacatcttgcagtacagtttgctcaaagtgccttactttgtgcgcgctcacatactcctgcgcgcttgcctgctcgttcgtaggctagcggggggtaggtacgtgcaggcgtgccttctgaggttgggcgcttggactggcacctttatctatgaccatctcgcccccctctctgactgggctagcgacggactgcgcgatctggcagttgcagtcgagccggtcattttctctcccatggagaagaaaatcatcacctggggtgcggacactgccgcgtgcggtgacatcttgagtggcctcccggtgtcagcgaggttggggaatttagtgctactggggcccgcggatgatatgcagcgcggaggttggaagcttttggctcccatcaccgcgtatgcgcagcaaacgaggggcctagtcggcaccattgtgaccagcctaaccgggcgtgacaaaaatgaggtcgagggggaggtacaggtggtctccacggctacccaatccttcctggcgacctccattaacggtgtcatgtggactgtttatcatggggccggttcaaagactctcgctggaccgaaagggccagtgtgtcaaatgtacaccaatgtggacaaggacctggtaggatggccatctcccccgggagcaaggtcgctcaccccatgtacttgtggctctagtgacctctatctggtcacgagggaggccgatgttatccccgcaaggcgcaggggtgacaatcgtgctgccctcctctctcctaggcccataagcaccttgaaaggctcctcggggggccccgtgatgtgtccctcggggcacgttgtgggactcttccgagctgccgtatgcacaaggggtgtagcaaaatccttagactttatcccagtggaaaacatggagacgactatgcgctctccctcattcacagacaactccacgccgcctgcggtgccccagacctatcaggtagggtacctgcacgcaccaacaggcagcggaaagagcacccgtgttccggcagcgtacgctagccagggctacaaggtgctggttttgaacccatcggtggcggcaacgcttagctttggctcttatatgaggcaagcttacggcgtggagccgaatgtccggaccggggtcaggactgtaaccacagggggagccatcacgtactccacatatgggaaattcttggccgatgggggatgttctggaggagcgtacgacatcatcatctgtgacgagtgccactccacagaccccacgacggtgttgggcattggcacggttctcgaccaggctgagactgccggggctcgtcttactgtgctcgcaacagcaacgccgccgggttctatcactgtcccccatcctaacataacagagacagccctcccgactacgggagaaataccattttatggaaaggccatcccccttgagtacatcaaagggggaagacatctcatattctgtcactcaaagaagaagtgcgatgagctggctgggaaactaaagtcactcggcttaaacgccgtcgcattctacagaggtgtcgatgtgtccgtcattcccacctcgggcgatgtcgttatctgcgcgacagacgcccttatgaccggctacacaggcgatttcgattccgtcatcgactgcaacgtggccgtgacacaggtggtggatttcagcttggacccaacattttccatagagactaccactgtccctcaagatgcggtatcacggagccaacgacgaggccgcacggggcggggtaaaccgggagtgtacagatttgtctcccaaggggagaggccttcgggtatgttcgacaccgtcgtcctgtgtgaggcttatgacacgggatgcgcgtggtacgaactaaccccctctgaaacaaccgtcaggttgagggcctatatgaacactcctggccttcccgtatgccaagaccacctggaattttgggaaggcgtgtttactggcttgactcacatagacgcccactttctgtctcagacgaagcaagggggtgagaacttcgcgtacctcgtagcataccaggctacagtgtgcgccagggccaaagcccccccgccttcttgggatacgatgtggaagtgtctcatcagactcaaacccacccttaccggccccactccactcttgtatcggctgggggctgtccaaaatgagataataacaacccatccaataaccaagtacatcatgacctgtatgtctgcagatctggaggttatcaccagcacatgggtcctcgtgggtggagtcctagccgcgctcgcagcctactgcttgtcagtgggctgcgtcgtcatctgtggcaggataactttgaccggcaagcctgctgttgtccctgatcgtgagatcttataccagcaatttgacgagatggaggagtgctctaggcacatcccctacctcgctgagggccagcagatcgccgaacagttcagacaaaaggtgttgggactcctccaagcgagcgctaagcaggcagaagaactgaagcccgctgtccattccgcatggcctaggatggaggagttttggaggaaacacatgtggaactttgtcagcggaattcagtacttggcgggcttatccactctgcccggcaacccagccgtggcatcattgatgtcatttacagcgtcgctgaccagtcctctgaggacttctcagaccctgctcctcaacatactcggtggctggatagccgctcaagtggcccccccccccgcgtctacagcttttgtcgtgagcggtctagcaggagccgcggttggaagcatccggctcgggagggtgttggttgatgtgctcgccggatacggagccggtgtgtcgggtgctctagtcgctttcaagatcatgagcggcgattgcccgaccacggaagacatggtcaatctgctacccgcgctgttgtcgccaggggctctcgtggtgggtgtcgtgtgtgctgccatcttaagacgccacgttggccccgctgagggtgccaaccagtggatgaacaggctaatagcctttgcatcaagaggcaaccacgtgtcaccaacgcactacgtgcctgagactgacgcgtcaaaaaatgtgactcagatactcacttctcttaccatcaccagcctactccgtagattacatcagtgggtcaatgaagatacggccaccccttgcgctacctcgtggttacgcgacgtgtgggactgggtgtgtacagtgttatctgattttaaagtatggctgcaagctaaacttttccctcgcctgccggggatccccttcctctcgtgccaaacgggatataggggagtctgggcaggggacggggtgtgccacaccacctgtacctgtggggccgtgatagctggacacgtcaaaaatggcaccatgaaaatcacagggcccaagacatgcagcaacacttggcacgggacttttccaatcaacgccaccactaccggccctagcaccccacgaccagcccccaactatcagcgcgctctctggcgggtatctgccgaggactacgttgaggtacggaggttgggcgactgccattacgtggtaggggtcactgctgaagggctgaagtgcccttgccaggtgcctgcgcctgaattcttcaccgaggtcgatggcgtgaggatacaccgttacgcgccaccttgcaagcccttgctcagggacgaagtgactttctctgtgggtctttcaaactatgccatagggtcgcagctcccttgcgagccagagcctgacgtgaccgtagtcacctcaatgctcacagaccccacgcacattaccgcagagacggcatcacggcggttgaagagggggtcccccccctccttagccagctcttcggccagccagctgtctgcaccgtccctcaaggctacttgcacaacctccaaagaccacccggacatggaactcattgaggccaacctcctctggaggcaggagatgggaggcaacatcactcgagtcgagtcagagaacaaagtcgtagtacttgactcctttgagcctctaaccgctgagtatgacgagagggaaatctcagtatcagctgagtgccataggccacccaggcacaaattccctccagctctcccaatatgggccaggcctgactacaatccacctctcctacaagcatggcaaatgcccggatacgagcctccagtcgtgtctgggtgtgccgtcgccccacctaaaccggcaccaattcccccgccgaggcggaagaggctggtgcacttggatgagtccacggtctcgcgcgccttggcgcagcttgccgacaaggtatttgtggagggtagtagtgatccaggacctagttcagactcgggactatcaataaccagtcctgatccacctgccccaacaacaccggacgacgcctgctcagaagcagagtcctatagctcaatgccccctcttgagggggaacctggtgaccctgacctaagttcaggctcttggtccactgtgagcgatcaggacgacgtcgtgtgttgttccatgtcctattcctggacgggggctctaataacaccatgtgctgcggaggaggagaagcttccaataaatcccctgagcaactccctcataagacaccataacatggtgtattccaccacatcacgcagcgccagcctccgccagaagaaggtcacatttgacagattgcaagtgttcgaccaacattatcaggatgtactaaaggagattaagcttcgagcgtccacggtgcaggcgaggctcctatccatagaggaagcctgcgacctcacaccatcgcactcagcccggtccaaatatgggtatggtgcacaggacgttagaagccatgctagcaaggccattaaccacatccgctccgtgtgggaggacttgctagaagactctgataccccaattcccacgaccatcatggccaagaatgaagtcttctgcgtagatccgtcgaagggtggacgcaagccggcacgcctaatagtttacccagacttgggcgtgcgggtctgcgagaagatggccctatacgacgtaacgcggaagttaccacaggccgtgatgggttcagcatacggattccagtactcccctaaccagagggttgagtacttgctcaaaatgtggcggtcaaagaaggtgcccatgggcttttcttacgacaccaggtgttttgattcaaccgtcaccgagcgggatatccggactgagaacgacatctatcagtcttgccagctggatcccgtggcaaggagggcagtatcatccctaacagaacggctctacgtaggtggccccatggtaaactccaagggacagtcatgtggctaccgtagatgccgcgccagtggggtgctgcccacgagcatgggaaacaccctcacatgctatctgaaagcacaggccgcctgcagggcggccaacatcaaggactgtgacatgttggtgtgcggagatgacctagtggtcatttgtgagagcgctggcgtccaggaggacactgcgtcactgcgagcattcacggatgctatgaccaggtactcagctccccctggagacgtcccgcagcccacgtatgaccttgagctcataacatcgtgctcatccaacgtctccgtcgcccacgacggtaatgggaagagatattactacctcacacgtgactgtaccactccacttgcgcgggccgcttgggagacagcccgccacactccagtcaattcgtggttgggcaacatcattatgtttgcccccacgatatgggtgcgtatggttctgatgacccattttttctccatcctccagtcgcaagaacaattggagaaagcactcgactttgacatctacggagtgacctattctgtctctccacttgatctcccagcaatcattcaacgactccatggcatggcagcgttttcactccacggatactctccaactgagctcaacagggtaggggcttgcctcaggaaacttggggtacctcccttgcgagcatggagacatcgagccagagctgtcagagccaaactcattgcccaggggggaaaagcagctatatgcggtaagtacctctttaactgggcggtgaagaccaaactaaaactcactccattggtctccgcgagcaagcttgacttatcaggctggttcgtggcaggctacgacgggggggacatttatcacagcgtgtcccaggctcgaccccgtctcttactccttggcctactcctactcaccgtaggggtagggatctttttggtccccgctcggtag

SEQ ID NO: 753 - DNA, 9388 bp, Hepatitis C Virus
ggcgacactccaccatgaatcactcccctgtgaggaactactgtcttcacgcagaaagcgtctagccatggcgttagtatgagtgtcgtgcagcctccaggatcccccctcccgggagagccatagtggtctgcggaaccggtgagtacaccggaattgccaggacgaccgggtcctttcttggattaacccgctcaatgcctggagatttgggcgtgcccccgcgagactgctagcccagtaatgttgggtcgcgaaaggccttgtggtactgcctgatagggtgcttgcaagtgccccgggaggtctcgtagaccgtgcaccatgagcacacttccaaaaccccaaagaaaaaccaaaagaaacaccaaccgccgcccaatggacgttaagttcccgggtggcggccagatcgtcggtggagtctacttattgccgcgcaggggccctagattgggtgtgcgcgcgacgaggaagacctccgaacggtcccagcccagaggtaggcgccagcccataccaaaggcgcgccagtctcagggccggcactgggctcagcctggttacccttggcccctttatggcaacgagggctgtggatgggcaggatggctcctgtccccccgcggctctcgccctaattggggccccaacgacccccggcgaagatcccgcaacatgggtaaggtcatcgattccctaacctgtggcttcgccgacctcatggggtacattcccgttgtgggagcaccgcttggcggtgtcgcggctgctttagcacatggtgttagggcaatcgaagacgggatcaactatgcaaccggaaaccttcctggttgctccttttctatcttccttctggcacttctctcgtgcctcaccacgcccgcctcggcagtcaactataaaaacagctctggtatataccatcttaccaatgactgccctaattcgagtattgtctatgaggcggacagtgtcatcatgcacagccctggatgcgtcccgtgtgtaagatctggaaacgtgtctcggtgttgggtgccggtgacccccacccttgctgtggaaaatgtttccgtgtcgacgagaggcttccgcgctcacgtggatcttctcgtcggttcggcagctttatgctcagcactttacatcggagacctctgcggtggcgtgtttctggtgggacaactcttcacgtttcggccccgacaatataatactgtccaagagtgcaactgctctatttacagcggacacatcacaggccataggatggcgtgggacatgatgatgaactggtccccgaccctgacctatgtcacctcttcgctgctgaggataccgcagttgctcctcgagatattccttgaggggcactggggtgtcatcggtgccatattgtattacagtatggttgcgaactgggctaaagtcctcgctgtcttggtccttttcgctggggtcgacggaactaccttcgttggccgcagtgtgggtgcgcagacgcggggcatcgtcagcatcttcactccgggggccagacagaacatccagttgattaattccaacggcagctggcacgtcaacaggacagcacttagctgcaatgactcactccaaaccggcttcattgctggtttgttttacacccatcgcttcaactcttcgggttgccctgaacggttgagtaggtgtcggccgctaagtgcatttgaccaaggttggggccctctgacatacgcgtccatgaaagggtcgtctgaggacaggccctactgctggcactacgcgcccagaccttgtgacattgtccctgcacgggacgtctgyggcccggtgtactgtttcacccccagccctgtagtagttggtactactgatcgcaaaggccttcccacgtacaactggggagcaaacgcctcagatgtgttcctgctgcaggggaccaggcccccccaagggccgtggtttggctgcacctggatgaatgctacagggtttgtcaagacatgcggcgcaccaccatgcattacccgtcctacgaggggcaacaacaccttgacatgcccctccgattgcttccgtaaacatccagaagcaacttacgggaagtgcgggtcagggccgtggctcactcccaggtgcttagtggactatccctatagattgtggcactacccatgcaccgtgaatttcaccatccacaaggtgcggatgtatgtagccggcgtcgagcatcggttcgacgctgcgtgcaactggacccgtggagaacggtgcgagttagatgatagggatagggttgagatgagccctctgctacactcaacgacagagttggccgtcttgccttgctcttttacaactatgcccgcgctgtcaactgggctaatccaccttcaccagaacgttgtagacgtgcagtatctctatggagtctcctcgacagtcgtgtcgtgggctgtgaagtgggaatacgtcgtcttggcgtttctggtcctagctgatgcacgggtttgtgcctgtttgtggttaatgttcctggttggccaagcagaggcagcgttggagaacctcatcatccttaatgctgcctctgctgctagtaaccaaggctgggtctgtgggatagctttcatctgtgccgcctggtacattcgcggcaagtgtgcccctatcactctctatgctattctgcggatgtggcccttgctcctgctagtattggctctgcctcgtagggcatatgctggcaacggagaggaggccgcatcttttgggctactggtgattgccgtggtcaccatcttcaccctcaccccggcatacaaaccacttctcataagcacgctctggtggattcagtatttcattgcacgggcagaggccatcttgcatgtatgggtgcccccattgcaggttcgaggaggacgtgatgcggtgatactgctcacctgcctactacacccacagttggggtttgaggttactaagatcattttagctctcatgggccccatctacattttgcagtacagcctgctcaagacgccgtacttcgtgcgagcgcacatccttttgcgcgcttgcttgtttgtgcgcggtgtggtaggcgggaagtacgcccaagctgcgcttttgcggctaggcgtgtggacgggcacctacatctatgaccatctgtctccactgtctgattgggcgtgtgatggcctacgagatctggctgtcgccgtcgaacctgtcatcttctctcctatggagaagaaagtcatcacttggggcgctgatacagtcgcgtgcggtgacataatcgctggactcccggtttcagctaggaaaggcaacctcatcttccttggccctgctgatgatattcggggcggaggctggcgcctccttgccccgatcacggcatatgcccagcagaccagaggcctagtaggcacaatcgtcactagccttaccggccgcgacaaaaacgaggtggaaggtgaaatccaggttgtgtctacggccacgcagtccttccttgctaccactgtcaacggggtcctctggaccgtataccatggtgctgggtcaaagacattggccggcccgaaagggcccatttgccaaatgtacaccaacgtcgaccaagacctggtaggctggcctgctccacctggggctcgttcgcttactccgtgcacctgcggtacaagtgacctttacctagtgacgaggaatgctgacgtcatcccagccagacgcaggggtgacactcgcgcagcactcctcagcccaaggcctcttagtactttgaagggatcgtcaggcgggcccatgctgtgcccctcgggccatgtagcggggatcttccgcgctgctgtgtgtactaggggtgtggctaagtcccttgactttgttcccgtggagagcatgcagaccaccgcacgctctccttctttctcagacaatacaaccccacctgcagtcccacaaacataccaggtggggtatcttcatgcccctacaggtagtggtaagagcaccaaggtcccagccgcgtacgctgctcagggttacaaagttttggtgctcaatccctccgtggcggccaccctcgggtttggggcatacatgtctaccgcccatggtatagaccccaatatccgcactggggtaagaactatcactacgggcggggcaatcacatactctacttatggcaaattcctcgctgatgggggctgctctggcggcgcctacgacatcatcatttgcgacgaatgccattcaacagaccctactactgtcctgggtatagggaccgtcctggaccaagcggagtcggctggagttagactcaccgtgcttgcgacagccactccccccgggtctgtcacagtccctcacccaaacatcactgagactgctttgccgagcacaggtgaggtgcctttctacggaaaggcgatccccctcgaatacatcagagggggtaggcacctgatcttctgtcattccaagaagaaatgcgatgagctagccaggcaacttacatctcttgggctcaatgcagtagcattctacaggggcgtcgacgtggcggtcatcccgacctcaggtgacgtcgttgtgtgtgctaccgatgccctcatgactggttatacaggagattttgactcagtgattgactgtaacgtttcagttacccaggtagtagacttcagcttggaccctacattcaccatagagaccaccactgtgccccaagacgccgtatcacggagtcagaggagaggtaggacagggagggggaaacacggggagtataggtatgtctcgcagggagaacggccgtcaggtatctttgactccgtcgtcctgtgcgaggcgtacgacacaggttgcgcatggtacgagctgactccatccgaaacaaccgtacgactacgcgcctatttgaatacaccaggactccccgtctgtcaagaccacctggaattttgggagggcgtatttacggggttgacccatattgacgcccactttctctcgcagacaaagcagtcgggagaaaactttgcgtatcttgtcgcctaccaagcgactgtttgcgcaagggccaaagccccccctccttcttgggacactatgtggaaatgccttattcgcctcaagcctatgcttacagggcctacccccttgctgtataggcttggcgctgtgcagaatgagatcaccacaactcacccggtcacgaagtacatcatgacttgtatgtcagcagacttggaagtcataaccagcacctgggtcatagtgggaggcgtcctcgcggcgctagctgcctactgtttgtctgtgggttgcgtagtgatctgcggtaggattaccaccactggcaagccagyaatcatccctgatcgagaggtgctctaccagcagtttgacgagatggaggagtgttctagacacattccttaccttgtcgaaggccagcatcttgcagagcagttcaaacaaaaggttctcggccttatccaaactactaccaagcaagccgaagagcttaagcctgctgtccattctgcttggcccaaactcgaacagttctggcagaagcacttgtggaactttgtgagtggtatacaatacctggccggcctgtccaccttgccgggcaacccggcggtcgcctcactgatgtccttctcagcttccttgaccagcccgatgtcgacctctacaaccctcctgctcaacatcctggggggctgggtcgcttcccaactcgcaaaccccacagcgtctactgcatttgtagtgagcggtctggcgggggctgctgttggcagcatcggcttgggaagggtgctggtggacgttatcgctggctacggtgcgggcgtgtccggggcactcgtcgcttttaagatcatgagcggtgagaccccctcagccgaggacatggtcaacctgctcccggcactgttatcccctggggcattggtagtgggtgttgtgtgcgcggccatcctaaggcgccacgcgggacccgcagagggagctacgcaatggatgaaccggttgatagcttttgcctccaggggtaaccatgtatcgcccacgcactatgtgccagagacagacacctctagacaaatcatgaccatactcagttcccttaccgtgaccagcctactccggaaattgcatgagtggatcaacagcgattggtctactccttgcagcgggtcatggctacgggagatctgggactgggtgtgcactgtactctctgacttcaagacctggctcagaacaaagctcgtgccggcactgccaggtttgcctttcctctcatgtcaacgggggttccgcggcgtgtggaggggtgacggcatttgtcacactacatgtccatgtggtgctgacatagtcggccacgttaagaatggatccatgaggatctccggtccgcggtggtgcagtaacatctggcatggcacgttccctatcaatgctacgacgactggtccaagcgtgcctatccctgagcccaactataagagggccctgtggagggtgtccgcagaggagtacgtcgaggtagtgaggatgggtgatagccacttcgtggtgggcgctacaaaccaagacctgaagtgcccatgccaggtgccggcgccagaattcttcactgaagtggatggcgtgcgactacatcgatatgcgcctccctgcaaaccccttttaagggatgagatctccttttccgtagggctcaactcctacgcgatcgggtctcaattgccatgtgaaccggagccggacgtgacagtggtgacatcaatgctggtcgacccatctcatatcactgcagagactgccgcccgtcgacttggacgtgggtccccaccctcccttgccagctcatcagcaagtcagctctcagccccatcactgaaagcaacatgcaccacgcatggggtgcatgccgatgcggatctgatagaagcaaacttgttgtggaggcaagaagtggggggcaacatcacccgcgtggagtctgagaataaggtcatcgttctcgactcattcgacccgctggtacctgaatatgatgacagagagccatctgtgcccgcggagtgccacaggccacctaggccgaagttcccaccagcgctcccgatttgggcaagacctgactacaatccgcccctccttgagacttggaagaaaccagactataccccaccgctggttcacgggtgcgccctgccccccgcagggcagcctccagtcccaccgcccaggaggaagaaagtggtgcacttggacgactccagcgtggcggaagctctggcagaactagctaagaagtctttcccgacacaaccgagcccttccactgactcggactcaggtcatcctactactagcaagggctcagacccagatgttgagaaggccgatgccggctctgacgcggggtcctacagctctatgccgccacttgagggtgagccgggtgatccggaccttgattcgggctcctggtctacggtcagtgaagaaagcgacagtgtcgtatgttgttccatgtcatacaattggacaggggcactaatcacaccttgtgcagccgaggaggagaaattgcccataaacccattgagcaattccctcattcgacaccacaatctggtgtactccacaacatcccggagtgctgcacagcggcagaagaaggtcaccttcgaccgcgtgcaggtgttagaccaacactacaaagatgtagtgaaggaggttaaggcccgggcctcagaggtaacggctaagctcctctcagttgaggaggcatgtgcccttacccctccacactctgctcgttcgaagttcgggtatggagcgaaagatgtccggagtcatgctagcaaggccatcaaccatatcaactccgtatggaaggacttgctagaagacaaccaatcaccaattcccacaaccatcatggcaaagaatgaggtgttctgcgtggacgcttctaagggagggcgcaagccggctcgtctcgtcgtatacccggacctatcggtgcgggtgtgcgaaaagagggctttgtttgacgtcacccgcaagttgccagtcgctatcatgggagacgcttatggcttccaatactcacccaaacagcgggtggaccgtctgctcaaggtgtggcgctccaagaagacccctatggggttttcctatgacaccaggtgctttgactctacagtcactgagcatgacataaaaactgagcaggatgtctatctytcctgtaagctggacccggaggccgaaaytgctatacgctccctcactgagcggctttacctaggaggccccatgtacaactcccggggccaattctgtgggacycgcaggtgccgcgcaagcggggtgcttaccactagcttaggyaacaccatgacctgctacataaaggctytagcggcctgccgagcagcaggcctcaccaaatatgacatgttggtctgcggagatgacttggtggtcattgctgagagcgctggagtccaggaggatgcctctagcctgcgagctttcacggaagccatgaccaggtattcagctcctcctggagatgtaccacagccagcatatgacttagagcttataacatcttgctcatccaatgtctccgtggcccacgaccacactggacagagatattactacctcacaagagaccctaccacaccactctctcgggctgcatgggagacagctcgacacactccagtgaattcctggttagggaatataattatgtatgctcctacgatctgggtacgtatggtgttgatgacccatttcttccagatactccaagcgcaggagcaattggatagggtacttgacttcgacatatacggagtcacatactcaattaatccactccaactcccagccattattcaaagactccatggcatggccgcgttttcactccatgggtactctccaggtgagctcaatcgggtggcatcatgcctcagaaaacttggggctcccccattgagggcctggagacatcgagcccgcgcggtccgagcgaagcttatcgcccagggagggaacgcagcgatttgcggcaagtacctctttaattgggcggtaaggactaagctcaaactcactccattgcctggcgcagccaacctcgacttgacggggtggttcgtggctggcttcagcgggggggacatttatcacagcgtgtcccgggctcgaccccgcatgttcctctggtgcctactcctactttccgtaggggtaggcatcttttcactacgcgctcggtagacgggtagcttaacac

SEQ ID NO: 754 - DNA, 9589 bp, Hepatitis C Virus
acccgcccctaataggggcgacactccgccatgaaccactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggtcatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaggatcggcgctccactggcaaatcctggggaaaaccaggatacccctggcccctatacgggaatgagggactcggctgggcaggatggctcctgtccccccgaggttcccgtccctcttggggccccaatgacccccggcataggtcccgcaacgtgggtaaggtcatcgataccctaacgtgcggctttgccgacctcatggggtacatccctgtcgtaggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgaccaacgactgcaccaatgatagcattacctggcaactccaggctgctgtcctccacgtccccgggtgcgtcccgtgcgagaaagtggggaatacatctcggtgctggataccggtctcaccgaatgtggccgtgcagcagcccggcgccctcacgcagggcttacggacgcacattgacatggttgtgatgtccgccacgctctgctccgctctttacgtgggggacctctgcggtggggtgatgcttgcagcccagatgttcattgtctcgccacagcaccactggtttgtgcaagactgcaattgctccatctaccctggtaccatcactggacaccgcatggcgtgggacatgatgatgaactggtcgcccacggctaccatgatcctggcgtacgcgatgcgcgtccccgaggtcatcatagacatcattggcggggctcattggggcgtcatgttcggcttagcctacttctctatgcagggagcgtgggcaaaagtcgttgtcattcttttgctggccgccggggtggacgcgcaaacccataccgttgggggttctaccgcgcataacgccaggaccctcaccggcatgttctcccttggtgccaggcagaaaatccagctcatcaacaccaatggcagttggcacatcaaccgcaccgccctgaactgcaatgactctttgcacaccggcttcctcgcgtcactgttctacacccacagcttcaactcgtcaggatgtcccgaacgcatgtccgcctgccgcagtatcgaggcctttcgggtgggatggggcgccttacaatatgaggacaatgtcaccaatccagaggatatgagaccgtattgctggcactacccaccaagacagtgtggtgtagtctccgcgagctctgtgtgtggcccagtgtactgtttcacccccagcccagtagtagtgggtacgaccgatagacttggagcgcccacttacacgtggggggagaatgagacagatgtcttcctattgaacagcactcgaccaccgcaggggtcatggttcggctgcacgtggatgaactccactggctacaccaagacttgcggcgcaccaccctgccgcattagagctgacttcaatgccagcatggacttgttgtgccccacggactgttttaggaagcatcctgataccacctacatcaaatgtggctctgggccctggctcacgccaaggtgcctgatcgactacccctacaggctctggcattacccctgcacagttaactataccatcttcaaaataaggatgtatgtggggggggtcgagcacaggctcacggctgcgtgcaatttcactcgtggggatcgttgcaacttggaggacagagacagaagtcaactgtctcctttgctgcactccaccacggagtgggccattttaccttgcacttactcggacctgcccgccttgtcgactggtcttctccacctccaccaaaacatcgtggacgtgcaattcatgtatggcctatcacctgctctcacaaaatacatcgtccgatgggagtgggtagtactcttattcctgctcttagcggacgccagggtttgcgcctgcttatggatgctcatcttgttgggccaggccgaagcagcactagagaagttggtcgtcttgcacgctgcgagcgcagctagctgcaatggcttcctatactttgtcatctttttcgtggctgcttggtacatcaagggtcgggtagtccccttggctacttattccctcactggcctatggtcctttggcctactgctcctagcattgccccaacaggcttatgcttatgacgcatctgtacatggtcagataggagcagctctgttggtactgatcactctctttacactcacccccgggtataagacccttctcagccggtttctgtggtggttgtgctatcttctgaccctggcggaagctatggtccaggagtgggcaccacctatgcaggtgcgcggtggccgtgatgggatcatatgggccgtcgccatattctgcccgggtgtggtgtttgacataaccaagtggctcttggcggtgcttgggcctgcttatctcctaaaaggtgctttgacgcgtgtgccgtacttcgtcagggctcacgctctactaaggatgtgcaccatggtaaggcatctcgcggggggtaggtacgtccagatggtgctactagcccttggcaggtggactggcacttacatctatgaccacctcacccctatgtcggattgggctgctaatggcctgcgggacttggcggtcgccgtggagcctatcatcttcagtccgatggagaaaaaagtcatcgtctggggagcggagacagctgcttgcggggatatcttacacggacttcccgtgtccgcccgacttggccgggaggtcctccttggcccagctgatggctatacctccaaggggtggagtcttctcgcccccatcactgcttatgcccagcagacacgcggccttttgggcaccatagtggtgagcatgacggggcgcgacaagacagaacaggccggggagattcaggtcctgtccacggtcactcagtccttcctcggaacaaccatctcgggggtcttatggactgtctaccatggagctggcaacaagactctagccggctcacggggtccggtcacacagatgtactccagtgctgagggggacttagtggggtggcccagcccccccgggaccaaatctttggagccgtgcacgtgtggagcggtcgacctatacctggtcacgcgaaacgctgatgtcatcccggctcgaagacgcggggacaagcgaggagcgctactctccccgagacctctttccaccttgaaggggtcctcggggggcccggtgctctgccccagaggccacgctgtcggggtcttccgggcagccgtgtgctcccggggcgtggccaagtccatagattttatccccgttgagacacttgacatcgtcactcggtcccccacctttagtgacaacagcacaccacctgctgtgccccaaacttatcaggtcgggtacttacatgccccgactggtagtggaaagagcaccaaagtccctgtcgcgtatgccgctcaggggtacaaagtgctagtgcttaatccctcggtggctgccaccctggggtttggggcgtacttgtccaaggcacatggcatcaatcccaacattaggactggggtcaggactgtgacgaccggggcgcccatcacgtactccacatatggcaaattcctcgccgatgggggctgcgcaggcggcgcctatgacatcatcatatgcgatgaatgccatgccgtggactctaccaccattctcggcatcggaacagtcctcgatcaagcagagacagccggggtcaggctaactgtactggctacggctacgccccccgggtcagtgacaaccccccaccccaacatagaggaggtggccctcgggcaggagggtgagatccccttctatgggagggcgattcccctgtcatacatcaagggaggaagacacttgatcttctgccactcaaagaaaaagtgtgacgagctcgcggcggcccttcggggtatgggcttgaacgcagtggcatactacagagggctggacgtctccgtaataccaactcagggagacgtagtggtcgtcgccaccgacgccctcatgacggggtttactggagactttgactccgtgatcgactgcaacgtagcggtcactcaagttgtagacttcagcttggaccccacattcaccataaccacacagactgtccctcaagacgctgtctcacgtagccagcgccggggccgcacgggcaggggaagactgggtatttataggtatgtttccactggtgagcgagcctcaggaatgtttgacagtgtagtgctctgcgagtgctacgatgcaggggccgcatggtatgagctcacaccagcggagaccaccgtcaggctcagagcatatttcaacacacctggtttgcctgtgtgccaagaccatcttgagttttgggaggcagttttcaccggcctcacacacatagatgcccacttcctttcccaaacaaagcaatcgggggaaaatttcgcatacttaacagcctaccaggctacagtgtgcgctagggccaaagccccccccccgtcctgggacgtcatgtggaagtgtttgactcgactcaagcccacactcgtgggccccacacctctcctgtaccgcttgggctctgttaccaacgaggtcaccctcacgcatcctgtgacgaaatacatcgccacctgcatgcaagccgaccttgaggtcatgaccagcacgtgggtcttagctgggggggtcttggcggccgtcgccgcgtactgcctggcgaccgggtgtgtttgcatcatcggccgcttgcacgttaaccagcgagccgtcgttgcaccggacaaggaggtcctctatgaggcttttgatgagatggaggaatgtgcctctagagcggctctcattgaagaggggcagcggatagccgagatgctgaagtccaagatccaaggcttattgcagcaagcttccaaacaagctcaagacatacaacccgctgtgcaggcttcttggcccaaggtagagcaattctgggccaaacacatgtggaacttcatcagcggcattcaatacctcgcaggactatcaacactgccagggaaccctgctgtagcttccatgatggcattcagtgccgccctcaccagtccgttgtcaactagcaccactatccttctcaacattttggggggctggctagcatcccaaattgcgcctcccgcgggggctaccggcttcgtcgtcagtggcctggtgggggctgccgtaggcagcataggcttgggtaaggtgctggtggacatcctggcagggtatggtgcgggcatttcgggggctctcgtcgcattcaagatcatgtctggcgagaagccctccatggaggatgttgtcaacctgctgcctggaattctgtctccgggtgccctggtggtgggagtcatctgcgcggccatcctgcgccgacacgtgggaccgggggaaggcgctgtccaatggatgaataggctcattgcctttgcttccagaggaaaccacgtcgcccccacccactacgtgacggagtcggatgcgtcgcagcgtgtgacccaactacttggctcccttaccataaccagcctgctcaggagactccacaactggattactgaagactgccccatcccatgcagcggctcgtggctccgcgatgtgtgggattgggtttgcaccatcctaacagactttaaaaactggctgacctccaaattgttcccaaagatgcctggtctcccctttatctcttgtcaaaaggggtacaagggcgtgtgggctggcactggtatcatgaccacacggtgtccttgcggcgccaatatctctggcaatgtccgcctgggctccatgagaattacggggcccaaaacctgcatgaatatctggcaggggacctttcccatcaattgttacacggagggccagtgcgtgccgaaacccgcaccaaactttaagatcgccatctggagggtggcggcctcagagtacgcggaggtgacgcagcacgggtcataccactacataacaggacttaccactgataacttgaaagttccttgccaactaccttctccagagttcttttcctgggtggacggagtgcagatccataggtttgcccccataccgaagccgttttttcgggatgaggtctcgttctgcgttgggcttaattcatttgtcgtcgggtctcagctcccttgcgatcctgaacctgacacagacgtattgacgtccatgctaacagacccatcccatatcacggcggagactgcagcgcggcgtttggcacgggggtcacccccgtccgaggcaagctcctcagcgagccagctatcggcaccatcgctgcgagccacctgcaccacccacggcaaggcctatgatgtggacatggtggatgccaacctgttcatggggggcgatgtgacccggatagagtctgagtccaaagtggtcgttctggactctctcgacccaatggtcgaagaaaggagcgaccttgagccttcgataccatcggaatatatgctccccaagaagagattcccaccagccttaccggcttgggcacggcctgattacaacccaccgcttgtggaatcgtggaagaggccagattaccaaccggccactgttgcgggctgcgctctccccccccctaagaaaaccccgacgcctcccccaaggagacgccggacagtgggtctgagtgagagctccatagcagatgccctacaacagctggccatcaagtcctttggccagccccccccaagcggcgattcaggcctttccacgggggcggacgcagccgattccggcagtcggacgccccccgatgagttggccctttcggagacaggttccatctcctccatgccccctctcgagggggagcctggagatccagacttggagcctgagcaggtagagcttcaacctcccccccaggggggggtggtaacccccggctcaggctcggggtcttggtctacttgctccgaggaggacgactccgtcgtgtgctgctccatgtcatactcctggaccggggctctaataactccttgtagccccgaagaggaaaagttgccaattaaccccttgagcaactccctgttgcgatatcacaacaaggtgtactgtaccacatcaaagagcgcctcattaagggctaaaaaggtaacttttgataggatgcaagcgctcgacgctcattatgactcagtcttgaaggacattaagctagcggcctccaaggtcaccgcaaggcttctcactttagaggaggcctgccagttaactccaccccactctgcaagatccaagtatgggtttggggctaaggaggtccgcagcttgtccgggagagccgttaaccacatcaagtccgtgtggaaggacctcctggaagacacacaaacaccaattcctacaaccatcatggccaaaaatgaggtgttctgcgtggaccccaccaaggggggtaagaaagcagctcgccttatcgtttaccctgacctcggcgtcagggtctgcgagaaaatggccctttatgatatcacacaaaagcttcctcaggcggtgatgggggcttcttatggattccagtactcccccgctcagcgggtggagtttctcttgaaggcatgggcggaaaagaaagaccctatgggtttttcgtatgatacccgatgctttgactcaaccgtcactgagagagacatcaggactgaggagtccatatatcgggcttgttccttgcccgaggaggcccacactgccatacactcactgactgagagactttacgtgggagggcccatgttcaacagcaagggccagacctgcgggtacaggcgttgccgcgccagcggggtgcttaccactagcatggggaacaccatcacatgctatgtgaaagccttagcggcctgtaaggctgcagggataattgcgcccacaatgctggtatgcggcgatgacttggttgtcatctcagagagccaggggaccgaggaggacgagcggaacctgagagccttcacggaggctatgaccaggtattctgcccctcctggtgacccccccagaccggaatatgacctggagctgataacatcttgctcctcaaatgtgtctgtggcgttgggcccacaaggccgccgcagatactacctgaccagagaccctaccactccaatcgcccgggctgcctgggaaacagttagacactcccctgtcaattcatggctaggaaacatcatccagtacgccccaaccatatgggctcgcatggtcctgatgacacacttcttctccattctcatggcccaagatactctggaccagaacctcaactttgagatgtacggagcggtgtactccgtgagtcccttggacctcccagccataattgaaaggttacacgggcttgacgctttctctctgcacacatacactccccacgaactgacacgggtggcttcagccctcagaaaacttggggcgccacccctcagagcgtggaagagccgggcacgtgcagtcagggcgtccctcatctcccgtggggggagagcggccgtttgcggccgatatctcttcaactgggcggtgaagaccaagctcaaactcactccattgccggaagcgcgcctcctggatttatccagctggttcactgtcggcgccggcgggggcgacatttatcacagcgtgtcgcgtgcccgaccccgcttattactccttggcctactcctactttttgtaggggtaggccttttcctactccccgctcggtagagcggcacacattagctacactccatagctaactgtccctttttttttttttttttttttttttttttttttttttttttttttttttttttttttttttttttttttttttttttttttttttttttttttttttttttttttttt

SEQ ID NO: 755 - DNA, 9502 bp, Hepatitis C Virus
gccagccccctgatgggggcgacactccaccatgaatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggataaacccgctcaatgcctggagatttgggcgcgcccccgcaagactgctagccgagtagtgttgggtcgcgaaaggccttgtggtactgcctgatagggtgcttgcgagtgccccgggaggtctcgtagaccgtgcaccatgagcacgattcccaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggtgcgtcggcccgagggcaggacctgggctcagcccgggtacccttggcccctctatggcaatgagggctgcgggtgggcgggatggctcctgtctccccgtggctctcggcctagttggggccccacggacccccggcgtaggtcgcgcaatttgggtaaggtcatcgataccctcacgtgcggcttcgccgacctcatggggtacataccgctcgtcggcgcccctcttggaggcgctgccagggccctggcgcatggcgtccgggttctggaagacggcgtgaactatgcaacagggaaccttcctggttgctctttctctatcttccttctggccctgctctcttgcctgactgtgcccgcttcagcctaccaagtgcgcaactccacagggctttatcatgtcaccaatgattgccctaactcgagtattgtgtacgaggcgcacgatgccatcctgcatactccggggtgtgtcccttgcgttcgcgagggcaacgtctcgaggtgttgggtggcgatgacccccacggtagccaccagggacggcaaactccccgcgacgcagcttcgacgtcacatcgatctgcttgtcgggagcgccaccctctgttcggccctctacgtgggggatctgtgcgggtccgtcttccttattggtcaactgtttaccttctctcccaggcgccactggacaacgcaaggctgcaattgttctatctaccccggccatataacgggtcatcgcatggcatgggatatgatgatgaactggtcccctacggcggcgttggtaatggctcagctgctccggatcccacaagccatcttggatatgatcgctggtgctcactggggagtcctggcgggcatagcgtatttctccatggtggggaactgggcgaaggtcctggtagtgctgttgctgtttgccggcgtcgacgcggaaaccatcgtctccgggggacaagccgcccgcgccatgtctggacttgttagtctcttcacaccaggcgctaagcagaacatccagctgatcaacaccaacggcagttggcacatcaatagcacggccttgaactgcaatgaaagccttaacaccggctggttagcagggcttatctatcaacacaaattcaactcttcgggctgtcccgagaggttggccagctgccgacgccttaccgattttgaccagggctggggccctatcagtcatgccaacggaagcggccccgaccaacgcccctattgttggcactaccccccaaaaccttgcggtatcgtgcccgcaaagagcgtatgtggcccggtatattgcttcactcccagccccgtggtggtgggaacgaccgacaggtcgggcgcgcctacctacaactggggtgcaaatgacacggacgtcttcgtcctcaacaacaccaggccaccgctgggcaattggttcggttgcacctggatgaactcaactggattcaccaaggtatgcggagcgcctccttgtgtgattggaggggggggcaacaacaccctgcactgccccactgattgtttccgcaagcatccggaagccacatactctcggtgcggctctggtccctggatcacacccagatgcctggtcgactatccatataggctttggcattacccttgtaccatcaactataccatttttaaagttaggatgtacgtgggaggggtcgagcacaggctggatgctgcctgcaactggacgcggggcgaacgttgcgatctggaagatagggacaggtccgagctcagcccgttgctgctgtccaccacgcagtggcaggtccttccgtgttcattcacgaccctgccagccttgtccaccggcctcatccacctccaccagaacattgtggacgtgcagtacctgtacggggtggggtcaagcatcgcgtcctgggccatcaagtgggagtacgtcgttctcctgttccttctgcttgcagacgcgcgcgtctgctcctgcttgtggatgatgctactcatatcccaggcggaggcggctttggagaacctcgtaatactcaatgcagcatccctggccgggacgcgaggtcttgtatccttcctcgtgttcttctgctttgcgtggtatctgaagggtaggtgggtgcccggagcggcctacgccctctacgggatgtggcccctgctcctgctcctgttagcgttgccccagcgggcatacgcgttggacacggaggtggccgcgtcgtgtggcggcgttgttcttgtcgggttaatggcgctgaccctgtcaccatattacaagcgctgtatcagctggtgcttatggtggcttcagtattttctgaccagagtagaagcgcaattgcacgtgtgggttccccccctcaacgttcgaggagggcgcgacgccgtcatcttactcatgtgtgttgtacacccgactctggtatttgacatcaccaaactactgctggccgtcctgggacccctttggattctccaagccagtttgcttaaagtaccctacttcgtgcgcgtccaaggccttctccggatctgcgcgctggcgcggaagatggtcggaggccattacgtgcaaatggctatcatcaagttaggggcgcttactggcacctatgtttataatcacctgactcctcttcgggactgggcgcacaacggcctgcgagacctggccgtggccgtagagccagtcgtcttctcccaaatggagaccaagctcatcacgtggggggcggacaccgccgcgtgcggtgacatcatcaacggcttgcccgtctccgcccgtaagggccgggagatactgctcggaccagccgatggaatggtctccaaagggtggaggttgctggcgcccattacggcgtacgcccagcagacaaggggcctcctagggtgtataatcaccagcctaactggccgggataaaaaccaagtggagggcgaggtccagattgtgtcaactgctgcccaaacttttctggcaacgtgcatcaatggggtatgctggactgtctaccacggggccggaacgaggaccatcgcatcacccaagggtcctgttatccagatgtataccaacgtagaccaagacctcgttggctggcccgctcctcaaggtgcccgctcattgacaccctgcacctgcggctcctcggacctttacttggtcacgaggcacgccgatgtcattcccgtgcgccggcggggtgatagcaggggcagcctgctgtcaccccggcccatttcctacttgaaaggctcctcggggggtccgctgttgtgccccgcgggacacgtcgtaggcatattcagggccgcggtgtgcacccgtggagtggctaaggcggtggactttatccctgtggagagcctagagacaaccatgaggtccccggtgtttacggacaactcctctccaccagcagtgccccagagcttccaggtggcccacctgcatgctcccacgggcagcggcaagagcaccaaggtcccggctgcatatgcagctcagggctataaggtgctagtgctcaacccctctgttgccgcaacactgggctttggtgcttacatgtccaaggcccacgggattgatcctaatatcaggaccggggtgagaacaattaccactggcagccccatcacgtactctacctacggcaagttccttgctgatggcgggtgctcggggggcgcttatgacataataatttgtgacgagtgccactccacggatgccacatccgtcttgggcatcggtaccgtccttgaccaggcagagaccgcgggggcgagactggttgtgctcgccaccgccacccctccgggctcgatcaccgtgccccatgccaacatcgaggaggtcgctctgtccaccaccggagagatcccattttacggcaaggccatccccctcgaagcaatcaagggggggagacatctcattttctgccactcaaaaaaaaagtgtgacgagctcgccgcgaagctggtcgcattgggcgtcaatgctgtggcctactaccgcggtcttgacgtgtctgtcatcccgaccagcggcgatgttgttgtcgtggcaactgatgctctcatgactggctataccggcgacttcgactcggtgatagactgcaacacgtgtgtcacccagacagtcgatttcagccttgaccctaccttcaccattgagacaaccacgcttccccaggatgctgtctcccgcactcagcgtcggggcaggactggcagggggaagccaggcatctacagatttgtggcaccgggggagcgtccttccggcatgttcgactcgtccatcctctgtgagtgctatgacacgggctgtgcttggtatgagctcacgcccgccgagactacagttaggctgcgagcgtacatgaacaccccggggcttcccgtgtgccaggaccatcttgaattttgggagggcgtctttacaggcctcacccatatagatgcccacttcctatcccagacaaagcagggtggggagaactttccttacctggtagcgtaccaagccaccgtgtgcgctagggctcaagcccctcccccatcgtgggaccagatgtggaagtgcttgatccgcctcaaacccaccctccatgggccaacacctctgctatacagactgggcgctgtccagggtgaagtcaccctgacgcacccagtcaccaaatacatcatgacatgcatgtcggccgacctggaggtcgtcacgagcacctgggtgctcgttggcggcgtcctggctgctctggccgcgtattgcctgtcgacaggctgcgtggtcatagtgggcaggattgtcttgtccgggaggccggcaatcataccagacagggaagttctctaccgggagttcgatgagatggaagagtgctctcagcacttaccgtatatcgaacaagggatgatgctcgccgagcagttcaagcagaaggccctcggcctcctgcagaccgcgtcccgccaggcagaggttatcgcccctactgtccaaaccaactggcaaaaactcgaggccttctgggcgaagcatatgtggaatttcatcagtgggatacaatatttggccggcctgtcaacgttgcctggcaaccccgccattgcttcattgatggcttttacagctgctgtcaccagcccactaaccactagccaaaccctcctcttcaacatattgggggggtgggtggctgctcagctcgccgcccccggtgccgccaccgcctttgtgggctccggcttggctggcgccgccgtcggcagtgtcggactggggagggtcctcgtggacattcttgcagggtatggcgcgggcgtggcgggggctcttgtagcatttaaaatcatgagcggtgagctcccctccacagaggacctggtcaatctactgcccgccatcctctcgcctggagcccttgtagtcggtgtggtctgtgcggcaatactgcgccggcacgtcggcccgggcgagggggcagtgcagtggatgaaccggctaatagccttcgcctcccgagggaaccatgtttcccccacgcactacgtgccggagagcgatgcagctgcccgcgtcactgccatactcagcagcctcactgtgacccagctcctgaggcgactacaccagtggctaagctcggagagcactactccatgctccggctcctggctaagggacatctgggactggatatgcgaggtgctgagcgactttaagacctggctaaaaaccaagctcatgccacatctgcctgggattccctttgtgtcctgccagcacgggtataagggggtctggcggggggacggcattatgcacactcgctgccactgtggagctgagatcactggacatgtcaaaaacggaacgatgaggatcgtcggtcctaagacctgtaggaacatgtggagtgggaccttccccattaacgcctacaccacgggcccctgtactccccttcctgcgccgaactacacgttcgcgctatggagggtgtctgcagaggaatacgtggagataaggcgggtgggggacttccactacgtgacaggcatgactactgataatctcaaatgcccgtgccaggtcccatcgcccgaatttttcacagaattggacggggtgcgcctacataggtttgcgcccccctgcaagcccttgctgcgggaggaggtatcattcagggtaggactccacgattacccggtggggtcgcaattaccttgcgagcccgaaccggacgtggccgtgttgacgtccatgctcactgatccctcccatataacagcagcggcggccgggagaaggttggcgaggggatcacccccttctgaggccagctcctcggctagccagctgtccgctccatctctcaaggcaacttgcaccatcaaccatgactcccctgacgccgagctcatagaagctaacctcctatggaggcaagagatgggcggcaacatcaccagggttgagtcagagaacaaagtggtgattctggactccttcgatccgcttgtggcggaggaggacgagcgggagatctccgtgcccgcagaaatcctgcggaagtctcggagattcacccaggccctgcctatttgggcgcggccggactataaccccccgctgatagagacgtggaaaaagcctaactatgaaccacctgtggtccatggctgtccgcttccacctccacagtcccctcctgtgcctccgcctcggaaaaagcggacggtggtcctcaccgaatcgaccctatccactgccttggccgagcttgccgctaaaagtttcggcagttcctcaacttccggcattacgggcgacaatacgacaacgtcctctgagcccgccccttctggctgttccccagactccgacgctgagtcctattcttccatgccccccctggagggggagcctggggatccggatctcagcgacgggtcatggtcgacggtcagtagtgaggccggcacggaagacgttgtgtgctgctcaatgtcttatacttggacaggcgcacttatcaccccgtgcgccgcggaagaacaaaaactgcccattaacgcactgagcaactcgttgctacgtcaccacaacctggtgtactccaccacctcacgcagtgcttgccaaaggcagaagaaagtcacatttgacagactgcaagttctggacagccactaccaggacgtgctcaaggaggttaaagcagcggcgtcaaaagtgaaggctaacttgctatccgtagaggaagcttgcagcctgacgcccccgcactcagccaaatccaagtttggctatggggcaaaagacgtccgttgccatgccagaaaggccgtaaaccacatcaactccgtgtggaaagaccttctggaagacagtgtaacaccaatacaaactaccatcatggctaagaacgaggttttttgcgttcagcctgagaaggggggtcgtaagccagctcgtctcatcgtgttccccgatctgggtgtgcgcgtgtgcgagaagatggccctgtacgacgtggttagcaagctccccccggccgtgatgggaagctcctacggattccaatactcaccaggacagcgggttgagttcctcgtgcaagcgtggaagtccaagaggaccccaatggggttctcgtatgatacccgctgctttgactccacagtcactgagagcgatatccgtacggaggaggcaatctaccaatgttgtgacctggacccccaagcccgcgtggccatcaggtccctcactgagaggctttatgttgggggccctcttaccaactcaaggggggagaactgcggctatcgcaggtgccgtgcgagcggcgtactgacaaccagctgtggtaacaccctcacttgctacatcaaggcccgggcagcctgtcgagccgcagggctccaggactgcaccatgctcgtgtgtggtgacgacttagtcgttatctgtgagagtgcgggggtccaggaggacgcggcgagcctgagagccttcacggaggctatgaccaggtactccgctccccccggggaccccccccaaccagaatacgacttggagctcataacatcgtgctcctctaacgtgtcagtcgcccacgatggcactggaaagagggtctattaccttacccgtgaccctacaactcccctcgcgagagccgcgtgggagacagcaaggcacactccagtcaattcctggctaggcaacataatcatgtttgctcctacattgtgggcgaggatgatactgatgacccacttcttcagtgtcctcatagccagggatcagcttgaacaggcccttgattgcgaaatctacggagcctgctactccatagaaccactggatctacctccaattattcaaagactccatggcctcagcgcgttttcactccacagttactctccaggtgaaatcaatagggtggccgcatgcctcagaaaacttggggttccgcccttgcgagcttggagacaccgggcccggagcgtccgcgctagacttctgtccagaggaggcagggctgccatatgtggcaagtacctcttcaactgggcagtaagaacaaagctcaaactcactccaatagcggccgctggccggctggacttgtccggctggttcacggctggctacagcgggggagacatttatcacagcgtgtctcatgcccggccccgctggttctggttctgcctactcctgcttgctgcaggggtaggcatctacctcctccccaaccgataaaggttggggtaaacactccggcctcttaggccattttctgtgttttttttttttttttttttttttttttttttttttttttttttttttttttttttttttttttttttttttttttttttttt

SEQ ID NO: 756 - DNA, 9460 bp, Hepatitis C Virus
gccagcccccgattgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatcccaaaggctcgccaacccgagggcagggcctgggctcagcccgggtacccttggcccctctatggcaatgagggcttggggtgggcaggatggctcctgtcaccccgcggctcccggcctagttggggccccacggacccccggcgtaggtcgcgtaacttgggtaaggtcatcgatacccttacatgcggcttcgccgatctcatggggtacattccgctcgtcggcgcccccctagggggcgctgccagggccttggcacacggtgtccgggttctggaggacggcgtgaactatgcaacagggaacttgcccggttgctctttctctatcttcctcttggctctgctgtcctgtttgaccatcccagcttccgcttatgaagtgcgcaacgtgtccgggatataccatgtcacgaacgactgctccaactcaagcattgtgtatgaggcagcggacgtgatcatgcatactcccgggtgcgtgccctgtgttcgggagggcaacagctcccgttgctgggtagcgctcactcccacgctcgcggccagagatgccagcgtccccactacgacaatacgacgccacgtcgacttgctcgttgggacggctgctttctgctccgctatgtacgtgggggatctctgcggatctattttcctcgtctcccagctgttcaccttctcgcctcgccggcatgagacagtgcaggactgcaactgctcaatctatcccggccatgtatcaggtcaccgcatggcttgggatatgatgatgaactggtcacctacaacagccctagtggtgtcgcagttgctccggatcccacaagctgtcgtggacatggtggcgggggcccactggggagtcctggcgggccttgcctactattccatggtagggaactgggctaaggttctgattgtggcgctactctttgccggcgttgacggggcgacctacacgtcggggggggtggccggccgcaccacctccgggttcacgtccctcttctcatctggggcgtctcagaaaatccagcttgtgaataccaacggcagctggcacatcaacaggactgccctaaattgcaatgactccctccacactgggttccttgccgcgctgttctacacacacaagttcaactcgtccgggtgcccggagcgcatggccagctgccgccccattgacgggttcgcccagggatggggccccatcacctatactgagcctaacagcccggatcagaggccttattgctggcattacgcgcctcgaccgtgtggtatcgtacccgcgtcgcaggtgtgtggtccagtgtattgtttcaccccaagccctgttgtggtggggaccaccgatcgttccggtgtccctacgtatagctggggggagaatgagacagacgtgatgctcctcaacaacacgcgtccgccacaaggcaactggttcggctgtacatggatgaatagtactgggttcactaagacgtgcggaggccccccgtgtaacatcgggggggtcggtaaccgcaccttgatctgccccacggactgcttccggaagcaccccgaggctacttacacaaaatgtggctcggggccctggttgacacctaggtgcctagtagactacccatacaggctctggcactacccctgcactctcaatttttccatctttaaggttaggatgtatgtggggggcgtggagcacaggctcaatgccgcatgcaattggactcgaggagagcgctgtaacttggaggacagggataggtcagaactcagcccgctgctgctgtctacaacagagtggcagatactgccctgtgccttcaccaccctaccggctttatccactggtttgatccatctccatcagaacatcgtggacgtgcaatacctgtacggtgtagggtcagcgtttgtctcctttgcaatcaaatgggagtacatcctgttgcttttccttctcctggcagacgcgcgcgtgtgtgcctgcttgtggatgatgctgctgatagcccaggctgaggccgccttagagaacttggtggtcctcaatgcggcgtccgtggccggagcgcatggtattctctcctttcttgtgttcttctgcgccgcctggtacattaagggcaggctggctcctggggcggcgtatgctttttatggcgtatggccgctgctcctgctcctactggcgttaccaccacgagcttacgccttggaccgggagatggctgcatcgtgcgggggtgcggttcttgtaggtctggtattcttgaccttgtcaccatactacaaagtgtttctcactaggctcatatggtggttacaatactttatcaccagagccgaggcgcacatgcaagtgtgggtcccccccctcaacgttcggggaggccgcgatgccatcatcctcctcacgtgtgcggttcatccagagttaatttttgacatcaccaaactcctgctcgccatactcggcccgctcatggtgctccaggctggcataacgagagtgccgtacttcgtgcgcgctcaagggctcattcgtgcatgcatgttagtgcggaaagtcgccgggggtcattatgtccaaatggccttcatgaagctgggcgcgctgacaggtacgtacgtttataaccatcttaccccactgcgggactgggcccacgcgggcctacgagaccttgcggtggcggtagagcccgtcgtcttctccgccatggagaccaaggtcatcacctggggagcagacaccgcagcatgtggagacatcatcttgggcctacccgtctccgcccgaagggggaaggagatatttttgggaccggctgatagtctcgaagggcaagggtggcgactccttgcgcccatcacggcctactcccaacaaacgcggggcgtacttggttgcatcatcactagcctcacaggccgggacaagaaccaggtcgagggggaggttcaagtggtttctaccgcaacacaatctttcctggcgacctgcatcaacggcgtgtgctggactgtctaccatggcgctggctcgaagaccctagccggtccaaaaggtccaatcacccaaatgtacaccaatgtagacctggacctcgtcggctggcaggcgccccccggggcgcgctccatgacaccatgcagctgtggcagctcggacctttacttggtcacgagacatgctgatgtcattccggtgcgccggcgaggcgacagcaggggaagtctactctcccccaggcccgtctcctacctgaagggctcctcgggtggtccattgctttgcccttcggggcacgtcgtgggcgtcttccgggctgctgtgtgcacccggggggtcgcgaaggcggtggacttcatacccgttgagtctatggaaactaccatgcggtctccggtcttcacagacaactcatcccccccggctgtaccgcagacattccaagtggcacatctgcacgctcctactggcagcggcaagagcactaaagtgccggctgcgtatgcagcccaagggtacaaggtgctcgtcctgaacccgtccgttgccgccaccttagggtttggggcgtatatgtccaaggcacacggtatcgaccctaacatcagaactggggtaaggaccattaccacgggcggctccattacgtactccacctatggcaagttccttgccgacggtggctgctccgggggcgcctatgacatcataatatgtgatgagtgccactcaactgactcgactaccatcttgggcatcggcacagtcctggaccaagcggagacggctggagcgcggcttgtcgtgctcgccaccgctacacctccgggatcggttaccgtgccacaccccaatatcgaggaaataggcctgtccaacaatggagagatccccttctatggcaaagccatccccattgaggccatcaagggggggaggcatctcattttctgccattccaagaagaaatgtgacgagctcgccgcaaagctgacaggcctcggactgaatgctgtagcatattaccggggccttgatgtgtccgtcataccgcctatcggagacgtcgttgtcgtggcaacagacgctctaatgacgggtttcaccggcgattttgactcagtgatcgactgcaacacatgtgtcacccagacagtcgacttcagcttggatcccaccttcaccattgagacgacgaccgtgccccaagacgcggtgtcgcgctcgcaacggcgaggtagaactggcaggggtaggagtggcatctacaggtttgtgactccaggagaacggccctcgggcatgttcgattcttcggtcctgtgtgagtgctatgacgcgggctgtgcttggtatgagctcacgcccgctgagacctcggttaggttgcgggcttacctaaatacaccagggttgcccgtctgccaggaccatctggagttctgggagagcgtcttcacaggcctcacccacatagatgcccacttcctgtcccagactaaacaggcaggagacaactttccttacctggtggcatatcaagctacagtatgcgccagggctcaagctccacctccatcgtgggaccaaatgtggaagtgtctcatacggctgaaacctacactgcacgggccaacacccctgctgtataggctaggagccgtccaaaatgaggtcatcctcacacaccccataactaaatacatcatggcatgcatgtcggctgacctggaggtcgtcactagcacctgggtgctggtaggcggagtccttgcagctttggccgcatattgcctgacgacaggcagtgtggtcattgtgggcaggatcatcttgtccgggaagccagctgtcgttcccgacagggaagtcctctaccaggagttcgatgagatggaagagtgtgcctcacaacttccttacatcgagcagggaatgcagctcgccgagcaatttaagcaaaaggcgctcgggttgttgcaaacggccaccaagcaagcggaggctgctgctcccgtggtggagtccaagtggcgagcccttgagaccttctgggcgaagcacatgtggaatttcatcagcgggatacagtacctagcaggcttatccactctgcctgggaaccccgcgatagcatcattgatggcatttacagcttctatcactagcccgctcaccacccaaaacaccctcctgtttaacatcttggggggatgggtggctgcccaactcgctcctcccagcgctgcgtcagctttcgtgggcgccggcatcgccggagcggctgttggcagcataggccttgggaaggtgctcgtggacatcttggcgggctatggggcaggggtagccggcgcactcgtggcctttaaggtcatgagcggcgaggtgccctccaccgaggacctggtcaacttactccctgccatcctctctcctggtgccctggtcgtcggggtcgtgtgcgcagcaatactgcgtcggcacgtgggcccgggagagggggctgtgcagtggatgaaccggctgatagcgttcgcttcgcggggtaaccacgtctcccccacgcactatgtgcctgagagcgacgctgcagcacgtgtcactcagatcctctctagccttaccatcactcaactgctgaagcggcttcaccagtggattaatgaggactgctctacgccatgctccggctcgtggctaagggatgtttgggattggatatgcacggtgttgactgacttcaagacctggctccagtccaagctcctgccgcggttaccgggagtccctttcctgtcatgccaacgcgggtacaagggagtctggcggggggacggcatcatgcaaaccacctgcccatgtggagcacagatcgccggacatgtcaaaaacggttccatgaggatcgtagggcctagaacctgcagcaacacgtggcacggaacgttccccatcaacgcatacaccacgggaccctgcacaccctccccggcgcccaactattccagggcgctatggcgggtggctgctgaggagtacgtggaggttacgcgtgtgggagatttccactacgtgacgggcatgaccactgacaacgtaaagtgcccatgccaggttccggcccccgaattcttcacggaggtggatggagtgcggttgcacaggtacgctccggcgtgcaaacctctcctacgggaggacgtcacgttccaggtcgggctcaaccaatacttggtcgggtcgcagctcccatgcgagcccgaaccggacgtaacagtgcttacttccatgctcaccgatccctcccacattacagcagagacggctaagcgtaggctggctagagggtcccccccctctttagccagctcatcagctagccagttgtctgcgccttctttgaaggcgacatgcactacccaccatgactccccggacgctgacctcatcgaggccaacctcttgtggcggcaggagatgggcggaaacatcactcgcgtggagtcagagaataaggtagtaattctggactctttcgaaccgcttcacgcggagggggatgagagggagatatccgtcgcggcggagatcctgcgaaaatccaggaagttcccctcagcgttgcccatatgggcacgcccggactacaatcctccactgctagagtcctggaaggacccggactacgtccctccggtggtacacggatgcccattgccacctaccaaggctcctccaataccacctccacggagaaagaggacggttgtcctgacagaatccaatgtgtcttctgccttggcggagctcgccactaagaccttcggtagctccggatcgtcggccgttgatagcggcacggcgaccgcccttcctgacctggcctccgacgacggtgacaaagggtccgacgttgagtcgtactcctccatgcccccccttgaaggggagccgggggaccccgatctcagcgacgggtcttggtctaccgtgagtgaggaggctagtgaggacgtcgtctgctgctcaatgtcctatacgtggacaggcgccctgatcacgccatgcgctgcggaggaaagtaagctgcccatcaacccgttgagcaactctttgctgcgtcaccacaacatggtctacgccacaacatcccgcagcgcaagcctccggcagaagaaggtcacctttgacagattgcaagtcctggatgaccattaccgggacgtgctcaaggagatgaaggcgaaggcgtccacagttaaggctaagcttctatctatagaggaggcctgcaagctgacgcccccacattcggccaaatccaaatttggctatggggcaaaggacgtccggaacctatccagcagggccgttaaccacatccgctccgtgtgggaggacttgctggaagacactgaaacaccaattgacaccaccatcatggcaaaaagtgaggttttctgcgtccaaccagagaagggaggccgcaagccagctcgccttatcgtattcccagacctgggagttcgtgtatgcgagaagatggccctttacgacgtggtctccacccttcctcaggccgtgatgggctcctcatacggatttcaatactcccccaagcagcgggtcgagttcctggtgaatacctggaaatcaaagaaatgccctatgggcttctcatatgacacccgctgttttgactcaacggtcactgagagtgacattcgtgttgaggagtcaatttaccaatgttgtgacttggcccccgaggccagacaggccataaggtcgctcacggagcggctttacatcgggggtcccctgactaactcaaaagggcagaactgcggttatcgccggtgccgcgcaagtggcgtgctgacgactagctgcggtaataccctcacatgttacttgaaggccactgcggcctgtcgagctgcaaagctccaggactgcacgatgctcgtgaacggagacgaccttgtcgttatctgtgaaagcgcgggaacccaggaggatgcggcggccctacgagccttcacggaggctatgactaggtactccgccccccccggggatccgccccaaccagaatacgacctggagctgataacatcatgttcctccaatgtgtcagtcgcgcacgatgcatctggcaaaagggtatactacctcacccgtgaccccaccaccccccttgcacgggctgcgtgggagacagctagacacactccaatcaactcttggctaggcaatatcatcatgtatgcgcccaccctatgggcaaggatgattctgatgactcactttttctccatccttctagctcaagagcaacttgaaaaagccctggattgtcagatctacggggcctgctactccattgagccacttgacctacctcagatcattgaacgactccatggtcttagcgcatttacactccacagttactctccaggtgagatcaatagggtggcttcatgcctcaggaaacttggggtaccacccttgcgaacctggagacatcgggccagaagtgtccgcgctaagctactgtcccagggggggagggccgccacttgtggcagatacctctttaactgggcagtaaggaccaagcttaaactcactccaatcccggctgcgtcccagctggacttgtccggctggttcgtcgctggttacagcgggggagacatatatcacagcctgtctcgtgcccgaccccgctggtttccgttgtgcctactcctactttttgtaggggtaggcatttacctgctccccaaccgatgaacggggagctaaccactccaggccaataggccatcctgtttttttttttttttttttttttttttttttttttttttttttttttt

SEQ ID NO: 757 - DNA, 9456 bp, Hepatitis C Virus
gccagcccccgattgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacactaaccgccgcccacaggacgtcaagttcccgggcggtggccagatcgttggtggagtttacctgttgccgcgcaggggccccaggttgggtgtgcgcgcgactaggaagacttccgagcggtcgcaacctcgtggaaggcgacaacctatccccaaggctcgccggcccgagggcagggcctgggctcagcccgggtacccttggcccctctatggcaatgagggcatggggtgggcaggatggctcctgtcaccccgcggctctcggcctagttggggccccaatgacccccggcgtaggtcgcgtaatttgggtaaggtcatcgataccctcacatgcggcttcgccgacctcatggggtacattccgctcgtcggcgcccccctagggggcgctgccagggccttggcacatggtgtccgggctctggaggacggcgtgaactatgcaacggggaatttgcccggttgctctttctctatcttcctcttggctctgctgtcctgtttgaccatcccagcttccgcttatgaagtgcgcaacgcgtccggggtataccatgtcacgaacgactgctccaactcaagtattgtgtatgaggcagcggacatgatcatgcataaccctgggtgcgtgccctgcgttcgggagaataactcctcccgctgctgggtagcgctcactcccactctcgcggccaggaacgccagcgtccccactacgacaatacgacgtcacgtcgacttgctcgttggggcggctgctctctgctccgctatgtacgtgggggatctctgcggatctgttttcctcgtctcccagctgttcaccttctcgcctcgccggcatgagacagtacaggactgcaattgttcaatctatcccggccacataacaggccatcgtatggcttgggatatgatgatgaactggtcacctacaacagccctagtggtctcgcagttactccggatcccacaagctgtcatggacatggtggcaggggcccactggggagtcctggcgggcctcgcctactattccatggtggggaactgggctaaggttttaattgtgttactactctttgccggcgttgacgggaacacctacgtgacggggggggcggctgcccgcggggcctccgggatcacgagcctcttttcacgtggtccgtctcagaaaatccagcttgtgaacaccaatggcagctggcacatcaacaggactgccctgaactgcaatgactccttcaacactgggttcctcgccgcgctgttctacgcgcacaggttcaactcgtccggatgcccagagcgcatggccagctgccgctccattgacaagttcgaccagggatggggtcccatcacttattatcagggtgacagcccggaccagaggccttattgctggcactacccacctcgaccgtgtggtatagtgcccgcgtcggaggtgtgtggtccagtgtattgtttcaccccaagccccgttgtggtggggacgaccgatcgcctcggcgtccctacatataactggggggaaaatgagacagacgtgctgctccttaacaacacgcggccgccgcaaggcaactggttcggctgtacgtggatgaataccactgggttcaccaagacgtgcgggggccccccgtgtaacatcgggggggccggcaacaacaccttgacttgccccacggactgcttccggaagcaccccgaggccacttacacaaaatgtggttcggggccttggttgacacctaggtgcttagttgactatccatacaggctctggcattacccctgcactgttaacttcaccatctttaaggttaggatgtatgtggggggcgtggagcacaggctcgacgccgcatgcaactggactcgaggagaacgttgcgccttggaggacagggatagatcagagctcagcccgctgctgctgtctacaacagagtggcagatactgccctgttccttcaccaccctaccggccctgtctactggtttgatccatctccaccggaacatcgtggacgtgcaatacctatacggtatagggtcagcagttgtctcctttgccatcaaatgggagtatgtcctgttgcttttccttctcctggcagacgcgcgcgtctgtgcctgcttgtggatgatgctgctgatagcccaggctgaggccgccttagagaacctggtggtcctcaatgcggcgtccgtggccggagtacatggcattctctccttccttgtgttcttttgtgccgcctggtacattaagggcaggctggtccctggggcggcatatgctttttatggtgtatggccgctgctcctgctcctgctggcgttgccaccacgggcttacgccatggctcgggagatggctgcatcgtgcggaggcgcggtttttgtaggtctggcactcttgaccttgtcaccatactataaggtgttcctcgctaggcttatatggtggttacaatattttatcaccagagccgaggcgcacttgcaagtgtggatcccccctctcaacgttcggggaggccgcgatgccatcatcctcctcacgtgtgcggcccacccagagctaatctttgatatcaccaaactcttgcttgccatattcggtccgatcatggtgctccaggctggcataactaaaatgccgtacttcgtacgcgctcaagggctcattcgtgcatgcatgttagtgcggaaagtcgctgggggtcattatgtccaaatggccttcatgaagcttgccgcgctgacaggtacgtacgtttatgaccatcttaccccactgcgggattgggcccacacgggcctgcgggaccttgcggtggcagtcgagcccgtcgtcttctcggacatggagaccaagatcatcacctggggggcagacaccgcggcatgtggggacatcattttgggcctacccgtttccgcccgaaggggaaaggagatacttctgggaccggccgatagtcttgaagggcaggggtggcgactcctcgcgcccatcacggcttactcccaacagacgcggggcttgcttggttgtatcatcaccagcctcacaggccgggacaagaaccaagtcgagggggaggttcaagtggtttccaccgcaacacaatctttcctggcgacctgcgtcaacggcgtgtgttggaccgtctatcatggcgctggctcaaagaccttagccggcccaaaaggcccaattacccaaatgtacactaatgtagatcaggacctcgtcggctggccggcgccctctggggcgcgttccttgacaccatgcacttgcggcagctcggacctttacttggtcacgagatatgccgatgtcattccggtgcgccggcggggtgacagtagggggagtctactctcccccaggcctgtctcctacttgaagggctcttcgggtggcccactgctctgcccttcggggcacgctgcgggtatcttccgggctgctgtgtgcacccgaggggttgcgaaggcggtggacttcgtacccgttgagtctatggaaactaccatgcggtctccggtcttcacagacaactcatcccccccggccgtaccgcagacgttccaagtggcccatctgcacgctcccaccggcagcggtaagagcactaaagtgccggcagcatacgcagcccaggggtacaaggtgctcgtcttgaacccgtccgttgccgccaccttagggtttggggcgtatatgtctaaggcacatggtatcgaccctaacactagaactggggtaaggaccatcaccaccggcgcccccatcacgtactccacctatggcaagttccttgccgacggtggttgctccgggggcgcctatgacatcataatatgtgatgaatgccactcaactgactcgactaccattttgggcatcggcacagtcctggaccaagcggagacggctggagcgcgactcgtcgtgctcgccaccgctactcctccgggatcggtcaccgtgccacactccaatattgaggaggtggccctatccaccactggagaaatccctttttatggcaaagccatccccatcgagaccatcaaggggggaagacatctcattttctgccattccaagaagaaatgcgacgagctcgccgcaaagctgtcagccctcggactcaatgctgtagcgtattaccggggtcttgacgtgtccgtcataccgactagcggagacgtagttgtcgtggcaacagacgctctaatgacgggctttaccggcgactttgactcagtgatcgactgcaacacatgtgtcacccagacagtcgatttcagcttggatcccaccttcaccattgagacgacgaccgtgcctcaagacgcggtgtcgcgctcacaacggcgaggtaggactggcaggggtagaagaggcatctataggtttgtgactccaggagaacggccttcgggtatgttcgattcttcggtcctgtgtgagtgctatgacgcaggctgtgcttggtacgagctcacgcccgctgagacctcagttaggctacgggcttacctaaatacaccagggttacccgtttgccaggaccacctggagttctgggagagcgtttttacaggcctcacccacatagatgctcacttcttgtcccagactaaacaagcaggagataacttcccctatctggtagcataccaggctactgtgtgcgccagggctcaggccccacctccatcgtgggaccaaatgtggaagtgtctcatacggctaaaacctacgctgcacgggccaacacccctgttgtataggctaggggccgttcaaaatgaggtcaccctcacacaccccataaccaaatacatcatggcatgcatgtcggctgacctggaggtcgtcactagcacctgggtgctggtaggcggagtccttgcagctctggccgcatattgcctgacgacaggcagtgtggtcattgtgggcaggatcgtcttgtccgggaggccggctgtcattcctgacagggaagttctctaccaggagttcgacgaaatggaagagtgcggttcgcacctcccttatatcgaacagggaatgcagctcgccgagcaattcaagcagaaggcgctcgggttgctgcaaatagccacaaagcaagcggaggctgctgctcccgtggtagagtccaaatggcgagcccttgagaccttctgggcgaagcacatgtggaatttcatcagcggggtacaatacttagcaggcttatccactctgcctgggaaccccgcgatagcatcgctgatggcattcacagcctctgtcaccagcccgctcaccactcaaagcaccctcctgttcaacatcttggggggatgggtggctgcccaactcgccccccccagcgctgcctcggctttcgtgggcgccggcatcgccggcgcggccgttggcagcataggacttgggaaggtgcttgtggacatcctggcgggctatggggcaggggtggctggtgccctcgtggcttttaagatcatgagcggcgagacgccctccgctgaggacctggttaatttgcttcctgccatcctctctcctggcgccctggtcgtcggggttgtgtgcgcggcaatacagcgccggcacgtgggcccgggagagggggctgtgcagtggatgaaccggctgatagcgttcgcctcgcggggtaaccacgtttcccccacgcactatgtgcccgagagcgacgctgcagcccgtgttactcagatcctctctagccttaccatcactcagctactgaagaggctccaccagtggattaatgaggactgctccacgccgtgctccggttcgtggctaagggatatttgggactggatatgctcggtgttaacggattttaagacctggctccagtccaagctcctgccacggttaccgggagtccctttcttctcatgccagcgtgggtacaagggagtctggcggggggacggcatcatgcaaaccacctgcccatgtggggcacagatcaccggacatgtcaaaaacggttccatgaggatcgttgggcctaaaacctgtagcaacacgtggcatggaacattccccatcaacgcatacaccacgggcccctgcacaccctccccggcgccaaactattccagggcgctgtggcgggtggccgctgaggagtacgtggaggttacgcgggtgggggatttccactacataacgggcatgaccactgacaacataaagtgcccatgccaggttccggcccccgagttcttcactgaagtggatggtgtgcggctacacaggtacgctccggcgtgcaaacctgtcctacgggaggaggtcgatttccaggtcgggctcaaccaatatccggttgggtcacagctcccatgcgagcccgaaccggatgtggccgtactcacttccatgctcaccgacccctcccacattacagcagaggcggctaagcgtaggctggccagggggtctcccccctccctggctagctcgtcagccagccagttgtctgcgccttccttgaaggcgacatgcaccacccatcacgactccccggacgccgacctcattgaggccaacctcctgtggcgacaggagatgggcgggaacatcacccgtgtggagtcagagaacaaggtggtaattttggactctttcgaaccgcttcgagcggaggaggacgagagggaggtatccgttgcggcggagatcctgcggaaaaccaggagattccccccagcgatgcccgtatgggcacgcccggattacaaccctccgctgttagagtcctggaaggacccggactacgttcctccggtggtacacgggtgcccattgccacctactaaggcccctccaataccacctccacggaggaagaggacggttgtcctgacagagtccactgtgtcctctgccttggcggagctcgccaccaagaccttcggcagctccggatcatctgccgtcgatagtggcacggcgaccgcccctcctgaccagacctccaacgacggcgacagagaatccgacgctgagtcgtactcctctatgccccccctcgagggggaaccgggggaccccgatctcagcgacgggtcttggtctaccgtaagcgaggaggctagtggggacgtcgtctgctgctcaatgtcctacacatggacaggtgccctaatcacaccatgcgctgcggaggaaagcaagctgcctatcaaccctctgagcaactccttgctgcgtcaccacaacatggtgtatgccacaacatctcgcagcgcaagcctgcggcagaagaaggtcacctttgacagattgcaggtcctggacgaccattaccgggacgtgctcaaggagatgaaggcaaaggcgtccacagttaaggctaaacttctgtctatagaagaagcctgcaagctgacgcccccacattcggccaaatccaaatttggctatggggcgaaggacgtccggaacctatccagcaaggccgttaaccacatccgctccgtgtggaaggacttgctggaagacactgaaacaccaattgacactaccatcatggcaaagaatgaggttttctgcgtccaaccagagaagggaggccgcaagccagctcgccttatcgtattcccagacctgggggttcgtgtatgcgagaagatggctctttatgacgtggtctccacccttcctcaggccgtgatgggctcctcatacggattccagtactctcctgggcagcgggtcgagttcctggtgaatacctggaaatcaaagaaatgccctatgggcttctcatatgacacccgctgttttgactcaacggtcaccgagaatgacatccgtattgaggagtcaatttaccaatgttgtgacttggcccccgaagccaaacaagccataaagtcgctcacagagcggctctatatcgggggccccctgactaactcaaaagggcagaactgcggttatcgccggtgccgcgcaagcggcgtcctgacgaccagctgcggtaataccctcacatgttacttgaaggcctctgcagcctgtcgagctgcgaagctccaggactgcacgatgctcgtgaacggagacgaccttgtcgttatctgtgaaagcgcgggaacccaggaggatgcggcgagcctacgagtcttcacggaggctatgactaggtactctgccccccccggggatccgccccaaccagaatacgacttggagctgataacatcatgttcctccaatgtgtcggtcgcgcacgatgcatctggcaaaagagtgtactacctcacccgtgaccccaccaccccccttgcgcgggctgcgtgggaaacagctagacacactccagtcaactcctggctaggcaacatcatcatgtatgcgcccaccttatgggcaaggatgattctgatgactcacttcttctccatccttctagctcaggaacaacttgaaaaagccctagagtgtcagatctacggggcttgttactccattgaaccgcttgacctacctcagatcattgagcgactccatggtcttagcgcgttttcactccatagttactctccaggtgaaatcaatagggtggcgtcatgcctcaggaagcttggggtaccacccttacgagtctggagacatcgggccagaagtgtccgcgctaagctactgtcccagggggggagggctgccacttgtggcaaatacctcttcaactgggcagtaaggaccaagcttaaactcactccaattccggctgcgtcccggttggacttgtccggctggttcgttgctggttacggcgggggagacatatatcacagcctgtctcgtgcccgaccccgctggttcatgttgtgcctactcctactttctgtaggggtaggcatctacctgctccccaaccgatgaacggggagctaaacactccaggccaataggccatcccttttttttttttttttttttttttttttttttttttttttttttt

SEQ ID NO: 758 - DNA, 9511 bp, Hepatitis C Virus
gcccgccccctgatgggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattaccggaaagactgggtcctttcttggataaacccactctatgtccggtcatttgggcacgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacacaaaccgccgcccacaggacgttaagttcccgggtggcggtcagatcgttggcggagtttacttgctgccgcgcaggggccccaggttgggtgtgcgcgcgacaaggaagacttctgagcgatcccagccgcgtggacgacgccagcccatcccgaaagatcggcgctccaccggcaagtcctggggaaagccaggatatccttggcccctgtacggaaacgagggttgcggctgggcgggttggctcctgtccccccgcgggtctcgtcctacttggggccccaccgacccccggcatagatcacgcaatttgggcagagtcatcgataccattacgtgtggttttgccgacctcatggggtacatccctgtcgttggcgccccggttggaggcgtcgccagagctctggcacacggtgttagggtcctggaggacgggataaattacgcaacagggaatttacccggttgctctttttctatctttttgcttgctcttctgtcatgcgtcacagtgccagtgtctgcagtggaagtcaggaacattagttctagctactacgccactaatgattgctcaaacaacagcatcacctggcagctcactgacgcagttctccatcttcctggatgcgtcccatgtgagaatgataatggcaccttgcattgctggatacaagtaacacccaacgtggctgtgaaacaccgcggtgcgctcactcgtagcctgcgaacacacgtcgacatgatcgtaatggcagctacggcctgctcggccttgtatgtgggagatgtgtgcggggccgtgatgattctatcgcaggctttcatggtatcaccacaacgccacaacttcacccaagagtgcaactgttccatctaccaaggtcacatcaccggccatcgcatggcatgggacatgatgctaagctggtctccaactcttaccatgatcctcgcctacgccgctcgtgttcccgaactggtcctcgaaattattttcggcggccattggggtgtggtgtttggcttggcctatttctccatgcaaggagcgtgggccaaagtcatcgccatcctccttcttgttgcgggagtggatgcaaccacctattccagcggccaggaagcgggtcgtaccgtcgcggggttcgctggcctctttactactggtgccaagcagaacctctatttaatcaacaccaatggcagctggcacataaaccggactgccctcaattgcaatgacagcttacagacgggtttcctcgcttccttgttttacacccacaagttcaacagctctggctgccccgagcgcttgtcttcctgccgcgggctggacgattttcgcatcggctggggaaccttggaatacgaaaccaacgtcaccaacgatggggacatgaggccgtactgctggcattaccccccgaggccttgcggcatcgtcccggctaggacggtttgcggaccggtctattgtttcacccctagccctgttgtcgtgggcaccactgacaagcagggcgtacccacctacacctggggagaaaacgagaccgatgtcttcctgctaaatagcacaagacccccgcgaggagcttggttcggctgcacctggatgaacgggactgggttcactaagacatgcggtgcaccaccttgccgcattaggaaagactacaacagcactatcgatttattgtgccccacagactgttttaggaagcacccagatgctacctatcttaagtgtggagcagggccttggttaactcccaggtgcctggtagactacccttataggttgtggcattatccgtgcactgtaaacttcaccatcttcaaggcgcggatgtatgtaggaggggtggagcatcgattctccgcagcatgcaacttcacgcgcggagatcgctgcagactggaagatagggataggggccagcagagtccactgctgcattccactactgagtgggcggtgctcccatgctccttctctgacctaccagcactatccactggcctattgcacctccaccaaaacatcgtggacgtgcagtacctctacggactttctccggctctgacaagatacatcgtgaagtgggagtgggtgatcctccttttcttgttgttggcagacgccaggatctgtgcatgcctttggatgctcatcatactgggccaagccgaagcggcgcttgagaagctcatcatcttgcactccgctagtgctgctagtgccaatggtccgctgtggtttttcatcttctttacagcggcctggtacttaaagggcagggtggtccccgtggccacgtactctgtcctcggcttatggtccttcctcctcctagtcctggccttaccacagcaggcttatgccttggacgctgctgaacaaggggaactggggctggccatattagtaattatatccatctttactcttaccccagcatacaagatcctcctgagccgttcagtgtggtggctgtcctacatgctggtcttggccgaggcccagattcagcaatgggttccccccctggaggtccgaggggggcgtgacgggatcatctgggtggctgtcattctacacccacgccttgtgtttgaggtcacgaaatggttgttagcaatcctggggcctgcctacctccttaaagcgtctctgctacggataccgtactttgtgagggcccacgctttgctacgagtgtgtaccctggtgaaacacctcgcgggggctaggtacatccagatgctgttgatcaccataggcagatggaccggcacttacatctacgaccacctctcccctttatcaacttgggcggcccagggtttgcgggacctggcaatcgccgtggagcctgtggtgttcagcccaatggagaagaaggtcattgtgtggggggctgagacagtggcgtgtggagacatcctgcatggcctcccggtctccgcgaggctaggtagggaggttctgctcggccctgccgacggctacacctccaaggggtggaagctcctagctcccattactgcttacactcagcaaactcgtggtctcctgggtgctatcgtggtcagcctaacgggccgcgacaaaaatgagcaggctgggcaggtccaggttctgtcctccgtcacacaaactttcttggggacatccatttcgggcgtcctctggacagtatatcacggggctggtaataagaccttggccggccccaagggaccagtcactcagatgtacaccagcgcagaaggggacctcgtgggatggcctagtccccccgggactaagtcattggacccctgtacctgcggggccgtagacctctacctggtcacccgaaacgctgatgtcattccggtccggaggaaagatgaccgacggggtgcattactctcgccaaggcccctctcaaccctcaaaggatcatccggagggcccgtgctctgctcaaggggacacgccgtgggcttgttcagagcggccgtgtgtgccaggggtgtagccaaatctattgacttcatccccgtcgaatcactcgatgtcgccacacggacgcccagtttctctgacaacagtacgccgccagctgtgccccagtcttaccaggtgggttacttgcacgcaccaacaggcagcggaaagagcaccaaggtccctgccgcgtatgccagtcaggggtataaagtactcgtactaaatccctctgtcgcggccacacttggttttggggcctacatgtccaaagcccacgggatcaaccctaatatcagaactggagtgcggaccgttaccaccggggactctatcacttactccacttatggcaagtttatcgcagatggaggctgtgcagccggtgcctatgacatcatcatatgcgacgaatgccattcagtggacgctactaccatccttggcattggaacagtccttgaccaagctgagaccgcaggcgtcaggctagtggttttggccacagccacgcctcccggtacggtgacaactccccacagtaacatagaggaggtggcccttggtcacgagggcgagatccctttttatggcaaagctattcccctagctttcatcaaggggggcagacacttgatcttttgccattcaaagaagaagtgcgacgagctcgcagcggccctccggggcatgggtgtcaatgccgttgcatactataggggtctcgacgtctccgttataccaactcaaggagacgtggtggttgtcgccactgatgccctaatgactgggtacaccggcgactttgactccgtcatcgactgtaatgttgcagtctctcagattgttgacttcagcctagacccaaccttcaccatcaccactcaaaccgtccctcaggacgctgtctcccgtagtcaacgtagagggagaactgggagggggcgattgggcgtttacaggtatgtttcgtcaggcgagaggccgtctgggatgttcgacagcgtagtgctctgcgagtgctatgatgccggggcagcctggtacgagcttacacctgctgagactacggtgagactccgggcttatttcaacacgcccggtttgcccgtatgtcaagaccacctggagttctgggaagcggtctttacaggtctcacacacattgacgcccacttcctctcccagacgaagcaaggaggagaaaactttgcgtatctaacggcctaccaggccacagtatgcgccagggcaaaggcccctcctccttcgtgggacgtgatgtggaagtgtctaactaggctcaaacctacactgactggtcccacccccctcctgtaccgcttgggtgccgtgaccaatgaggtcaccttgacgcaccccgtgacgaaatacatcgccacgtgcatgcaagctgacctcgagatcatgacaagctcatgggtcctggcggggggggtgctagccgccgtggcagcttactgcctggcgactggctgcatttccatcattggccgcctacacctgaatgatcgggtggttgtggcccccgacaaggaaatcttatatgaggcctttgatgagatggaagaatgcgcctccaaagccgccctcattgaggaagggcagcggatggcggagatgctcaaatctaagatacaaggcctcctacaacaggccacaaggcaagctcaagacatacagccagctatacagtcatcatggcccaagcttgaacaattttgggccaaacacatgtggaacttcatcagtggtatacagtacctagcaggactctccaccctaccgggaaatcctgcagtggcatcaatgatggcttttagcgccgcgctgactagcccactacccaccagcaccaccatcctcttgaacatcatgggaggatggttggcctctcagattgccccccctgccggagccactggcttcgttgtcagtggtctagtgggggcggccgtcggaagcataggcctgggtaagatactggtggacgttttggccgggtacggcgcaggcatttcaggggccctcgtagcttttaagatcatgagcggcgagaagcccacggtagaagacgttgtgaatctcctgcctgctattctgtctcctggtgcgttggtagtgggagtcatctgtgcagcaatcctgcgccgccacgtcggtcagggagagggagcggtccagtggatgaacagactgatcgccttcgcctccaggggaaaccacgttgcccctacccactacgtggtggagtctgacgcttcacagcgtgtaacgcaggtgctgagttcacttacaattaccagcttacttaggagactacatgcctggatcactgaagattgcccagtcccatgctcggggtcttggctccaggacatttgggattgggtttgttccatcctcacagacttcaaaaactggctgtcttcaaaattactccccaagatgcccggcattccctttatctcttgccagaagggatacaagggtgtatgggctggtacgggtgtcatgactactcggtgcccatgtggagcaaacatctcgggccatgtccgcatgggcaccatgaaaataacaggcccgaagacttgcttgaacctgtggcaggggactttccccattaattgttacacagaagggccttgcgtgccaaaaccccctcctaattacaagaccgcaatttggagggtggcagcgtcggagtacgttgaggtcacacagcatggctctttctcgtatgtaacggggttaaccagtgacaaccttaaggtcccttgccaggtaccagctccagaatttttctcttgggtggacggggtgcaaatccaccgattcgcccccgttccaggtcccttctttcgggatgaggtaacgttcaccgtaggccttaactccttcgtggtcggctctcagctcccttgcgatcctgagccggacaccgaggtactggcctccatgttgacagacccgtcccacatcaccgcggaggcggcagccaggcgattggcaaggggatctcccccttcacaggctagctcctcagcgagccagctctctgccccgtccttgaaggctacctgtaccacccataagacagcatatgattgtgacatggtggatgccaaccttttcatgggaggcgatgtgacccggattgagtctgactctaaggtgatcgttctagactccctcgattccatgactgaggtagaggatgatcgtgagccttctgtaccatcagagtacctgatcaagaggagaaagttcccaccggcgctgcctccttgggcccgtccagactacaatcctgttttgatcgagacatggaagaggccgggctatgaaccacccactgtcctaggctgtgccctcccccccacacctcaaacgccagtgcctccacctcggaggcgccgcgccaaagtcctgacccaggacaatgtggagggggtcctcagggagatggctgacaaagtactcagccctctccaagacaacaatgactccggtcactccactggagcggataccggaggagacatcgtccagcaaccctctgacgagactgccgcttcagaagcggggtcactgtcctccatgcctccccttgagggagagccgggagaccctgacctggagtttgaaccagtgggatccgctcccccttctgagggggagtgtgaggtcattgattcggactctaagtcgtggtccacagtctctgatcaagaggattctgttatctgctgctctatgtcatactcctggacgggggccctcataacaccatgtgggcccgaagaggagaagttaccgatcaaccctctgagtaattcgctcatgcggttccataataaggtgtactccacaacctcgaggagtgcctctctgagggcaaagaaggtgacttttgacagggtgcaggtgctggacgcacactatgactcagtcttgcaggacgttaagcgggccgcctctaaggttagtgcgaggctcctcacagtagaggaagcctgcgcgctgaccccgccccactccgccaaatcgcgatacggatttggggcaaaagaggtgcgcagcttatccaggagggccgttaaccacatccggtccgtgtgggaggacctcctggaagaccaacataccccaattgacacaactatcatggctaaaaatgaggtgttctgcattgatccaactaaaggtgggaaaaagccagctcgcctcatcgtataccccgaccttggggtcagggtgtgcgaaaagatggccctctatgacatcgcacaaaagcttcccaaagcgataatggggccatcctatgggttccaatactctcccgcagaacgggtcgatttcctcctcaaagcttggggaagtaagaaggacccaatggggttctcgtatgacacccgctgctttgactcaaccgtcacggagagggacataagaacagaagaatccatatatcaggcttgttctctgcctcaagaagccagaactgtcatacactcgctcactgagagactttacgtaggagggcccatgacaaacagcaaagggcaatcctgcggctacaggcgttgccgcgcaagcggtgttttcaccaccagcatggggaataccatgacatgttacatcaaagcccttgcagcgtgtaaggctgcagggatcgtggaccctgttatgttggtgtgtggagacgacctggtcgtcatctcagagagccaaggtaacgaggaggacgagcgaaacctgagagctttcacggaggctatgaccaggtattccgcccctcccggtgaccttcccagaccggaatatgacttggagcttataacatcctgctcctcaaacgtatcggtagcgctggactctcggggtcgccgccggtacttcctaaccagagaccctaccactccaatcacccgagctgcttgggaaacagtaagacactcccctgtcaattcttggctgggcaacatcatccagtacgcccccacaatctgggtccggatggtcataatgactcacttcttctccatactattggcccaggacactctgaaccaaaatctcaattttgagatgtacggggcagtatactcggtcaatccattagacctaccggccataattgaaaggctacatgggcttgaagccttttcactgcacacatactctccccacgaactctcacgggtggcagcaactctcagaaaacttggagcgcctccccttagagcgtggaagagtcgggcgcgtgccgtgagagcttcactcatcgcccaaggagcgagggcggccatttgtggccgctacctcttcaactgggcggtgaaaacaaagctcaaactcactccattgcccgaggcgagccgcctggatttatccgggtggttcaccgtgggcgccggcgggggcgacatttatcacagcgtgtcgcatgcccgaccccgcctattactcctttgcctactcctacttagcgtaggagtaggcatctttttactccccgctcggtagagcggcaaaccctagctacactccatagctagtttccgtttttttttttttttttttttttttttttt

SEQ ID NO: 759 - DNA, 9436 bp, Hepatitis C Virus
gccagcccccgattgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacacctaccgccgcccacaggacgtcaagttcccgggcggtggtcagatcgttggtggagtttacgtgttgccgcgcaggggccccacgttgggtgtgcgcgcgactaggaagacttccgaacggtcgcaacctcgtggaaggcgacaacctatccccaaggctcgccgacccgagggtagggcctgggctcagcctgggtacccttggcccctctatggcaatgagggcctggggtgggcaggatggctcctgtcaccccgcggctcccggcctagttggggccccacggacccccggcggaggtcgcgcaatctgggtaaggtcatcgataccctcacgtgcggcttcgccgacctcatggggtacattccgctcgtcggcgcccccctagggggcgctgccagggccctggcacatggtgtccgggttctggaggacggcgtgaactacgcaacagggaacttgcccggttgctctttctctatcttcctcttggccctgctgtcctgtttgaccatcccagcttccgcttatcaggtgcgcaacgcatccgggctgtaccatgtcacgaatgactgctccaactcaagcattgtgtatgaggcagcgggcatgatcatgcatacccccgggtgcgtaccctgcgttcgggagaacaacgcctcccgttgttgggtagcgctcactcccacgctcgcggccaggaacaccagcatccccactacgacaatacgacgccacgtcgacttgctcgttggggcggccgctttctgttccgccatgtacgtgggggacctctgcggatccgttttcctcgtctcccagttgttcaccttctcgcctcgccggtatgagacagtacaggactgcaattgctcaatctatcccggccatgtatcaggtcaccgcatggcttgggatatgatgatgaactggtcgcctacaacagccctagtggtgtcgcagttactccggatcccacaagctgtcgtggatatggtggcgggggcccactggggagtcctagcgggccttgcctactattccatggtggggaactgggctaaggtcttgattgtgatgttactctttgccggcgttgacggggtcacttacacgacaggggggtcgcaagctcgccacacccagagcgtcacgtccttcttcacccaagggccggcccagagaatccagctcataaacaccaatggcagctggcacatcaacaggactgccctgaactgcaatgaatccctcaacaccgggttctttgccgcactgttctacgcacacaagttcaactcgtccggatgcccagagcgcatggccagctgcagctccatcgacaagttcgctcagggatggggccccatcacctataccgagcctagggacctggatcagaggccttactgctggcattacgcacctcggcagtgtggtatcgtacctgcgtcgcaggtgtgtggtccagtgtactgtttcaccccaagccctgttgtagtggggacgaccgatcggtccggtgcccctacgtataactggggggcgaatgagacagatgtgctgcttctcaacaacacgcggccgccacaaggcaactggtttggctgtacatggatgaacagcactgggttcaccaagacgtgtgggggccctccgtgcaacatcgggggggtcggcaacctcaccttgacctgccccacggattgctttcggaagcaccccgaggccacttacacaaaatgtggctcggggccatggttaacacctaggtgtatagttgactacccatacaggctctggcactacccctgcactgtcaactttaccatctttaaggttaggatgtatgtggggggcgtggagcacaggcttagtgctgcatgcaactggactcgaggagagcgttgcgacctggaggacagggacagatcggagctcagcccgctgctgctgtccacgacagagtggcagacacttccctgttccttcaccaccctaccggctctgtccactggtttgatccacctccatcagaacatcgtggacgtgcagtacctgtacggtatagggtcagcggttgtctcctttgtgatcaaatgggagtatatcgtgttgcttttccttctcctggcggacgcgcgcgtctgtgcctgcttgtggatgatgctgctgatagcccaggctgaggccgccctagagaacctggtggtcctcaacgcggcgtccctggccggagcggatggcattctctccttccttgtgtttttctgtgccgcctggtacatcaagggcaggctggtccctggggcggcatatgctctgtacggcgtgtggccgctgctcctgctcctgctggcgttaccaccacgggcttacgccatggaccgggagatggctgcatcgtgtggaggggtggtttttgtaggtctaatactcttgaccttgtcaccacactacaaagtgttcctcgccaggctcatatggtggttacaatactttatcaccagggccgaggcgcatttgtgcgtgtgggtcccccctctcaatgtccgggggggccgcgatgctatcatcctcctcacatgtgcggcccacccagagctaatctttgacattaccaaactcctgctcgccattctcggtccgctcatggtgctccaggctgccataactgcgatgccgtactttgtacgcgctcaggggcttattcgtgcatgcatgttggtgcggaaagtagccggaggccattacgtccaaatggccttcatgaagctggccgcactgacaggtacgtacgtctatgaccatcttaccccgctacaggattgggcccacgcgggcctacgagaccttgcggtggcagtagagcccgtcgtcttctctgacatggagaccaagatcatcacctggggggcggacaccgcggcgtgtggggacatcatcttgggactgcccgtctccgcccgaaggggaagggagatacttctgggaccggccgatagcattgaagggcaggggtggcgactccttgcccccatcacggcctacgcccaacagacacggggcctacttggttgcattgttactagcctcacaggccgggacaagaaccaggtcgaaggggaggttcaagtggtttccaccgcaacacaatctttcctggcgacctgcgttaatggtgtgtgttggaccgtcttccacggcgccggctcaaagaccctagccggcccaaaaggcccaatcacccaaatgtacactaatgtagaccaagacctcgtcggctggcatgcgcctcccggggcgcgttcccttacaccatgcacctgcggtagctcggacctctatctggtcacgagacatgctgacgtcattccggtgcgccgacgcggtgacggtcgggggagcctactgtcccccagacccgtctcctatttgaagggctcttcgggtggcccactgctctgcccttcggggcacgctgtaggcatcttccgggctgctgtgtgcacccggggggttgcgaaggcggtggacttcatacccgttgagtctatggaaactactatgcggtccccggtcttcacggacaactcatctcccccggccgtaccgcagacattccaagtggcccatctacacgctcccactggcagcggcaagagcactaaagtgccggctgcgtacgcagcccaagggtacaaggtactcgtcctgaacccatctgttgccgccaccttgggttttggggcgtatatgtctaaggcacatggtaccgaccccaacatcagaactggggtaaggaccattaccacgggcgcccccatcacgtactccacctatggtaagttccttgccgacggtggatgttctgggggcgcctatgatatcataatatgtgatgagtgccactcaactgactcgactaccatcctgggcatcggcacagtcctggaccaagcggagacggctggagcgcggctcgtcgtgctcgccaccgctacgcctccgggatcggttaccgtgccacacccaaatattgaggaggtggctctgtccaacactggagagatccccttctatggcaaggccatccccctcgaggccatcaaggggggaaggcatctcattttctgccactccaagaagaagtgcgatgagctcgccgcaaagctgtcaggcctcggaatcaatgccgtagcgtattaccggggtcttgacgtgtccgtcataccgactagcggagatgtcgttatcgtggcaacagacgctctaatgacgggctacaccggtgactttgactcggtgatcgactgcaacacatgtgtcacccagacagtcgatttcagcttggatcccacctttaccattgagacgacgaccgtgccccaagacgcggtgtcgcgctcacaacggcgaggcaggactggcaggggtaggggaggcatctacaggtttgtgactccgggagaacggccctcgggcatgttcgattcttcggtcctgtgtgagtgctatgacgcgggctgtgcttggtatgagctcacgcccgctgagactacagtcaggttgcgggcttacctgaatacaccagggttgcccgtctgccaggaccatctggagttctgggaaagcgtcttcacaggcctcacccacatagatgcccacttcctgtcccaaaccaagcaggcaggagacaacttcccttacctggtagcataccaagccacggtgtgcgccagggctcaggctccacctccatcgtgggatcaaatgtggaagtgtctcatacggcttaaacctacgctgcacgggccaacacccctgctgtataggctaggagccgttcaaaatgagatcaccctcacacatcccataaccaaattcatcatggcatgcatgtcggccgacctggaggtcgtcactagcacctgggtgctggtaggcggagtccttgcagctctggccgcatattgcctgacaaccggtagtgtggtcattgtgggtaggatcattttgtccgggaggccggctgttgttcccgacagggaagtcctctaccgggagttcgatgaaatggaagagtgcgcctcacacctcccttacatcgaacagggaatgcagctcgccgagcagttcaagcagaaggcactcgggttgctgcaaacagccaccaagcaagcggaggccgctgctcccgtggtggagtccaggtggcgggcccttgaggccttctgggcaaagcacatgtggaacttcatcagcgggatacagtatttagcaggcttatccactctgcctgggaaccccgcgatagcatcactgatggcattcacagcctctatcaccagtccgctcaccacccagaataccctcctgttcaacatcttagggggatgggtggctgctcaactcgctcctcccagtgctgcttcggccttcgtgggcgccggcattgccggtgcggccattggcagcataggccttgggaaggtgcttgtggacattctggcgggctatggagcgggggtggccggtgcactcgtggcttttaaggtcatgagcggcgaggcgccctccgccgaggacctggttaacttgctccctgccatcctctcccccggcgccctggtcgtcggggtcgtgtgtgcagcaatcctgcgtcggcacgtgggcccgggagagggggctgtgcagtggatgaaccggctgatagcgttcgcttcgcggggtaaccacgtttcccccacgcactacgtgcctgagagcgacgccgcagcacgtgtaactcagatcctctccagcctcaccatcactcagctgctgaagaggcttcaccagtggattaatgaggactgctccacgccatgctccggctcgtggctaaaggatgtttgggactggatatgcacggtgttgactgacttcaagacctggctccagtccaagctcctgccgaaattgccgggagtccctttcttctcatgccaacgcgggtacaagggagtctggcggggggacggcatcatgcaaaccacctgcccatgtggagcacaaattaccggacatgtcaaaaacggttccatgaggatcgttgggcctaaaacctgcagcaacacgtggcacggaacgttccccatcaacgcgtacaccacaggcccctgcacaccctccccggcgccgaactattccagggcgctgtggcgggtggctgctgaagagtacgtggagattacgcgggtgggggacttccactacgtgacgggtatgaccaccgacaacgtaaaatgcccgtgccaggtcccggcccccgaattcttcaccgaattggacggggtgcggttgcacaggtacgctccggcgtgcagacctctcctacgggaggatgtcacattccaggtcgggctcaaccaatacctggttgggtcacagctcccatgcgagcctgaaccggatgtggcagtgctcacttccatgctcaccgacccctcccacattacagcagagacggctaaacgtaggctggccagggggtctcccccctccttggccagctcttcagctagccaattgtctgcgccttccttgaaggcaacatgcactacccaccatgactccccggacgctgacctcatcgaggccaacctcctgtggcggcaggagatgggcggaaacatcacccgtgtggagtcagagaataaggtggtaattttggactctttcgacccgcttcgagcggaagaggatgagagggaagtatccgttgcagcagagatcctgcgaaaatccaagaagttcccccccgcgttgcccatatgggcacgcccggattacaaccctccactgttagagtcctggaaaagtccggactacgtccctccggcggtgcatgggtgcccattgccgcctaccacgggccctccaataccgcctccacggaaaaagaggacggttgttctgacagagtccaccgtgtcttctgccttggcggagctggctactaagactttcggcagctccggatcgtcggccgttgacagcggcacggcgaccgcccctcccgatcagacctctgacgacggtgacaaagaatctgacgttgagtcgtactcctccatgcccccccttgagggggagccgggggaccctgatctcagcgacgggtcttggtctaccgtgagcggggaggccagcgacgacatcgtctgctgctcaatgtcctacacatggacaggcgccctgatcacgccatgcgccgcagaggagagcaagctgcccatcaacgcgttgagcaactctctgctgcgtcaccacaacatggtctatgccacaacatcccgcagtgcaagcctgcggcagaagaaggtcacctttgacagactgcaagtcctggacgaccactaccgggacgtgctcaaggagatgaaggcgaaggcgtccacagttaaggctaaacttctatccgtagaagaagcctgcaagctgacgcccccacattcggccaaatctaaatttggctatggggcaaaggacgtccggaacctatccagcaaggccattaaccacatccgctccgtgtggaaggacctgctggaagacactgagacaccaattgacaccaccatcatggcaaaaagtgaagttttctgcgtccaaccggagaagggaggccgcaagccagctcgccttatcgtattcccagacctgggagttcgtgtatgcgagaaaatggctctttacgacgtggtctccacccttcctcaggccgtgatgggctcctcgtacggattccagtactctcctgggcagcgggttgagttcctggtgaatgcctggaaatcaaagaaaagccctatgggcttctcgtatgacacccgctgctttgactcaacagtcactgagagcgacatccgtgttgaggagtcaatctaccaatgttgtgacttggcccccgaagccagacaggccataaagtcgctcacggagcggctctacatcgggggccccctgactaattcaaaagggcagaactgcggttatcgccggtgccgcgcgagcggcgtgctgacgactagctgcggcaataccctcacatgctacttgaaagccactgcggcctgtcgagctgcaaagctccaggactgcacgatgctcgtgaacggagacgaccttgtcgttatctgtgaaagcgcgggaacccaggaggatgcggcgagcctacgagtcttcacggaggctatgactaggtactctgccccccccggggacccgccccaaccagaatacgacttggagttgataacatcatgctcctccaacgtgtcggtcgcgcacgacgcatccggcaaaagagtgtactacctcactcgtgatcccaccaccccccttgcacgggctgcgtgggagacagctagacacactccagtcaactcctggctaggcaacatcatcatgtatgcgcccaccttatgggcaaggatgattttgatgactcacttcttctccatccttctagcccaggaacagcttgaaaaggccctggattgtcagatctacggggcctgttactccattgagccacttgacctacctcagatcattcaacgactccatggtcttagcgcattctcactccatagttactctccaggtgagatcaatagggtggcttcatgcctcaggaaacttggggtaccgcccttgcgagtctggagacatcgggccagaagtgtccgcgctaggctactgtcccaaggggggagggccgccacgtgtggcaagtacctcttcaactgggcagtaaggaccaagctcaaactcactccaatcccggccgcgtcccagctggacttgtccagctggttcgttgctggttacagcgggggagacatatatcacagcctgtctcgtgcccgaccccgctggtttatgtggtgcctactcctactttccgtaggggtaggcatctacctgctccccaaccggtgagcggggagctaatcactccaggccaataggccatcccctttttttttttttttttttttttt

SEQ ID NO: 760 - DNA, 9434 bp, Hepatitis C Virus
  misc_feature 3438, 3449, 4080, 6655: n = A,T,C or G
gccagcccccgattgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacacctaccgccgcccacaggacgtcaagttcccgggcggtggtcagatcgttggtggagtttacgtgttgccgcgcaggggccccacgttgggtgtgcgcgcgactaggaagacttccgaacggtcgcaacctcgtggaaggcgacaacctatccccaaggctcgccgacccgagggtagggcctgggctcagcctgggtacccttggcccctctatggcaatgagggcctggggtgggcaggatggctcctgtcaccccgcggctcccggcctagttggggccccacggacccccggcgcaggtcgcgcaatctgggtaaggtcatcgataccctcacgtgcggcttcgccgacctcatggggtacattccgctcgtcggcgcccccctagggggcgctgccagggccctggcacatggtgtccgggttctggaggacggcgtgaactacgcaacagggaacttgcccggttgctctttctctatcttcctcttggccctgctgtcttgtttgaccatcccagcttccgcttatcaggtgcgcaaccgatccgggctataccatgtcacgaacgactgctccaactcaagcattgtgtatgaggcagcgggcatgatcatgcatacccccgggtgcgtaccctgcgtccgggagaacaacgtctcccgttgctgggtagcgctcactcccacgctcgcggccaggaacaccagcatccccactacgacaatacgacgccacgtcgacttgctcgttggggcggctgctttctgttccgccatgtacgttggggacctctgcggatccgttttcctcgtctcccagttgttcaccttctcgcctcgccggtatgagacagtacaggactgcaattgctcaatctatcccggccatgtatcaggtcaccgcatggcttgggatatgatgatgaactggtcgcctacaacagccctagtggtgtcgcagttactccggatcccacaagctgtcgtggatatggtggcgggggcccactggggagtcctagcgggccttgcctactattccatggtggggaactgggctaaggtcttgattgtgatgttactctttgccggcgttgacggggtcacttacacgacaggggggtcgcaagctcgccacacccagggggtcgcgtccttcttcaccccagggccggcccagaaaatccagctcataaacaccaatggcagctggcacatcaacaggactgccctgaactgcaatgaatccctcaacaccgggttctttgccgcactgttctacgcacacaagttcaactcgtccggatgcccagagcgcatggccagctgcagctccattgacaagttcgctcagggatggggtcccatcacctataccgagcctggggacttggatcagaggccttactgctggcattacgcacctcggcagtgtggtatcgtacccgcgtcgcaggtgtgtggtccagtgtactgtttcaccccaagccctgttgtagtggggacgaccgatcgttccggtgcccctacgtataactggggggcgaatgagacagatgtgctgcttctcaacaacacacggccgccacaaggcaactggtttggctgtacatggatgaacagcactgggttcaccaagacgtgtgggggccctccgtgcaacatcgggggggtcggcaacctcaccttgacctgccccacggattgcttccggaagcaccccgaggccacttacacaaaatgtggctcggggccatggttaacacctaggtgcatagttgactacccatacaggctctggcactacccctgcactgtcaactttaccatctttaaggttaggatgtatgtggggggcgtggagcacaggcttagtgctgcatgcaactggactcgaggagagcgttgcgacctggaggacagggacagatcggagctcagcccgctgctgctgtccacgacagagtggcagacacttccctgttccttcaccaccctaccggctctgtccactggtttgatccacctccatcagaacatcgtggacgtgcagtacctgtacggtatagggtcagcggttgtctcctttgtgatcaaatgggagtatatcgtgttgcttttccttctcctggcggacgcgcgcgtctgtgcctgcttgtggatgatgctgctgatagcccaggctgaggccgccctagagaacctggtggtcctcaacgcggcgtccctggccggagcgcatggcattctctccttccttgtgtttttctgcgccgcctggtacatcaagggcaggctggtccctggggcggcatatgctctttacggcgtatggccgctgctcctgctcctgctggcgttaccaccacgagcttacgccatggaccgggagatggctgcatcgtgtggaggggtggtttttctaggtctaatactcttgaccttgtcaccacactacaaagtgttcctcgccaggctcatatggtggttacaatactttatcaccagggccgaggcgcatttgtgcgtgtgggtcccccctctcaacgtccgggggggccgcgatgctatcatcctcctcacatgtgcggcccacccagagctaatctttgacattaccaaactcctgctcgccattctcggtccgctcatggtgctccaggctgccataactgcgatgccgtactttgtacgcgctcaggggcttattcgtgcatgcatgttggtgcggaaagtagccggaggccattatgtccaaatggccttcatgaagctggccgcactgacaggtacgtacgtctatgaccatcttaccccgctacaggattgggcccacgcgggcctacgagaccttgcggtggcagtagagcccgtcgtcttctctgacatggagaccaagatcatcacctggggggcggacaccgcggcgtgtggggacatcatcttgggactgcccgtctccgcccgaagggaaagggagatacttctgggaccggccgatagcattgaagggcaggggtggcgactccttgcccccatcacggcctacncccaacagacncggggcctacttggttgcattgttactagcctcacaggccgggacaagaaccaggtcgaaggggaggttcaagtggtttccaccgcaacacaatctttcctggcgacctgcgttaatggcgtgtgttggaccgtcttccacggcgccggctcaaagaccctagccggcccaaaaggcccaatcacccaaatgtacactaatgtagaccaagacctcgtcggctggcatgcgcctcccggggcgcgttcccttacaccatgcacctgcggtagctcggacctctatctggtcacgagacatgctgacgtcattccggtgcgccgacgcggtgacggtcgggggagcctactgtcccccagacccgtctcctatttgaagggctcttcgggtggcccactgctctgcccttcggggcacgctgtaggcatcttccgggctgctgtgtgcacccggggggttgcgaaggcggtggacttcatacccgttgagtctatggaaactaccatgcggtctccggtcttcacagacaactcatctcccccggccgtaccgcagacattccaagtggcccatctacacgctcccactggcagcggcaaaagcactaaagtgccggctgcgtacgcagccnaagggtacaaggtactcgtcctgaacccatctgttgccgccaccttgggttttggagcgtatatgtctaaggcacatggcaccgaccctaacatcagaactggggtaaggaccattaccacgggcggccccatcacgtactccacctatggtaagttccttgccgacggtggatgttcggggggcgcctatgatatcataatatgtgatgagtgccactcaactgactcgactaccatcctgggcatcggcacagtcctggaccaagcggagacggctggagcgcggctcgtcgtgctcgccaccgctacgcctccgggatctgttaccgtgccacacccaaatattgaggaggtggctctgtccaacactggagagatccccttctatggcaaggccatccccatcgaggtcatcaaggggggaaggcatctcattttctgccactccaagaagaagtgcgatgagctcgccgcaaagctgtcaggcctcggaatcaatgccgtagcgtattaccggggtcttgacgtgtccgtcataccgactagcggagatgtcgttgtcgtggcaacagacgctctaatgacgggctacaccggcgactttgactcggtgatcgactgcaacacatgtgtcacccagacagtcgatttcagcttggatcccacctttaccattgagacgacgaccgtgccccaagacgcggtgtcgcgctcacaacggcgaggcagaactggcaggggtaggggaggcatctacaggtttgtgactccgggagaacggccctcgggcatgttcgattcttcggtcctgtgtgagtgctatgacgcgggctgtgcttggtatgagctcacgcccgctgagactacagtcaggttgcgggcttacctgaatacaccagggttgcccgtctgccaggaccatctggagttctgggaaagcgtcttcacaggcctcacccacatagatgcccacttcctgtcccaaaccaagcaggcaggagacaacttcccctacctggtggtataccaagccacggtgtgcgccagggctcaggctccacctccatcgtgggatcaaatgtggaagtgtctcatacggcttaaacctacgctgcacgggccaacacccctgctgtataggctaggagccgttcaaaatgagatcaccctcacacatcccataaccaaattcatcatggcatgcatgtcggccgacctggaggtcgtcactagcacctgggtgctggtaggcggagtccttgcagctctggccgcatattgcctgacaaccggtagtgtggtcattgtgggtaggatcattttgtccgggaggccggctgttgttcccgacagggaagtcctctaccgggagttcgatgaaatggaagagtgcgcctcacacctcccttacatcgaacagggaatgcagctcgccgagcagttcaagcagaaggcactcgggttgctgcaaacagccaccaagcaagcggaggccgctgctcccgtggtggagtccaggtggcgggcccttgaggccttctgggcaaagcacatgtggaacttcatcagcgggatacagtacttagcaggcttatccactctgcctggaaaccccgcgatagcatcactgatggcattcacagcctctatcaccagtccgctcaccacccagaataccctcctgttcaacatcttagggggatgggtggctgctcaactcgctcctcccagtgctgcttcggccttcgtgggcgccggcattgccggtgcggccattggcagcataggccttgggaaggtgcttgtggacattctggcgggctatggagcgggggtggccggtgcactcgtggcttttaaggtcatgagcggcgaggcgccctccgccgaggacctggttaacttgctccctgccatcctctcccccggcgccctggtcgtcggggtcgtgtgtgcagcaatcctgcgtcgacacgtgggcccgggagagggggctgtgcagtggatgaaccggctgatagcgttcgcttcgcggggtaaccacgtttcccccacgcactacgtgcctgagagcgacgccgcagcacgtgtaactcagatcctctccagcctcaccatcactcagctgctgaagaggcttcaccagtggattaatgaggactgctccacgccatgctccggctcgtggctaagggatgtttgggactggatatgcacggtgttgactgacttcaagacctggctccagtccaagctcctgccgcaattgccgggagtccctttcttctcatgccaacgcgggtacaagggagtctggcggggggacggcatcatgcaaaccacctgcccatgtggagcacaaattaccggacatgtaaaaaacggttccatgaggatcgttgggcctaagacctgcagcaacatgtggcatggaacgttccccatcaacgcgtacaccacgggcccctgcacaccctccccggcgccaaactattccagggcgctgtggcgggtggctgctgaagagtacgtggagattacgcgggtgggggacttccactacgtgacgggtangaccaccgacaacgtaaaatgcccgtgccaggtcccggcccccgaattcttcactgaattggacggggtgcggttgcacaggtacgctccggcgtgcagacctctcctacgagaggatgtcacattccaggtcgggctcaaccaatacctggttgggtcacagctcccatgcgagcccgaaccggatgtggcagtgctcacttccatgctcaccgacccctcccacattacagcagagacggctaaacgtaggctggccagggggtctcccccctccttggccagctcttcagctagccaattgtctgcgccttccttgaaggcaacatgcactacccaccatgactccccggacgctgacctcatcgaggccaacctcctgtggcggcaggagatgggcgggaacatcacccgtgtggagtcagagaataaggtggtaattttggactctttcgacccgcttcgagcggaagaggatgagagggaagtatccgttgcagcagagatcctgcgaaaatccaagaagttccccccagcgttgcccatatgggcacgcccggattacaaccctccactgttagagtcctggaaaagtccggactacgtccctccggcggtgcatgggtgcccattgccgcctaccacgggccctccaataccgcctccacggaaaaagaggacggttgttctgacagagtccaccgtgtcttctgccttggcggagctggctactaagactttcggcagctccggatcgtcggccgttgacagcggcacggcgaccgcccctcccgatcagacctctgacgacggtgacaaagaatctgacgttgagtcgtactcctccatgccccccctcgagggggagccgggggaccctgatctcagcgacgggtcttggtctaccgtgagcggggaggccagtgacgacatcgtctgctgctcaatgtcctacacatggacaggcgccctgatcacgccatgcgccgcagaggagagcaagctgcccatcaacgcgttgagcaactctctgctgcgtcaccacaacatggtctatgccacaacatcccgcagtgcaagcctgcggcagaagaaggtcacctttgacagactgcaagtcctggacgaccactaccgggacgtgctcaaggaggtgaaggcgaaggcgtccacagttaaggctaaacttctatccgtagaagaagcctgcaagctgacgcccccacattcggccaaatctaaattcggctatggggcaaaggacgtccggaacctatccagcaaggccattaaccacatccgctccgtgtggaaggacctgctggaagacactgagacaccaattgacaccaccatcatggcaaaaagtgaagttttctgcgtccaaccggagaagggaggccgcaagccagctcgccttatcgtattcccagacctgggagttcgtgtatgcgagaaaatggctctttacgacgtggtctccacccttcctcaggccgtgatgggctcctcgtacggattccagatctctcctgggcagcgggttgagttcctggtcaatgcctggaaatcaaagaaaagccctatgggcttctcgtatgacactcgctgctttgactcaacagtcactgagagcgacatccgtgttgaggagtcaatctaccaatgttgtgacttggcccccgaagccagacaggccataaagtcgctcacagagcggctctacatcgggggtcccctgactaattcaaaagggcagaactgcggttatcgccggtgccgcgcgagcggcgtgctgacgactagctgcggcaataccctcacatgctacttgaaagccactgcggcctgtcgagctgcaaagctccaggactgcacgatgctcgtgaacggagacgaccttgtcgttatctgcgaaagcgcgggaacccaggaggatgcggcgagcctacgagtcttcacggaggctatgactaggtactctgccccccccggggacccgccccaaccagaatacgacttggagttgataacatcatgctcctccaacgtgtcggtcgcgcacgacgcatctggcaaaagagtgtactacctcactcgtgatcccaccaccccccttgcacgggctgcgtgggagacagctagacacactccagtcaactcctggctaggcaacatcatcatgtatgcgcccaccttatgggcaaggatgattttgatgactcacttcttctccatccttctagcccaggaacagcttgaaaaggccctggattgtcagatctacggggcctgttactccattgagccacttgacctacctcagatcattcaacgactccatggccttagcgcattctcactccatagttactctccaggtgagatcaatagggtggcttctagcctcaggaaacttggggtaccgcccttgcgagtctggagacatcgggccagaagtgtccgcgctaggctactgtcccagggggggagggccgccacgtgtggcaagtacctcttcaactgggcagtaaggaccaagctcaaactcactccaatcccggccgcgtcccagctggacttgtccagctggttcgttgctggttacagcgggggagacatatatcacagcctgtctcgtgcccgaccccgctggttcatgtggtgcctactcctactttccgtaggggtaggcatctacctgctccccaaccggtgaacggggagctaatcactccaggccaataggccatcccttttttttttttttttttttttt

SEQ ID NO: 761 - DNA, 3559 bp, Hepatitis C Virus
ttttccttctcctggcggacgcgcgcgtctgtgcctgcttgtggatgatgctgctgatagcccaggctgaggccaccttagagaacctggtggtcctcaatgcggcgtctgtggccggagcgcatggccttctctccttcctcgtgttcttctgcgccgcctggtacatcaaaggcaggctggtccctggggcggcatatgctctctatggcgtatggccgttgctcctgctcttgctggccttaccaccacgagcttatgccatggaccgagagatggctgcatcgtgcggaggcgcggtttttgtaggtctggtactcttgaccttgtcaccatactataaggtgttcctcgctaggctcatatggtggttacaatattttatcaccagggccgaggcgcacttgcaagtgtgggtcccccctcttaatgttcggggaggccgcgatgccatcatcctccttacatgcgcggtccatccagagctaatctttgacatcaccaaactcctgctcgccatactcggtccgctcatggtgctccaggctggcatgactagagtgccgtactttgtacgcgctcaggggctcatccgtgcatgcatgttagtgcggaaggtcgctggaggccactatgtccaaatggccttcatgaagctggccgcgctgacaggtacgtacgtatatgaccatcttactccactgcgggattgggcccacgcgggcctacgagaccttgcggtggcagtagagcccgtcgtcttctctgacatggagactaagatcatcacctggggggcagacaccgcggcgtgtggggacatcatctcgggtctaccagtctccgcccgaagggggaaggagatacttctaggaccggccgatagttttggagagcaggggtggcggctccttgcgcctatcacggcctattcccaacaaacgcggggcctgcttggctgtatcatcactagcctcacaggtcgggacaagaaccaggtcgatggggaggttcaggtgctctccaccgcaacgcaatctttcctggcgacctgcgtcaatggcgtgtgttggaccgtctaccatggtgccggctcgaagaccctggccggcccgaagggtccaatcacccaaatgtacaccaatgtagaccaggacctcgtcggctggccggcgccccccggggcgcgctccatgacaccgtgcacctgcggcagctcggacctttatttggtcacgaggcatgccgatgtcattccggtgcgccggcgaggcgacagcagggggagcctactctcccctaggcccgtctcctacctgaagggctcctcgggtggaccactgctttgcccttcggggcacgttgtaggcatcttccgggctgctgtgtgcacccggggggttgcgaaggcggtggacttcatacccgttgagtctatggaaactaccatgcggtctccggtcttcacagacaactcatcccctccggccgtaccgcaaacattccaagtggcacatttacacgctcccactggcagcggcaagagcaccaaagtgccggctgcatatgcagcccaagggtacaaggtgctcgtcctaaacccgtccgttgctgccacattgggctttggagcgtatatgtccaaggcacatggcatcgagcctaacatcagaactggggtaaggaccatcaccacgggcggccccatcacgtactccacctattgcaagttccttgccgacggtggatgctccgggggcgcctatgacatcataatatgtgacgaatgccactcaactgactcgacaaccatcttgggcatcggcacagtcctggatcaggcagagacggctggagcgcggctcgtcgtgctcgccaccgccacgcctccgggatcgatcaccgtgccacaccccaacatcgaggaagtggccctgtccaacactggggagattcccttctatggcaaagccatccccattgaggccatcaaggggggaaggcatctcatcttctgccattccaagaagaagtgtgacgagctcgccgcaaagctgacaggcctcggactcaacgctgtagcgtattaccggggtctcgatgtgtccgtcataccgactagcggagacgtcgttgtcgtggcaacagacgctctaatgacgggttttaccggcgactttgactcagtgatcgactgcaacacatgtgtcacccagacggtcgatttcagcttggatcccaccttcaccattgagacgacaacgctgccccaagacgcggtgtcgcgtgcgcagcggcgaggtaggactggcaggggcaggagtggcatctacaggtttgtgactccaggagaacggccctcaggcatgttcgactcctcggtcctgtgtgagtgctatgacgcaggctgcgcttggtatgagctcacgcccgctgagactacagtcaggttgcgggcttacctgaatacaccagggttgcccgtctgccaggaccatctggagttctgggaaagcgtcttcacaggcctcacccacatagatgcccacttcctgtcccaaaccaagcaggcaggagacaacttcccctacctggtggcataccaagccacggtgtgcgccagggctcaggctccacctccatcgtgggatcaaatgtggaagtgtctcatacggcttaaacctacgctgcacgggccaacacccctgctgtataggctaggagccgttcaaaatgagatcaccctcacacatcccataaccaaattcgtcatggcatgcatgtcggccgacctggaggtcgtcactagcacctgggtgctggtaggcggagtccttgcagctctggccgcatattgcctgacaaccggtagtgtggtcattgtgggtaggatcattttgtccgggagaccggctgttgttcccgacagggaagtcctctaccgggagttcgatgaaatggaagcgtgcgccccacacctcccttacatcgagcaaggaatgcagctcgccgagcagttcaagcagaaggcactcgggttgctgcaaacagccaccaagcaagcggaggccgctgctcccgtggtggagtccaggtggcgggcccttgaggccttctgggcaaagcacatgtggaacttcatcagcgggatacagtacttagcaggcttatccactctgcctgggaaccccgcgatagcatcactgatggcattcacagcctctatcaccagtccgctcaccacccagaataccctcctattcaacatcttagggggatgggtggctgcccaactcgctcctcccagtgctgcttcggccttcgtgggtgccggcattgccggtgcggccattggcagcataggccttgggaaggtgcttgtggacattctggcgggctatggagcgggggtggccggtgcactcgtggcttttaaggtcatgagcggcgaggcgccctccgccgaggacctggttaacttgctccctgccatcctctcccccggcgccttggtcgtcgggatcgtgtgtgcagcaatcctgcgtcggcacgtgggccc

SEQ ID NO: 762 - DNA, 9448 bp, Hepatitis C Virus
gccagcccccgattgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggatggcgacaacctatccccaaggctcgccgacccgagggcagggcctgggctcagcccgggtacccttggcccctctatggcaatgagggcttggggtgggcaggatggctcctgtcaccccgcggctcccggcctagttggggccccacggacccccggcgtaggtcgcgtaacttgggtaaggtcatcgatacccttacatgcggcttcgccgatctcatggggtatattccgctcgtcggcgcccccctagggggcgctgccagggccttggcacacggtgtccgggttctggaggacggcgtgaactatgcaacagggaacttgcccggttgctctttctctatcttcctcttggctttgctgtcctgtttgaccatcccagcttccgcttatgaagtgcgcaacgtgtccgggatataccatgtcacgaacgactgctccaactcaagcattgtgtatgaggcagcggacatgatcatgcatactcccgggtgcgtgccctgcgttcgggaggacaacagctcccgttgctgggtagcgctcactcccacgctcgcggccaggaatgccagcgtccccactacgacaatacgacgccacgtcgacttgctcgttggggcggctgctttctgctccgctatgtacgtgggggatctctgcggatctgttttcctcgtctcccagctgttcaccttctcgcctcgccggcatgagacagtgcaggactgcaactgctcaatctatcccggccatttatcaggtcaccgcatggcttgggatatgatgatgaactggtcacctacaacagccctagtggtgtcgcagttgctccggatcccacaagctgtcgtggacatggtggcgggggcccactggggagtcctggcgggccttgcctactattccatggtagggaactgggctaaggtcctgattgtggcgctactcttcgccggcgttgacggggagacctacacgtcggggggggcggccagccacaccacctccacgctcgcgtccctcttctcacctggggcgtctcagagaatccagcttgtgaataccaacggcagctggcacatcaacaggactgccctaaactgcaatgactccctccacactgggttccttgccgcgctgttctacacacacaggttcaactcgtccgggtgcccggagcgcatggccagctgccgccccattgactggttcgcccagggatggggccccatcacctatactgagcctgacagcccggatcagaggccttattgctggcattacgcgcctcgaccgtgtggtatcgtacccgcgtcgcaggtgtgtggtccagtgtattgcttcaccccaagccctgttgtggtggggaccaccgatcgttccggtgtccctacgtatagctggggggagaatgagacagacgtgatgcttctcaacaacacgcgtccgccacaaggcaactggttcggctgtacatggatgaatagtactgggttcactaagacgtgcggaggccccccgtgtaacatcgggggggtcggtaaccacaccttgacctgccccacggactgcttccggaagcaccccgaggctacttacacaaaatgtggctcggggccctggttgacacctaggtgcctagtagactacccatacaggctctggcactacccctgcactttcaatttttccatctttaaggttaggatgtatgtggggggcgtggagcacaggctcaatgccgcatgcaattggactcgaggagagcgctgtaacttggaggacagggacaggtcagaactcagcccgctgctgctgtctacaacagagtggcagatactgccctgcgccttcaccaccctaccggctttgtccactggtttgatccatctccatcagaacatcgtggacgtgcaatacctgtacggtgtagggtcagcgtttgtctcctttgcaatcaaatgggagtacatcctgttgcttttccttctcctggcggacgcgcgcgtgtgtgcctgcttgtggatgatgctgctgatagcccaggctgaggccgccttagagaacttggtggtcctcaatgcggcgtccgtggccggagcgcatggtattctctcctttcttgtgttcttctgtgccgcctggtacattaagggcaggctggctcctggggcggcgtatgctttctatggcgtatggccgctgctcctgctcctactggcgttaccaccacgagcttacgccatggaccgggagatggctgcatcgtgcgggggcgcggttcttgtaggtctggtattcttgaccttgtcaccatactacaaagtgttcctcactaggctcatatggtggttacaatactttatcaccagagccgaggcgcacatgcaggtgtgggtcccccccctcaacgttcggggaggccgcgatgccatcatcctcctcacgtgtgcggtccatccagagctaatttttgacatcaccaaactcctgctcgccatactcggcccgctcatggtgctccaggctggcataacgagagtgccgtacttcgtgcgcgctcaagggctcattcgtgcatgcatgttagtgcggaaagtcgccgggggtcattatgtccaaatggccttcatgaagctgggcgcgctgacaggtacgtacgtttataaccatcttactccactgcgggactgggcccacgcgggcctacgagaccttgcggtggcagtagagcccgtcgtcttctccgacatggagaccaaggtcatcacctggggagcagacaccgcagcgtgtggggacatcatcttgggtctacccgtctccgcccgaagggggaaggagatatttttgggaccggccgatagtcttgaagggcaagggtggcgactccttgcgcccatcacagcctactcccaacaaacgcggggcgtacttggttgcatcatcactagcctcacaggccgggacaagaaccaggtcgagggggaggttcaagtggtttccaccgcaacacaatctttcctggcgacctgcatcaacggcgtgtgctggactgtctaccatggcgctggctcgaagaccctagccggtccaaaaggtccaatcacccaaatgtacaccaatgtagacctggacctcgtcggctggcaggcgccccccggggcgcgctccatgacaccatgcacctgtggcagctcggacctttatttggtcacgagacatgctgatgtcattccggtgcgccggcgaggcgacagcaggggaagtctactctcccccaggcccgtctcctacctgaagggctcctcgggtggtccattgctttgcccttcggggcacgttgtgggcgtcttccgggctgctgtgtgcacccggggggttgcgaaggcggtggacttcatacccgttgagtctatggaaactaccatgcggtctccggtcttcacagacaactcatcccccccggctgtaccgcagacattccaagtggcacatctgcacgctcctactggcagcggcaagagcactaaagtgccggctgcgtatgcagcccaagggtacaaggtgctcgtcctgaacccgtccgttgccgccaccttgggttttggggcgtatatgcccaaggcacatggtatcgaccctaacatcagaactggggtaaggaccattaccacgggcggccccattacgtactccacctatggcaagttccttgccgacggtggctgctccgggggcgcctatgacatcataatatgtgatgagtgccactcaactgactcgactaccatcttgggcatcggcacagtcctggaccaagcggagacggctggagcgcggcttgtcgtgctcgccaccgctacacctccgggatcggttaccgtgccacaccccaatatcgaggaaataggcctgtccaacaatggagagatccccttctatggcaaagccatccccattgaggccatcaagggggggaggcatctcattttctgccattccaagaagaaatgtgacgagctcgccgcaaagctgacaggcctcggactcaatgctgtagcatattaccggggccttgatgtgtccgtcataccgcctatcggagacgtcgctgtcgtggcaacagacgctctaatgacgggttttaccggcgattttgactcagtgatcgactgtaacacatgtgtcacccagacagtcgacttcagcttggatcccaccttcaccattgagacgacgaccgtgccccaagacgcggtgtcgcgctcgcagcggcgaggtagaactggcaggggtaggagtggcatctacaggtttgtgactccaggagaacggccctcgggcatgttcgattcttcggtcctgtgtgagtgctatgacgcgggctgtgcttggtatgagctcacgcccgctgagacctcggttaggttgcgggcttacctaaatacaccagggttgcccgtctgccaggaccatctggagttctgggagagcgtcttcacaggcctctcccacatagatgcccacttcctatcccagactaaacaggcaggagacaactttccttacctggtggcatatcaagctacagtgtgcgccagggctcaagctccacctccatcgtgggaccaaatgtggaagtgtctcatacggctaaaacctacactgcacgggccaacacccctgctgtataggctaggagccgtccaaaatgaggtcaccctcacacaccccataactaaatacatcatggcatgcatgtcggctgacctggaggtcgtcactagcacctgggtgctggtaggcggagtccttgcagctctggccgcatattgcctgacgacaggcagtgtggtcatcgtgggcaggatcatcttgtccgggaagccagctgtcgttcccgacagggaagtcctctaccaggagttcgatgagatggaagagtgtgcctcacaacttccttacatcgagcagggaatgcagctcgccgagcaatttaagcaaaaggcgctcgggttgttgcaaacggccaccaagcaagcggaggctgctgctcccgtggtggagtccaagtggcgagcccttgagaccttctgggcgaagcacatgtggaatttcatcagcgggatacagtacctagcaggcttatccactctgcctggaaaccccgcgatagcatcattgatggcatttacagcttctatcactagcccgctcaccacccaaaacaccctcctgtttaacatcttggggggatgggtggctgcccaactcgctcctcccagcgctgcgtcagctttcgtgggcgccggcatcgccggagcggctgttggcagcataggccttgggaaggtgctcgtggacatcttggcgggctatggggcaggggtagccggcgcactcgtggcctttaaggtcatgagcggcgaggtgccctccaccgaggacctggtcaacttactccctgccatcctctctcctggtgccctggtcgtcggggtcgtgtgcgcagcaatactgcgtcggcacgtgggcccgggagagggggctgtgcagtggatgaaccggctgatagcgttcgcttcgcggggtaaccacgtctcccccacgcactatgtgcctgagagcgacgctgcagcacgtgtcactcagatcctctctagccttaccatcactcaactgctgaagcggcttcaccagtggattaatgaggactgctctacgccatgctccggctcgtggctaagggatgtttgggattggatatgcacggtgttgactgacttcaagacctggctccagtccaagctcctgccgcggttaccgggagtccctttcctgtcatgccaacgcgggtacaagggagtctggcggggggacggcatcatgcaaaccacctgcccatgtggagcacagatcgccggacatgtcaaaaacggttccatgaggatcgtagggcctagaacctgcagcaacacgtggcatggaacgttccccatcaacgcatacaccacgggaccctgcacaccctccccggcgcccaactattccagggcgctatggcgggtggctgctgaggagtacgtggaggttacgcgtgtgggagatttccattacgtgacgggcatgaccactgacaacgtaaagtgcccatgccaggttccggcccccgaattcttcacggaggtggatggagtgcggttgcacaggtacgctccggcgtgcaaacctctcctacgggaggacgtcgcgttccaggtcgggctcaaccaatacttggtcgggtcgcagctcccatgcgagcccgaaccggacgtaacagtgcttacttccatgctcaccgacccctcccacattacagcagagacggctaagcgtaggctggctagagggtctcccccctccttagccagctcatcagctagccagttgtctgcgccttccttgaaggcgacatgcactacccaccatgactccccggacgctgacctcatcgaggccaacctcttgtggcggcaggagatgggcggaaacatcactcgcgtggagtcagagaataaggtagtaattctggactctttcgaaccgcttcacgcggagggggatgagagggagatatccgtcgcggcggagatcctgcgaaaatccaggaagttcccctcagcgttgcccatatgggcacgcccggactacaatcctccactgctagagtcctggaaggacccggactacgtccctccggtggtgcacggatgcccattgccacctaccaaggctcctccaataccacctccacggagaaagaggacggttgtcctgacagagtccaatgtgtcttctgccttggcggagctcgccactaagaccttcagcagctccggatcgtcggccgttgatagcggcacggcgaccgcccttcctgaccaggcctccgacgacggtgacaaaggatccgacgttgagtcgtactcctccatgccccctcttgaaggggagccgggggaccccgatctcagcgacgggtcttggtctaccgtgagtgaggaggctagtgaggacgtcgtctgctgctcaatgtcctatacgtggacaggcgccctgatcacgccatgcgctgcggaggaaagtaagctgcccatcaacccgttgagcaactctttgctgcgtcaccacaacatggtctacgccacaacatcccgcagcgcaagcctccggcagaagaaggtcacctttgacagactgcaagtcctggacgatcattaccgggacgtgctcaaggagatgaaggcgaaggcgtccacagttaaggccaagcttctatctatagaagaggcctgcaagctgacgcccccacattcggccaaatccaaatttggctatggggcaaaggacgtccggaacctatccagcagggccgttaaccacatccgctccgtgtgggaggacttgctggaagacactgaaacaccaattgacaccaccatcatggcaaaaaatgaggttttctgcgtccaaccagagaaaggaggccgcaagccagctcgccttatcgtattcccagacctgggagttcgtgtatgcgagaagatggccctttacgacgtggtctccacccttcctcaggccgtgatgggctcctcatacggatttcaatactcccccaagcagcgggtcgagttcctggtgaatacctggaaatcaaagaaatgccctatgggcttctcatatgacacccgctgttttgactcaacggtcactgagagtgacattcgtgttgaggagtcaatttaccaatgttgtgacttggcccccgaggccagacaggccataaggtcgctcacggagcggctttacatcgggggtcccctgactaattcaaaagggcagaactgcggttatcgccggtgccgcgcaagtggcgtgctgacgactagctgcggtaataccctcacatgttacttgaaggccactgcggcctgtcgagctgcaaagctccaggactgcacgatgctcgtgaacggagacgaccttgtcgttatctgtgaaagcgcgggaacccaggaggatgcggcggccctacgagtcttcacggaggctatgactaggtactccgccccccccggggatccgccccaaccagagtacgacctggagctgataacatcatgttcctccaacgtgtcagtcgcgcacgatgcatctggcaaaagggtatactacctcacccgtgaccccaccatcccccttgcacgggctgcgtgggagacagctagacacactccagtcaactcttggctaggcaatatcatcatgtatgcgcccgccctatgggcaaggatgattctgatgactcactttttctccatccttctagctcaagagcaacttgaacaagccctggattgtcagatctacggggcctgctactccattgagccacttgacctacctcagatcattgaacgactccatggtcttagcgcattttcactccacagttactctccaggtgagatcaatagggtggcttcatgcctcaggaaacttggggtaccacccttgcgagtctggagacatcgggccagaagtgtccgcgctaagctactgtcccagggggggagggccgccacttgtggcagatacctctttaactgggcagtaaggaccaagcttaaactcactccaatcccggctgcgtcccagctggacttgtccggctggttcgtcgctggttacagcgggggagacatatatcacagcctgtctcgtgcccgaccccgctggtttctgttgtgcctactcctactttctgtaggggtaggcatttacctgctccccaaccgatgaacggggagctaaccactccaggccaataggccatcccgtttttttttttttttttttttttttttttttttttt

SEQ ID NO: 763 - DNA, 9427 bp, Hepatitis C Virus
gccagcccccgattgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagtttccgggcggtggtcagatcgttggtggagtttacctgttgccgcgcaggggccccaggttgggtgtgcgcgcgactaggaagacttccgagcggtcgcaacctcgcggaaggcgacaacctatccccaaggctcgccggcccgagggcaggacctgggctcagcccgggtacccttggcccctctatggcaatgagggcatggggtgggcaggatggctcctgtcaccccgcggctctcggcctagttggggccccacggacccccggcgtaggtcgcgcaatttgggtaaggtcatcgataccctcacatgcggcttcgccgacctcatggggtacattccgctcgtcggcgcccccttagggggcgctgccagggccctggcacatggtgtccgggttctggaggacggcgtgaattatgcaacagggaatttgcccggttgctctttctctatcttcctcttggctctgctgtcctgtttgactgtcccagtttccgcttacgaagtgcgcaacgtatccgggggatatcatgtcacgaacgactgctccaactcaagcatcgtgtatgaggcagcggacgtgatcatgcataccccggggtgcgtgccctgcgtccgggagaacaactcctcccgttgctgggtagcgctcactcccacgctcgcggccaggaacaccaccgtccctaccacgacaatacgacgccacgtcgacttgctcgttgggacggccgctttctgctccgctatgtacgtgggggatctctgcggatctgtcttcctcgtctcccagctgttcaccttttcgcctcgccggcatgagacagtacaggactgcaattgctcaatctatcccggtcatttatcaggtcaccgcatggcttgggatatgatgatgaactggtcacctacagcagccctagtggtgtcgcagctactccggatcccgcaagctgtcgtggacatggtggcgggggcccactggggagtcctggcgggcctggcctactattccatggtggggaactgggctaaggttttgattgtgatgctactctttgccggcgttgacgggcaaacctatacgacggggggggcggttgcccgcaccaccaccgggttcgcgtccctcttctccgctgggtcgcaggagaacatccagcttataaacaccaatggcagctggcacatcaacaggactgccctgaactgcaacgactccctcaacactggatttcttgccgcgctgttctacacacacaagttcaactcatccagagccgagagcgtattggccagctgccgcttcatcgacgagttcgatcagggatggggccccatcacttacaccgagcgtaacagttcggaccagaggccttattgctggcactatccaccccgacagtgtggtatcatacccgcgtcggaggtgtgcggtccagtgtattgtttcaccccaagccctgttgtggtggggacaaccgatcggttcggtgtccctacatacagctggggggagaatgagacggacgtgctggttctcaacaacacgcggccgccgcagggcaactggttcggctgtacatggatgaatggcactggtttcaccaagacatgcgggggtcccccgtgtcacatcggggggcgcggcaacaacaccctgacttgccccacggactgcttccggaagcatcccgaggctacgtatacaaaatgtggttcggggccttggttgacacctaggtgcatggttgattacccatacaggctctggcactacccctgcactgtcaactttaccacctttaaggttaggatgtatgtggggggcgtggagcacaggctcattgctgcatgcaattggactcgaggagaccgttgtaacttggaggacagggatagatcagagcttagtccgctgctgctgtctacgacagagtggcagatactgccctgttccttcaccaccctaccggctctctccaccggtttgatccatctccatcagaacatcgtggacgtgcaatacctgtacggtatagggtctgctgttgtctccattgcaatcaggtgggaatatgtcctgttgcttttccttctcctggcggacgcgcgtgtctgtgcctgcttgtggatgatgctgctgatagcccaggctgaggccgccttagagaatctggtggtcctcaacgcagcgtctgtggctggagcgcacggcatcctctccttccttgtgttcttctgtgccgcctggtatattaaaggcaggctggtccccggggcggcgtatgctctctatggcgtatggccgctgctcctgctcctgctggcgttaccaccacgagcttacgccatggaccgggagatggctgcatcgtgcggaggcgcggtctttatgggtctagcattcctgactttgtcaccacactataaagtgtttctcgctaggcttatttggtggttacaatatctcctcactagggccgaggcgcacttgcatatgtggatcccccccctcaacgttcggggaggccgcgatgccatcatcctcctcgcatgtgcggcccatccagagctgatctttgacatcaccaaactcctgctcgccatacttggtccgctctacatgctccaggctggtataactgcagtgccgtactttgtgcgcgctcaagggctcattcgtgcatgcatgttggtgcgaaaagtcgctgggggtcattatgtccaaatggccttcatgaagctcgccgcactgacaggtacgtacgtttatgaccatcttactccactgcgggattgggcccacgcgggcctacgagaccttgcggtggcagtagagcccgttgtcttctctgacatggaaactaagatcatcacctggggggcggacactgcagcgtgtggggacattatcttgggtctacccgtctccgcccgaagggggagggagatacttctgggtccggccgatagtcttgaagggcaaggatggcgacttctagcgcctatcacggcctactcccaacagacccggggcctacttggttgcatcattactagcctcacaggccgggacaagaaccaggtcgagggggaagttcaagtggtttccaccgcaacacaatctttcctggcgacctgcatcaacggcgtgtgttggactgtctaccatggcgctggctcgaagaccctagccggcccaaaaggcccaatcacccaaatgtacactaatgtagaccaggacctcgtcggctggcaggcgccccccggggcgcgttccatgacaccgtgtacttgcggcagctcggacctctacttggtcacgagacatgctgatgttattccggtgcgccggcggggcgatggcagggggagcttactctcccccaggcctgtctcctacttgaagggttcttcgggtggtccactgctctgcccttcagggcacgctgtcggcatcttccgggctgctgtgtgcacccggggggttgctaaggcggtggacttcatacccgtcgagtctatggaaactaccatgcggtctccggtcttcacagacaactcctcccccccggcagtaccgcagacattccaagtggcccatctacacgctcccaccggcagtggcaagagcaccaaagtgccagctgcgtacgcagcccaagggtacaaggtactagtcctgaacccgtctgttgccgcgaccttaggttttggggcgtatatgtccaaggcatatggtaccgaccccaatgtcagaactggggtaaggaccatcaccacgggcagccccatcacgtactccacctacggcaagttccttgctgacggcggttgctctgggggcgcctacgacatcataatatgcgatgagtgccactcaactgactcgactaccatcttgggcatcggcacagtcctggaccaagcggagacggctggagcgcggctcgtcgtgctcgccaccgctacacctccggggtcggtcaccgtgccacacccaaatatcgaggaagtgggcctgtccaatactggggagatccccttctatggcaaagccatccccatcgaggtcatcaaggggggaaggcatctcatcttctgccattccaagaagaagtgtgacgagctcgccgcgaagctgtcggccctcggaatcaatgctgtagcatattaccggggtcttgatgtgtccgtcataccggctagcggagacgtcgttgtcgtggcaacagacgccctaatgacgggcttcaccggcgactttgactcagtcatcgactgtaacacatgtgtcacccagacagtcgatttcagcttggaccccaccttcaccattgagacgacgaccgtgccccaagacgcggtgtcgcgctcgcagcggcgaggcaggactggtaggggtagggcaggcatctacaggtttgtgactccgggagaacggccctcgggcatgttcgattcctcggtcctgtgtgagtgttatgactcgggctgtgcttggtacgaactcacgcccgctgagacctcggttaggttgcgggcatacctaaatacaccagggctgcccgtctgtcaggaccatctggagttctgggagagtgtcttcacaggcctcacccacatagatgcccacttcttgtcccaaactaagcaggcaggagacaacttcccctacctggtagcataccaagctacagtgtgcgccaggtctcaggccccacctccatcgtgggatcaaatgtggaagtgtctcatacggctcaagcccacactgcacgggccaacgcccctgctgtataggctaggagccgttcaaaatgaggtcaccctcacacaccccataaccaaattcatcatggcatgcatgtcggctgacctggaggtcgtcactagcacttgggtgctagtaggcggggtccttgcagctctggccgcgtactgcttgacaacaggcagcgtggtcattgtgggcaggatcatcttgtccgggaggccagccgtcattcccgacagggaagtcctctaccgggagttcgatgaaatggaagagtgcgcttcacacctcccttacatcgaacaggggatgctgctcgccgagcaattcaagcagaaggcgctcgggttgctgcaaatggccaccaaacaagcggaggctgctgctcccgtggtggagactaagtggcaagcccttgaggtcttctgggcaaagcacatgtggaacttcatcagcgggatacagtacttggcaggcttatccactctgcccgggaaccccgcgatagcatcactgatggcattcacatcctctatcaccagcccgctcaccacccaaagtaccctcctgtttaacatcctgggggggtgggtggctgcccagcttgccccccccagcgctgcttcggcttttgtgggcgctggcatcgccggtgcggccgttggcagcataggccttgggaaggtgcttgtggacatcctggcaggctatggagcaggggtggccggcgcactcgtggcctttaaggtcatgagtggcgaggtgccctccaccgaggatctggttaatttacttcctgccatcctgtctcctggcgccctggtcgtcggggttgtgtgcgcagcaatactgcgccgacacgtgggtccaggagagggggctgtgcagtggatgaaccggctgatagcgttcgcctcgcggggtaaccacgtctcccccacgcactatgtgcctgagagcgacgcagcacaacgtgttactcagatcctctccagccttaccatcactcagttgctaaagaggcttcaccagtggattaatgaggactgctccacgccatgctccggctcgtggctaagggatgtctgggactggatatgcacggtgctgacagacttcaagacctggctccagtccaagcttctgccgcggttaccgggcgtccctttcttctcgtgccaacgcgggtacaagggagtctggcggggggaaggcatcatgcaaaccacctgcccatgtggagcacagatcgccggacatgtcaaaaacggttccatgaggatcgtcgggcctagaacctgcagcaacacgtggcatggaacatttcccatcaacgcatacaccacgggcccttgctcgccctccccggcgccaaattattccagggcgctgtggcgggtggccgctgaggagtacgtggaggttacgcgggtgggggatttccactacgtgacgggcgtgaccactgacaacgtgaaatgcccatgccaggttccggcccctgaattcttcacagaattggatggggtgcggttgcacaggtacgctccggcgtgcaagcctctcctacgggatgaggtctcattccaggtcgggctcaaccaatacctggttggatcgcagctcccatgcgagcccgaaccggatgtagcagtgctcacttccatgctcaccgacccctcccacattacagcagagacggctaagcgtaggctggccagagggtctcccccctccttggccagctcttcagctagccagttgtctgcgccttccttgaaggcgacatgcaccatccatcatgactccccggacgccgacctcattgaggccaacctcctgtggcggcaggagatgggcgggaacatcacccgtgtggagtcagagaataaggtagtgatactggactctttcgaaccgattcgagcggaggaggatgagagggaagtatccgttccggcggagatcctgcggagatctaggaagttccccgcagcgatgcccatatgggcacgcccggattacaatcctcccctgctagagtcctggaaggatccggactacgttcctccggtagtacacggatgcccattgccacctaccaaggccgctccgataccacccccacggaggaagaggacgattgtcctgacagagtccactgtgtcttctgccttggcggagctcgctactaagaccttcggcggctccggatcgtcggccgccgacagcggcacggcgactgcccctcctgaccagacctccgacgacggcgacaaagaatctgacgttgagtcgtactcctccatgcccccccttgagggagagccgggggaccccgatctcagcgacgggtcttggtccaccgtgagcgaggaagccagtgaggacgtcgtctgctgctcgatgtcctacacatggacgggcgccctgatcacgccatgcgctgcggaggaaagcaagctgcccatcaacccgttgagcaactccttgctgcgtcaccacaatatggtgtacgccacaacatcccgcagcgcaagtctgcggcagaagaaggtcacctttgacagactgcaagtcctggacgatcactaccgggacgtgctcaaggagatgaaggcgaaggcgtccacagttaaggccaaacttctatctgtagaggaagcctgcaagctgacgcccccacattcggccaaatcaaaatttggctatggggcgaaggacgtccggagcctatccagcagggccgtcaaccacatcacctccgtgtggaaggacttgctggaagacactaagacaccaattgacaccaccatcatggcaaaaaatgaggttttctgcgtccaaccagagaaaggaggccgcaagccagctcgccttatcgtatttccagacctgggagttcgtgtatgcgagaagatggccctctacgacgtggtatccaccctccctcaggccgtgatgggctcctcatacgggttccagtattctcctgggcagcgggtcgagttcctggtgaaaacctggaaatcgaagaaatgccccatgggcttttcatatgacacccgctgctttgactcaacggtcactgagaatgacatccgtattgaggagtcgatttaccaatgttgtgacttggcccccgaagccaggcaggtcataaggtcgctcacagaacggctttatatcgggggtcccttgactaattcaaaagggcagaactgcggttatcgccggtgccgcgcaagcggcgtgctgacgactagctgcggcaatactctcacatgttacttgaaggcctctgctgcctgtcgagctgcgaagctccaggactgcacgatgctcgtgaacggagacgaccttgtcgttatctgtgagagcgcgggaacccaggaggatgcggcgagcctacgagtcttcacggaggctatgactaggtactctgccccccccggggacccgcctcaaccggaatatgacttggagttgataacatcatgttcctccaatgtgtcggtcgcgcacgatgcatccggcaaaagggtgtactacctcacccgtgaccccaccaccccccttgcgcgggctgcgtgggagacagctagacacactccagttaactcctggctgggcaacatcatcatgtatgcgcccaccttatgggcaaggatgattctgatgactcacttcttctccatccttctagcccaggagcaacttggaaaggccctagattgtcagatctacggggcctgttactccattgagccacttgacctacctcagatcattgagcgactccatggtcttagcgcattttcactccatagttactctccaggtgagatcaatagggtggcttcatgcctcaggaaacttggggttccacccttgcgagtctggagacatcgggccagaagtgtccgcgctaagctgctgtcccagggggggagggccgccacatgtggcaagtacctcttcaactgggcagtaaggaccaagcttaagctcactccaatcccagctgcgtcccagttggacttgtccagctggttcgttgctggttacagtgggggagacatatatcacagcctgtctcgtgcccgaccccgctggttcatgttatgcctactcctactttctgtaggggtaggcgtctacctgctccccaaccgctgaacggggagctaaacactccaggccaataggccgtccccttttttttttttttt

SEQ ID NO: 764 - DNA, 9487 bp, Hepatitis C Virus
gccagccccctgatgggggcgacactccgccatgaatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggattaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgttaagttcccgggtggcggccagatcgttggcggagtttacttgttgccgcgcaggggccccagagtgggtgtgcgcgcgacgaggaagacttccgagcggtcgcaacctcgcgggaggcgtcagcctattcccaaggcccgccgacccgagggaaggtcctgggcgcagcccgggtacccttggcccctctatggcaacgagggctgtgggtgggcgggatggctcctgtccccccgcggctctcggcctagttggggcccttctgacccccggcggaggtcacgcaatttgggtaaggtcatcgataccctcacgtgtggcttcgccgacctcatggggtacatcccgctcgtcggcgctcctctagggggcgctgccagagctctggcacatggtgttagagtcctggaagacggcgtgaattacgcaacagggaacctccccggttgctctttttctatcttcttgctcgctcttctatcctgcctgacagtccctgcttcggccgtcggagtgcgcaactcttcgggggtgtaccatgtcaccaatgattgccccaatgcgtccgttgtgtacgagacggagaacctgatcatgcatctgcccgggtgtgtgccctacgtacgcgagggcaacgcctcgaggtgttgggtctcccttagtcccaccgtagccgccagggattcgcgcgtccccgtcagtgaggttcggcgtcgtgtcgactcgattgtcggggccgctgcgttctgttcggctatgtatgtaggggacctatgcggctccatcttccttgttggccagatcttcaccttctctcccaggcaccattggacgacgcaagactgcaattgctccatctacccaggccatgtgacaggtcatcgaatggcttgggacatgatgatgaattggtcacccactggcgccttagtggtggcacagctactccggatcccacaagctatcgtggatatgatagctggtgcccactggggtgtcctagcgggcctggcatactactccatggtggggaactgggctaaggttgtggtcgtgctgctgctcttcgctggcgttgacgcagagacccgggtcacagggggggccgctggccacaccgcgttcgggtttgctagcttcctcgccccaggcgctaagcaaaagatccagctcataaataccaacggcagctggcacatcaacagaactgccttgaactgtaatgaaagcttggatactggctggctagcagggctgctctactaccacaagttcaactcctcagggtgtcccgagaggatggctagttgccaacctcttaccgccttcgaccaagggtggggacccatcactcacgaggggaatgctagtgatgaccagcggccatattgttggcactatgccctacgcccgtgtggcattgtgccagcgaaaaaggtttgcgggcctgtatactgtttcacacccagccccgtggtagtggggacgacggacagagccggcgttcctacctacagatggggtgccaatgagacggatgtactgctcctcaacaactctaggccgccaatggggaattggtttgggtgtacgtggatgaattctagtggcttcaccaagacgtgcggggctccggcctgcaacatcggcgggagcgggaacaataccctgctgtgcccaacagattgcttccgtaaacatccggatgccacatacagcaggtgcggctctggtccctggcttacccctcgatgcttggtagactacccatacaggctctggcactacccctgtacagtcaattacaccattttcaagatcaggatgtttgtgggcggggttgagcacaggcttgacgccgcgtgcaactggacgcggggagagcgctgcgatttggacgacagggatcgggccgagttgagccctctgttgctgtccactacgcaatggcaggtcctcccctgctcattcacaacactgcccgccctgtcaactggcctgatacatctccaccagaacatcgtggacgtgcagtacctctatgggttgagctcggcagtcacatcctgggtcataaagtgggagtacgttgtgctcctcttcttgctgctagcagatgctcgcatttgtgcctgcttgtggatgatgcttctcatatctcaggtagaggcggcgctggagaacttgatagttctcaacgctgcttccctagtcgggacacatggcatcgtccccttcttcatctttttttgtgcagcttggtacctaaaaggcaagtgggcccctggactcgcctattccgtctatgggatgtggccactgctcctgcttctcctggcgttgccccaacgggcatacgccttggatcaggagttggccgcgtcgtgtggggccacggtcttcatctgcctagcggtgctcactctatcgccatattacaaacagtacatggcccgcggcatctggtggctgcagtacatgctgaccagagcagaggcgctcctacaggtttgggtccccccgctcaacgcccgaggagggcgcgacggagtcgtactgctcacgtgtgtgctccacccgcacttgctctttgaaatcaccaagatcatgctggccattctcgggcctttgtggatcttgcaggccagtctgctcaaggtaccgtacttcgtgcgtgcccacggtctcattaggctctgcatgctggtgcgcaagacagcgggcggtcagtatgtgcagatggctctgttaaagctgggagcatttgccggcacctacatttacaaccacctttccccgctccaagactgggctcacagcggtctgcgcgacctggcggtagccactgaacccgtcatcttctcccggatggaaatcaagactatcacctggggggcggatactgcggcttgtggagacatcatcaacgggctgcctgtttccgcccggagagggagagaggtgttgctgggaccagccgatgccctgactgacaaaggatggaggcttttagcccccatcacggcttacgcccagcagacacggggtctcttgggctgcatcatcaccagcctcaccggtcgggacaaaaatcaagtggagggggaagtccagattgtgtctaccgcaacccagacgttcttggctacttgtgttaatggagtttgctggactgtgtatcatggggccggatcgaggaccatcgcttcggcgtcgggccctgtgatccagatgtacactaatgtggaccaggatttggtgggctggccagcgcctcagggagcgcgctccctgacgccgtgcacatgcggcgcctcggatctgtacttggtcacgaggcacgcggacgtcattccagtgcggcgtcggggcgataacaggggaagtttactatctccccggccaatttcatatctaaagggatcctcgggaggccccctgctctgtcccatgggacatgccgtgggcattttcagggccgcggtgtgcacccgtggggtcgcaaaggcggtcgactttgtgcccgttgaatccctagagaccaccatgaggtccccagtgtttaccgacaattccagccctccgacagtgccccagagctaccaggtggcgcatctgcacgctcccactggaagtggtaagagcacgaaggtgccggccgcctatgcggctcaagggtacaaggttcttgtgctgaacccgtctgttgctgccaccctagggttcggcgcttatatgtcaaaggcccatgggattgacccaaacgtcaggactggcgtaaggaccattaccacaggctcccccatcacccactccacctacggcaaattcctggctgacggtgggtgttcaggaggtgcgtatgacatcataatatgtgacgaatgtcactcagtggacgccacctcgattctaggcatagggactgtcttggaccaagcggagacagcgggggttaggctcactatcctcgccaccgctacaccacctggctccgtcaccgtgccacattccaacatcgaggaagttgcattgtccactgagggggagataccattctatggtaaggccatccccctaaattacatcaagggggggaggcatctcattttctgtcattccaagaagaagtgcgacgagctcgctgcaaagctggttggcctgggcgtcaacgcagtggccttttaccgcggcctcgacgtgtctgtcatcccaaccacaggagacgtcgttgttgtggcgaccgacgccttaatgactggctacaccggcgatttcgactccgtgatagactgcaacacctgtgtcgtccagacagtcgatttcagcctagaccctacattctctattgagacttccaccgtgccccaggacgccgtgtcccgctcccaacggagaggtagaaccggtcgggggaagcatggtatctacagatatgtgtcacccggggagcggccgtctggcatgtttgactccgtggtcctctgtgagtgctatgacgcgggttgtgcttggtatgagcttacacccgccgagaccacggttaggttacgggcatatcttaacaccccagggttgcccgtgtgccaggaccacttggagttttgggagagcgtcttcaccggcctcacccacatagatgcccacttcctgtctcagacgaaacagagcggggaaaatttcccctacctagtcgcataccaagccaccgtgtgcgctagagctaaagctcctcccccgtcatgggaccaaatgtggaagtgcttgatacggctcaagcccaccctcactggggctacccccctactatacagactgggtggtgtgcagaatgagatcaccctaacacacccaatcaccaagtacatcatggcttgtatgtcggctgacctggaggtcgtcactagcacgtgggtgctggtgggcggcgtcctggccgctttggccgcttactgcctgtctacaggcagcgtggtcatagtgggcaggataatcctaagcgggaagccggcagtcattcctgacagggaggttctctaccgagagtttgatgagatggaagagtgcgccgcccacatcccctaccttgagcaggggatgcatttggctgaacagttcaagcagaaagctctcgggttgctccagacagcatccaagcaagcagagacgatcactcccgctgtccataccaattggcagaaactcgagtccttctgggctaagcacatgtggaacttcgtcagcgggatacaatacctggcgggcctgtcaacgctgcccggtaatcccgctatagcgtcgctgatgtcgtttacagccgcggtgacgagtccactaaccacccagcaaaccctcctctttaacatccttggggggtgggtggccgcccagcttgccgccccagctgccgccactgctttcgtcggcgctggtattaccggcgctgtcatcggcagtgtgggcctagggaaggtcctagtggacattcttgctggctacggggctggtgtggcgggggcccttgtggctttcaagatcatgagcggggaggcccccaccgccgaggatctagtcaaccttctgcctgccatcctctcgccaggagctctcgttgtaggcgtggtgtgcgcagcaatactacgccggcacgtgggccctggcgagggcgcggtgcagtggatgaaccgactgatagcgtttgcttctcggggtaaccacgtctcccctacacactatgtgccagagagcgacgcgtcagtccgtgtcacacatatcctcaccagcctcactgtcactcagctcctgaaaaggctccacgtgtggataagctcagattgcaccgccccgtgtgctggttcttggctcaaagatgtctgggactggatatgcgaggtgctgagcgacttcaagagttggctgaaggccaaacttatgccgcaactgcccgggatcccattcgtatcctgtcaacgcgggtaccgtggggtctggcggggcgaaggcatcatgcacgcccgttgcccgtgtggagccgatataactggtcatgtcaaaaacggttcgatgagaatcgtcggccctaagacttgcagcaacacctggcgtgggtcgttccccatcaacgcccacactacgggcccttgcacaccctccccagcgccgaactacacgttcgcgttatggagggtgtcggcagaggagtatgtggaggtaaggcggctgggggatttccattacatcacgggggtgaccactgataagatcaagtgtccatgccaggtcccctcgcccgagttcttcacagaggtggatggggtgcgcctacataggtacgcccccccctgcaaacccctgctacgggatgaggtgacgtttagcatcgggctcaatgaatacttggtggggtcccagttgccctgcgagcccgagccagacgtagctgtactgacatcaatgcttacagacccctcccacatcactgcagagacggcggcgcgtagactgaatcgggggtctcccccctccctggctagctcttctgccagccaattgtctgcgccgtccctgaaagcaacatgtaccacccaccatgactctccagacgctgacctcataacagccaacctcctgtggaggcaggagatgggggggaacattaccagagtggagtcggagaataagatcgtcatcctggattctttcgacccgctcgtggcggaggaggatgatcgggagatttctgtcccagctgagattctgctgaagtctaagaagtttccccccgccatgcctatatgggcacggccagattataatcctccccttgtggaaccatggaagcgcccggactacgaaccacccttagttcacgggtgccccctaccacctcccaaaccaactccggtgccgccaccccggagaaagaggacagtggtgctggatgagtctacagtatcatctgctctggctgagcttgccactaagacctttggcagctctacaacctcaggcgtgacaagtggtgaagcggccgaatcgtccccggcgccttcctgcgacggtgaactggactccgaagctgaatcttactcctccatgccccctctcgagggggaaccgggggaccccgatctcagcgacgggtcttggtctaccgtaagcagtgatggcggtacggaggacgtcgtgtgctgctcgatgtcctactcgtggacgggcgccctaattacgccctgtgccgcagaggaaaccaaactccccatcaacgcactgagtaactcgctgctgcgccaccacaatttggtgtattccaccacctctcgcagcgctggccagaggcagaaaaaagtcacatttgacaggctgcaggtcctggacgatcattaccgggacgtgctcaaggaggctaaggccaaggcatccacagtgaaggctaaattgctatccgtagaggaggcatgtagcctgacgcccccgcactccgccagatcaaaatttggctatggggcgaaggatgtccgaagccattccagtaaggccatacgccacattaactccgtgtggcaagaccttctggaggacaatacaacacctatagacactaccatcatggcaaagaatgaggtcttctgcgtgaagcccgaaaaggggggccgcaagcccgctcgtcttatcgtgtaccccgacctgggagtgcgcgtatgcgagaagagggctttgtatgacgtagtcaaacagctccccattgccgtgatgggaacctcctacgggttccagtactcaccagcgcagcgggtcgacttcctgcttaatgcgtggaaatcaaagaaaaatcctatggggttttcctatgacacccgttgctttgactcgacagtcactgaggctgatatccgtacggaggaagacctctaccaatcttgtgacctggtccctgaggcccgcgcggccataaggtctctcacagagaggctttacatcgggggcccgcttaccaactctaagggacaaaactgcggctatcggcgatgccgcgcgagcggcgtgctgaccactagctgcggtaacaccataacctgttatctcaaggccagtgcagcctgtcgagctgcaaagctccgggactgcactatgctcgtgtgcggcgacgacctcgtcgttatctgtgagagcgccggtgtccaggaggacgctgcgaacctgagagccttcacggaggctatgaccaggtactccgcccccccgggagacccgcctcaaccagaatacgacttggagcttataacatcttgttcctccaatgtttcagtcgcgcacgacggcgctggcaaaagggtctactatctgacccgtgatcctgagactcccctcgcgcgtgccgcttgggaaacagcaagacacactccagtgaactcctggctaggcaacatcatcatgtttgcccccactctgtgggtacggatggtccttatgacccattttttctccatactcatagcccaggaacaccttgaaaaggctctagattgtgaaatctatggggccgtgcactccgtccaaccgttagatctacctgaaatcattcaaagactccacggcctcagcgcgttctcgctccatagttactctccaggtgaaatcaatagggtggctgcatgcctcaggaaacttggggttccgcccttgcgagcttggagacaccgggcccggagcgtccgcgccacactcctatcccagggggggagagccgctatatgcggtaagtatctcttcaactgggcggtgaaaaccaaactcaaactcactccattaccgtccgcgtctcagttggacttgtccaattggttcacgggcggttacagcgggggagacatttatcacagcgtgtctcatgtccggccccgctggttcttctggtgcctactcctactttcagtgggggtaggcatttacctccttcccaaccggtagacggttgggcaaccactccaggcctttaggccctgtttaaacactccaggcctttaggccccgttttttttttttttttttttttttttttttttttttttttttttttt

SEQ ID NO: 765 - DNA, 6935 bp, Hepatitis C Virus
gaattcagccatggctgcgcgcgtctgtgcctgcttgtggatgatgctgctgatagcccaggctgaggccaccttagagaacctggtggtcctcaatgcggcgtctgtggccggagcgcatggccttctctccttcctcgtgttcttctgcgccgcctggtacatcaaaggcaggctggtccctggggcggcatatgctctctatggcgtatggccgttgctcctgctcttgctggctttaccaccacgagcttatgccatggaccgagagatggctgcatcgtgcggaggcgcggtttttgtaggtctggtactcttgaccttgtcaccatactataaggtgttcctcgctaggctcatatggtggttacaatattttatcaccagggccgaggcgcacttgcaagtgtgggtcccccctcttaatgttcggggaggccgcgatgccatcatcctccttacatgcgcggtccatccagagctaatctttgacatcaccaaactcctgctcgccatactcggaccgctcatggtgctccaggctggcatgactagagtgccgtactttgtacgcgctcaggggctcatccgtgcatgcatgttagtgcggaaggtcgctggaggccactatgtccaaatggccttcatgaagctggccgcgctgacaggtacgtacgtatatgaccatcttactccactgcgggattgggcccacgcgggcctacgagaccttgcggtggcagtagagcccgtcgtcttctctgacatggagactaagatcatcacctggggggcagacaccgcggcgtgtggggacatcatctcgggtctaccagtctccgcccgaagggggaaggagatacttctaggaccggccgatagttttggagagcaggggtggcggctccttgcgcctatcacggcctattcccaacaaacgcggggcctgcttggctgtatcatcactagcctcacaggtcgggacaagaaccaggtcgatggggaggttcaggtgctctccaccgcaacgcaatctttcctggcgacctgcgtcaatggcgtgtgttggaccgtctaccatggtgccggctcgaagaccctggccggcccgaagggtccaatcacccaaatgtacaccaatgtagaccaggacctcgtcggctggccggcgccccccggggcgcgctccatgacaccgtgcacctgcggcagctcggacctttacttggtcacgaggcatgccgatgtcattccggtgcgccggcgaggcgacagcagggggagtctactctcccctaggcccgtctcctacctgaagggctcctcgggtggaccactgctttgcccttcggggcacgttgtaggcatcttccgggctgctgtgtgcacccggggggttgcgaaggcggtggacttcatacccgttgagtctatggaaactaccatgcggtctccggtcttcacagacaactcatcccctccggccgtaccgcaaacattccaagtggcacatttacacgctcccactggcagcggcaagagcaccaaagtgccggctgcatatgcagcccaagggtacaaggtgcgcgtcctaaacccgtccgttgctgccacattgggctttggagcgtatatgtccaaggcacatggcatcgagcctaacatcagaactggggtaaggaccatcaccacgggcggccccatcacgtactccacctatggcaagttccttgccgacggtggatgctccgggggcgcctatgacatcataatatgtgacgaatgccactcaactgactggacaaccatcttgggcatcggcacagtcctggatcaggcagagacggctggagcgcggctcgtcgtgctcgccaccgccacgcctccgggatcgatcaccgtgccacaccccaacatcgaggaagtggccctgtccaacactggggagattcccttctatggcaaagccatccccattgaggccatcaaggggggaaggcatctcatcttctgccattccaagaagaagtgtgacgagctcgccgcaaagctgacaggcctcggactcaacgctgtagcgtattacaggggtctcgatgtgtccgtcataccgactagcggagacgtcgttgtcgtggcaacagacgctctaatgacgggctttaccggcgactttgactcagtgatcgactgcaacacatgtgtcacccagacagtcgatttcagcttggatcccaccttcaccattgagacgaccaccgtgccccaagacgcggtgtcgcgctcgcagcggcgaggtaggactggcaggggcaggagtggcatctacaggtttgtgactccaggagaacggccctcaggcatgttcgactcctcggtcctgtgtgagtgctatgacgcaggctgcgcttggtatgagctcacgcccgctgagactacagtcaggttgcgggcttacctgaatacaccagggttgcccgtctgccaggaccatctggagttctgggaaagcgtcttcacaggcctcacccacatagatgcccacttcctgtcccaaaccaagcaggcaggagacaacttcccctacctggtggcataccaagccacggtgtgcgccagggctcaggctccacctccatcgtgggatcaaatgtggaagtgtctcatacggcttaaacctacgctgcacgggccaacacccctgctgtataggctaggagccgttcaaaatgagatcaccctcacacatcccataaccaaattcgtcatggcatgcatgtcggccgacctggaggtcgtcactagcacctgggtgctggtaggcggagtccttgcagctctggccgcatattgcctgacaaccggtagtgtggtcattgtgggtaggatcattttgtccgggaggccggctgttgttcccgacagggaagtcctctaccgggagttcgatgaaatggaagagtgcgcctcacacctcccttacatcgagcaaggaatgcagctcgccgagcagttcaagcagaaggcactcgggttgctgcaaacagccaccaagcaagcggaggccgctgctcccgtggtggagtccaggtggcgggcccttgaggccttctgggcaaagcacatgtggaacttcatcagcgggatacagtacttagcaggcttatccactctgcctgggaaccccgcgatagcatcactgatggcattcacagcctctatcaccagtccgctcaccacccagaataccctcctattcaacatcttagggggatgggtggctgctcaactcgctcctcccagtgctgcttcggccttcgtgggtgccggcattgccggtgcggccattggcagcataggccttgggaaggtgcttgtggacattctggcgggctatggagcgggggtggccggtgcactcgtggcttttaaggtcatgagcggcgaggcgccctccgccgaggacctggttaacttgctccctgccatcctctcccccggcgccttggtcgtcgggatcgtgtgtgcagcaatcctgcgtcggcacgtgggcccgggagagggggctgtgcagtggatgaaccggctgatagcgttcgcttcgcggggtaaccacgtttcccccacgcactacgtgcctgagagcgacgccgcagcacgtgtaactcagatcctctccagcctcaccatcactcagctgctgaagaggcttcaccagtggattaatgaggactgctccacgccatgctccggctcgtggctaagggatgtttgggactggatatgcacggtgttgactgacttcaagacctggctccagtccaagctcctgccgaaattgccgggagtccctttcttctcatgccaacgcgggtacaagggagtctggcggggggacggcatcatgcaaaccacctgcccatgtggagcacaaattaccggacatgtcaaaaacggttccatgaggatcgttgggcctaaaacctgcagcaacacgtggcacggaacgttccccatcaacgcgtacaccacaggcccctgcacaccctccccggcgccgaactattccagggcgctgtggcgggtggctgctgaagagtacgtggagattacgcgggtgggggacttccactacgtgacgggtatgaccaccgacaacgtaaaatgcccgtgccaggtcccggcccccgaattcttcactgaattggacggggtgcggttgcacaggtacgctccggcgtgcagacctctcctacgggtggatgtcacattccaggtcgggctcaaccaatacctggttgggtcacagctcccatgcgagcctgagccggatgtggcagtgctcacttccatgctcaccgacccctcccacattacagcagagacggctaaacgtaggccggccagggggtctcccccctccttggccagctcttcagctagccaattgtctgcgccttccttgaaggcaacatgcactacccaccatgactccccggacgctgacctcatcgaggccaacctcctgtggcggcaggagatgggcggaaacatcacccgtgtggagtcagagaataaggtggtaattttggactctttcgacccgcttcgagcggaagaggatgagagggaagtatccgttgcagcagagatcctgcgaaaatccaagaagttcccccccgcgttgcccatatgggcacgcccggattacaaccctccactgttagagtcctggaaaagtccggactacgtccctccggcggtgcatgggtgcccattgccgcctaccacgggccctccaataccgcctccacggaaaaagaggacggttgttctgacagagtccaccgtgtcttctgccttggcggagctggctactaagactttcggcagctccggatcgtcggccgttgacagcggcacggcgaccgcccctcccgatcagacctctgacgacggtgacaaagaatctgacattgagtcgtactcctccatgcccccccttgagggggagccgggggaccctgatctcagcgacgggtcttggtctaccgtgagcggggaggccggcgacgacatcgtctgctgctcaatgtcctacacatggacaggtgccttgatcacgccatgcgctgcggaggagagcaagttgcccatcaatccgttgagcaactctttgctgcgtcaccacagtatggtctactccacaacatctcgcagcgcaagtctgcggcagaagaaggtaacctttgacagaatgcaagtcctggacgaccactaccgggacgtgctcaaggagatgaaggcgaaggcgtccacagttaaggctaggcttctatctatagaggaggcctgcaaactgacgcccccacattcggccaaatccaaatttggctacggggcgaaggacgtccggagcctatccagcagggccgtcaaccacatccgctccgtgtgggaggacttgctggaagacactgaaacaccaattgataccaccatcatggcaaaaaatgaggttttctgcgtccaaccagagaaaggaggccgcaagccagctcgccttatcgtattcccagacctgggggtacgtgtatgcgagaagatggccctttacgacgtggtctccacccttcctcaggccgtgatgggcccctcatacggattccagtactctcctgggcagcgggtcgagttcctggtgaatacctggaaatcaaagaaatgccctatgggcttctcatatgacacccgctgctttgactcaacggtcactgagaatgacatccgtactgaggagtcaatctaccaatgttgtgacttggcccccgaagccagacaggccataaagtcgctcacagagcggctctacatcgggggtcccctgactaattcaaaagggcagaactgcggttatcgccggtgccgcgcgagcggtgtgctgacgactagctgcggcaataccctcacatgctacttgaaagccactgcggcctgtcgagctgcaaagctccaggactgcacgatgctcgtgaacggagacgaccttgtcgttatctgcgaaagcgcgggaacccaggaggatgcggcgagcctacgagtcttcacggaggctatgactaggtactctgccccccccggggacccgccccaaccagaatacgacttggagctgataacgtcatgctcctccaatgtgtcggtcgcgcacgatgcatccggcaaaagggtgtactacctcacccgtgaccccaccacccccctcgcacgggctgcgtgggagacagttagacacactccagtcaactcctggctaggcaatatcatcatgtatgcgcccaccctatgggcgaggatgattctgatgactcatttcttctctatccttctagctcaggagcaacttgaaaaagccctggattgtcagatctacggggcctgctactccattgagccacttgacctacctcagatcatcgaacgactccatggtcttagcgcattttcactccatagttactctccaggtgagatcaatagggtggcttcatgcctcaggaaacttggggtaccgcccttgcgagtctggagacatcgggccagaagtgtccgcgctaagctgctgtcccagggggggagggccgccacatgcggcaaatacctcttcaactgggcagtaaggaccaagcttaagctcactccaatcccagctgcgtcccagttggacttgtccagctggttcgttgctggttacagtgggggagacatatatcacagcctgtctcgtgcccgaccccgctggttcatgttatgcctactcctactttctgtaggggtaggcgtctacctgctccccaaccggtgaacggggagctaaccactccaggccaataggccattcccttttttttttttcggaattcgtcgacaagctt

SEQ ID NO: 766 - DNA, 9456 bp, Hepatitis C Virus
acctgcctcttacgaggcgacactccaccatggatcactcccctgtgaggaacttctgtcttcacgcggaaagcgcctagccatggcgttagtacgagtgtcgtgcagcctccaggaccccccctcccgggagagccatagtggtctgcggaaccggtgagtacaccggaatcgctggggtgaccgggtcctttcttggagcaacccgctcaatacccagaaatttgggcgtgcccccgcgagatcactagccgagtagtgttgggtcgcgaaaggccttgtggtactgcctgatagggtgcttgcgagtgccccgggaggtctcgtagaccgtgcaacatgagcacacttcctaaacctcaaagaaaaaccaaaagaaacaccatccgtcgcccacaggacgtcaagttcccgggtggcggacagatcgttggtggagtatacgtgttgccgcgcaggggcccacgattgggtgtgcgcgcgacgcgtaaaacttctgaacggtcacagcctcgcggacgacgacagcctatccccaaggcgcgtcggagcgaaggccggtcctgggctcagcccgggtacccttggcccctctatggtaacgagggctgcgggtgggcagggtggctcctgtccccacgcggctcccgtccatcctggggcccaaatgacccccggcggaggtcccgcaatttgggtaaagtcatcgataccctaacgtgcggattcgccgacctcatggggtacatcccgctcgtcggcgctcctgtaggaggcgtcgcaagagccctcgcgcatggcgtgagggcccttgaagacgggataaatttcgcaacagggaacttgcccggttgctccttttctatcttccttcttgctctgttctcttgcttaattcatccagcagccagtctagagtggcggaatacgtctggcctctacgtccttaccaacgactgttccaatagcagtattgtgtatgaggccgatgatgtcattctgcacacacccggctgtgtaccttgtgtccaggacggcaatacatctacgtgctggaccccagtgacacctacagtggcagtcaggtacgtcggagcaactactgcttcgatacgcagtcatgtggacctattagtaggcgcggccacgatgtgctctgcgctctacgtgggtgatatgtgtggggctgtctttctcgtgggacaagccttcacgttcagacctcgacgccatcaaacggtccagacctgtaactgctcgctgtacccaggccatctttcaggacatcgaatggcttgggatatgatgatgaattggtcccccgctgtgggtatggtggtggcgcatgtcctgcgtttaccccagaccttgttcgacataatggccggggcccattggggcatcttggcgggcctggcctattactccatgcagggcaactgggccaaggtcgcaatcatcatggttatgttctcaggggtcgatgcccacacatataccaccggtggcactgcatctcgtcatacccaagcgtttgctggtctttttgacataggcccccaacagaaactgcagctggtcaacaccaatggctcgtggcacatcaacagtactgccctaaattgcaatgagtccataaacaccgggtttatagctgggttgttttattaccataagttcaactctactggatgtcctcaaaggctcagcagctgcaagcccatcactttcttcaggcagggatggggccccttaacagatgctaacatcaccggtccttctgatgacagaccatactgctggcactacgcacctagaccttgtgacattgtcccggcatcaagtgtctgcggccctgtgtactgcttcacaccatcgccagtggtcgtaggcactactgatgccaggggcgtgccaacctacacctggggtgagaatgagaaagatgtgttcctgctgaagtcccagcggcctcccagtggtcggtggtttgggtgctcgtggatgaactccacggggtttctcaagacgtgcggagctcccccctgtaacatctatgggggcgaggggaatccccacaatgaatcagatcttttctgccccactgactgcttcaggaaacatcccgagaccacgtacagccggtgtggtgcagggccctggttgacacctcgttgcatggttgactacccataccggctttggcattacccatgtacagtcgatttcagattgttcaaggtgaggatgtttgtgggtgggtttgaacatcgatttaccgccgcttgcaactggaccaggggggagcgctgcgatatcgaggatcgtgaccgcagtgagcaacatccgctgctgcattcaacaactgagcttgctatactgccttgctctttcacgcccatgcctgcgctgtcaacaggtctgatacacctccaccaaaacatcgtggatgtccaatacctttatggcgttggatctggcatggtgggatgggcgctgaaatgggagttcgtcatcctcgttttcctccttctggcggacgcacgcgtgtgcgttgccctttggctgatgctgatgatatcacagacagaagcagccttggagaacctggtcacgctgaacgccgtcgctgctgctgggacacatggtatcggctggtacctggtagctttttgcgcggcgtggtacgtgcggggtaaactcgtcccgctggtgacctacagcctgacgggtctttggtccctagcattgctcgtcctcttgctcccccaacgtgcgtatgcttggtcgggtgaagacagcgccactcttggcgctggggtcttggtcctcttcggcttctttaccttgtcaccctggtataagcattggatcggccgcctcatgtggtggaaccagtacaccatatgcagatgcgagtccgcccttcacgtgtgggttccccccttactcgcacgcgggagtagggatggtgtcatcctgctaacaagcctgctttatccatccttaatttttgacatcactaagctgctgatggcagtattgggcccattatacttaatacaggctaccattactaccaccccctactttgtgcgtgcgcatgtactggtccgcctttgcatgctcgtgcgctccgtgataggggggaaatacttccagatgatcatactgagcattggcagatggttcaacacctacctatacgaccacctagcgccaatgcaacactgggccgctgctggtctcaaagacctagcagtggccactgaacctgtaatatttagtcccatggaaatcaaggtcatcacctggggtgcggatacagcggcttgcggagatattctttgcgggctgcccgtctctgcacgattaggccgtgaggtgttgttgggacctgctgatgactatcgggagatgggctggcgtctgttggccccgattacagcatacgcccagcaaactaggggccttcttgggactattgtgactagcttgactggcagagacaagaacgtggtgaccggtgaagtgcaggtgctttctacggctacccagaccttcctaggtacaacagtagggggggttatatggactgtttatcatggagcaggttcgagaacgctcgcgggcgccaaacatcccgcgctccaaatgtacacaaatgtagatcaggacctcgttgggtggccagcccctccaggggccaagtctcttgaaccgtgcgcctgcgggtcttcagacttatacttggttacccgcgatgccgatgtcatccctgctcggcgcagaggggactccacagcgagcttgctcagtcctaggcctctcgcctgtctcaagggttcctctggaggtcccgttatgtgcccttcggggcatgttgcggggatctttagggctgctgtgtgcaccagaggtgtagcaaaatccctacagttcataccagtggaaacccttagcacgcaggctaggtctccatctttctctgacaattcaactcctcctgctgttccacagagctatcaagtaggatacctccatgccccgaccggcagcggtaagagcacaaaggtcccggccgcttatgtagcacaaggatataatgtcctcgtactaaatccatcggtggcggccacattaggcttcggctccttcatgtcgcgtgcctatgggatcgaccccaacatccgcactgggaaccgcaccgttacaactggtgctaaactgacctattccacctacggtaagtttctcgcggacgggggttgctccgggggggcatatgatgtgattatctgtgatgaatgtcatgcccaagacgctactagcatattgggtataggcacggtcttagatcaggctgagacggctggggtgaggctgacggttttagcgacagcaactcccccaggcagcatcactgtgccgcattctaacatcgaagaagtggccctgggctctgaaggtgagatccctttctacggtaaggctataccgatagccctgctcaagggggggaggcaccttatcttttgccattccaagaaaaaatgtgatgagatagcgtccaaactaagaggcatggggctcaacgctgtagcatactataggggtctcgatgtgtccgtcataccaacaacaggagacgtcgtagtttgcgctactgacgccctcatgactggattcaccggggacttcgattctgtcatagattgcaacgtggctgttgaacagtacgttgacttcagcctggaccccaccttttccattgagacccgcactgctccccaagatgcggtttcccgcagccaacgtcgcggccgaacgggtcgaggtagactcggtacgtaccgatatgtcgcctccggtgaaagaccgtctggaatgtttgactcggtcgtcctctgtgagtgctatgacgcgggctgctcatggtacgatctgcagcccgctgagaccacagttagactgagagcttacttgtccacacccgggttacccgtctgccaagaccatttagacttttgggagagcgtcttcactggactaactcacatagatgcccactttctgtcacagactaagcagcagggacttaacttctcgtacctaactgcctaccaagccactgtgtgcgcccgcgcgcaggctcctcccccaagttgggacgagatgtggaagtgtctcgtgcggcttaagccaacactacatggacctacgccccttctatatcggctggggcctgtccaaaatgaaacctgcttgacacaccccatcacaaaatacctcatggcatgcatgtcagccgatctggaagtaaccaccagcacctgggtgttgctcggaggggtcctcgcagccctagcggcctactgcttgtcagtcggctgcgttgtgattgtgggtcatattgagctggagggcaagccagcactcgttccagacaaagaggtgttgtatcaacaatacgatgagatggaggagtgctcacaagctgccccatatatcgaacaagctcaggtaatagcccaccagttcaaggaaaaaatccttggattgctgcagcgagccacccagcaacaagctgtcattgagcccatagtaactaccaactggcaaaagcttgaggccttctggcacaagcatatgtggaattttgtgagtgggatccaatacctagcaggcctctccactttgcctggcaaccctgctgtggcgtctcttatggcgttcactgcttcagtcaccagtcccctgacgaccaaccaaactatgttttttaacatactcggggggtgggttgccacccatttggcagggccccagagctcctccgcgttcgtggtaagcggcttggcaggcgctgccatagggggtataggcctgggcagggtcttgcttgacatcctggcaggatacggagctggtgtctcaggcgccttggtagcttttaagatcatgggaggagaatgccccactgctgaggacatggtcaacctgttgcccgccatactatctccgggtgctctcgtcgtcggtgtgatatgcgcagccatactgcgccgacacgtaggacctggggagggagcggtacagtggatgaacaggctcatcgcgttcgcatcccggggcaaccacgtctcaccgacgcactatgttcccgagagcgatgctgcggcaagggtcaccgcattgctgagttctctaactgtcacaagtctgctccggcggttacaccagtggatcaatgaagactacccaagcccttgtagcgacgattggctacgtaccatctgggactgggtttgctcggtgttggccgacttcaaggcatggctctctgctaagattatgccagcgctccctgggctgcccttcatttcctgtcaaaagggatacaagggcgtgtggcggggggacggtgtgatgtcaacacgctgtccttgcggggcagcaataactggccatgtgaagaacgggtccatgcggcttgcagggccgcgtacatgtgctaacatgtggcacggtactttccccatcaatgagtacaccaccggacccagcacaccttgcccatcacccaactacactcgcgcactatggcgcgtggctgccaacagctacgttgaggtgcgtcgggtgggggacttccattacatcacgggggccacagaagatgagctcaagtgtccgtgccaagtgccggctgctgagttctttactgaagtggatggagtgagacttcaccgctacgcccctccatgtaagcccctgttgagagatgatatcactttcatggtagggttgcattcctacacgataggatctcaactcccctgtgagccagaaccggatgtctctgtgctgacctcgatgttgagagacccttcccatatcaccgccgagacggcagcgcgccgccttgcacgcgggtcccctccatcagaggcaagctcatccgccagccaactatcagctccgtcgttgaaggccacttgccagacgcataggcctcatccagacgctgagctagtggacgccaacttgttatggcggcaagagatgggcagcaacattacacgggtggagtctgagacaaaggttgtggttcttgattcgttcgagcctctgagagccgaaactgatgacgtcgagccctcggtggctgcagagtgtttcaagaaacctcccaagtatcctccagcccttcctatctgggctagaccggactacaatcctccactgttggaccgctggaaagcaccggattatgtaccaccaactgtccatggatgtgccttaccaccacggggcgctccaccggtgcctccccctcggaggaaaaggacaattcagctggacggctctaatgtgtccgcggcgctagccgcgctagctgaaaaatcattcccgtcctcgaaaccacaggaagagaatagctcatcctccggggtcgacacacagtccagcactacttccaaggtgcccccttctccgggaggggagtccgactcagagtcatgctcgtctatgcctcctctcgagggagagccgggcgacccggacttgagttgcgactcttggtccaccgttagtgacagcgaggagcagagcgtggtctgctgctctatgtcgtattcttggaccggcgccctgataacaccatgtagtgctgaggaagagaaactgcccatcagcccactcagcaactccctgttgagacatcataacctagtctattcaacgtcgtctagaagcgcttctcagcgtcagaagaaggttaccttcgatagactgcaggtgctcgacgaccattacaagactgcattaaaggaggtaaaggagcgagcgtctagggtaaaggctcgcatgctcaccatcgaggaagcgtgcgcgctcgtccctcctcactctgcccgatcgaagttcgggtatagtgcgaaggacgttcgctccttgtccagcagggccattaaccagatccgctccgtctgggaggacttgctggaagacaccacaactccaattccaaccaccatcatggcgaagaacgaggtgttttgcgtggaccccgctaaagggggccgcaagcccgctcgcctcattgtgtaccctgacctgggggtgcgtgtctgtgagaaacgcgccctgtatgacgtgatacagaagttgtcaattgagacgatgggtcctgcctatggattccaatactcgcctcaacagcgggtcgaacgtctgctgaagatgtggacctcaaagaaaacccccttggggttctcatatgacacccgctgctttgactcaactgtcactgaacaggacatcagggtggaagaggagatataccaatgctgtaaccttgaaccggaggccaggaaagtgatctcctccctcacggagcggctttactgcggaggccctatgttcaacagcaagggggcccagtgtggttatcgccgttgccgtgccagtggagttctgcctaccagcttcggcaacacaatcacttgttacatcaaggccacagcggctgcaaaggccgcaaacctccggaacccggactttcttgtctgcggagatgatttggtcgtggtggctgagagtgatggcgtcgatgaggatagagcagccctgagagccttcacggaggctatgaccaggtattctgctccacccggagatgctccacaggccacttacgaccttgagcttatcacatcttgctcctccaacgtctccgtggcacgggacgacaaggggaggaggtactattacctcacccgtgatgccactactcccctagcccgtgcggcttgggaaacagctcgtcacactccagttaactcctggttaggcaacatcatcatgtacgcgcctaccatctgggtgcgcatggtgatgatgacacactttttctccatactccaatcccaggagatacttgatcgcccccttgactttgaaatgtacggggccacttattctgtcactccgctggatttaccagcaatcattgaaagactccatggtctaagcgcgttcacgctccacagttactctccagtagagctcaatagggtcgcggggacactcaggaagcttgggtgcccccccctacgggcttggagacatcgggcacgagcagtgcgcgccaagcttatcgcccagggaggaaaggctaaaatatgcggcctttatctctttaattgggcggtacgcaccaagaccaacctcactccattgccagccgctggccagttggatttgtccagctggtttacggttggtgtcggcgggaacgacatttatcacagcgtgtcgcgtgcccgaacccgccatttgctgctttgcctactcctactaacagtaggggtaggcatctttctcttgccagctcgatgagctggtaagataacactccatttcttttttgtttttttttttttttttttt

SEQ ID NO: 767 - DNA, 9454 bp, Hepatitis C Virus
gcctgcctcttacgaggcgacactccaccatggatcactcccctgtgaggaacttctgtcttcacgcggaaagcgcctagccatggcgttagtacgagtgtcgtgcagcctccaggaccccccctcccgggagagccatagtggtctgcggaaccggtgagtacaccggaatcgctggggtgaccgggtcctttcttggaacaacccgctcaatacccagaaatttgggcgtgcccccgcgagatcactagccgagtagtgttgggtcgcgaaaggccttgtggtactgcctgatagggcgcttgcgagtgccccgggaggtctcgtagaccgtgtaacatgagcacacttcctaaaccccaaagaaaaaccaaaagaaacaccatccgtcgcccacaggacgtcaagttcccgggtggcggagtgatctatgtgggagtatacgtgttgccgcgcagggggccacgattgggtgtgcgcgcgacgcgtaaaacttctgaacggtcgcagcctcgcggacggcgaaagcctatccccaaggcgcgtcggagcgaaggccggtcctgggcccagcctgggtacccttggcccctctatggtaatgagggctgcgggtgggcagggtggctcctgtccccacgcggctcccgtccaaattgggccccaaatgacccccggcgacggtcccgcaatttgggtaaagtcatcgataccctcacgtgcggattcgccgatctcatggggtacatcccgctcgtcggcgcccccctaggaggcgctgcaagagccctcgcgcatggcgtgagagcccttgaagacgggataaattttgcaacagggaacttgcccggttgctccttttctatcttccttcttgctctgttctcttgcttaatccatccagcagctagtctagagtggcggaatacgtctggcctctatgtccttaccaacgactgttccaatagcagtattgtgtatgaggccgatgacgttattctacacacacccggctgtataccttgtgttcaggacggcaatacatctacgtgctggaccccagtgacacctacagtggcagtcaggtacgtcggagcaaccaccgcttcgattcgcagtcatgtggacctattagtgggcgcgggcacgatgtgttctgcgctctacgtgggcgatatgtgtgggcccgtcttcctcgtgggacaagccttcacgttcagacctcgtcgccatcggacggtccagacctgtaactgctcgctgtacccaggccatctttcaggacagcgaatggcttgggatatgatgatgaattggtctcctgccgtgggtatggtggtggcacacatcctgcggttgccccagaccttgttcgacgtagtagccggggcccattggggcatcattgcgggcctagcctattactccatgcagggcaactgggccaaggtcgctatcatcatggttatgttttcaggggttgatgccagcacacacgtcaccgctggccaagcagctcgtaatgcctatgggataactagtttattttctgtgggcgccaaacagaacctgcaactgatcaacactaatggctcgtggcacatcaacagaactgccctgaactgcaatgagtctataaacaccgggttcatagcagggttgttctattatcataagttcaactctactggatgtcctcaaaggctcagcagctgcaagcccatcaccttcttcaagcaggggtggggccccttgacagatgctaacatcaccggtccatctgacgacaaaccgtactgctggcactatgcacctagaccttgtggcattgtcccggcgttaaatgtttgcggccctgtgtactgcttcactccatcgccagtggtcgtaggcactactgatgctaagggcgccccaacctacacctggggtgcgaataagacagatgtgttcctgctggagtccctgcggcctcccagtggtcggtggtttgggtgcacgtggatgaactccacggggtttgttaagacgtgcggagctcccccttgtaacatctatggggatgggagagatgcccaaaatgagtcagacctcttctgccccaccgactgcttcaggaaacatcctgaggccacatacagccggtgtggtgcagggccctggttgacacctcgatgcttggtcgactacccataccggctttggcattatccatgcacagtcaattttacattgttcaaggtgaggatgtttgtgggtgggtttgagcaccggtttaccgccgcttgcaactggaccaggggggagcgttgcgatatcgaggatcgtgaccgcagcgagcaacatccgctgcttcattcaacaactgagcttgctatactgccttgctctttcacgcccatgcctgcattgtcaacaggtctaatacacctccaccaaaacatcgtggacgttcaatacctttatggcattggatctggcatggtcgggtgggcgttgaaatgggagttcgttatcctcattttcctcctcctggcagacgcacgcgtgtgcgttgctctttggctgatcctgacgatatcacaagcagaagcggccttggagaaccttgtcacgctgaacgccgtcgctgctgccgggacacacggcatcggctggtacctggtagctttttgcgcggcgtggtacgtgcggggtaaattggtcccgctggtgacctacagcctgacgggtctttggtccctagcattgctcgtcctcttgctcccccaacgggcgtacgcttggtcgggtgaagacagcgctactctcggcgctgggatcttggtcctcttcggcttctttaccttatcaccttggtataagcattggatcgcccgcctcatatggtggaaccagtacaccatatgtagatgcgagtccgcccttcatgtgtgggtccctcccttacttgcacgcgggggtagggacggtgtcatcctgctaacaagcctgctttatccatctttgatttttgacatcactaagctgctgatagcagcattgggcccattatacttgatacaggctaccatcaccgccaccccctactttgtgcgtgcgcatgtactggtccgcctttgcatgcttgtgcgctccgtgatggggggaaaatacttccagatgatcatactgagcctggcagatggttcaaacacctacctatacgaccacctagcgccaatgcaacattgggccgcagccggcctcaaagacctagcagtggccactgaacctgtaatatttagtcccatggaaatcaaggtcatcacctggggcgcagatacggcagcttgcggagatattctttgcgggctgcccgtctctgcgcgattaggccgtgaggtgttgttgggacctgctgatgactatcgggagatgggttggcgtctgttagcaccgatcacggcatatgcccagcaaactagaggccttcttgggactattgtgactagcttgactggcagggataagaacgtggtggccggtgaagtgcaggtgctttctacggctacccagaccttcctaggtacaacagtagggggggttatgtggactgtttaccatggtgctggttcgaggacactcgcgggcgttaaacatcctgcgctccaaatgtacacaaatgtagatcaggacctcgttgggtggccagcccctccaggggctaagtcccttgaaccatgcacctgcgggtctgcagacttatacttggttacccgcgatgctgatgtcattcccgctcggcgcaggggggactccacagcgagcttgctcagtcctaggcctctcgcccgtcttaaaggttcctctgggggtcctgttatgtgcccttcggggcatgttgcagggatctttagggctgctgtatgcaccagaggtgtggcaaaagccctacagttcataccagtggaaaccctgagtacacaggctaggtctccatccttctctgacaattcaactcctcctgctgtcccacagagctatcaagtagggtaccttcatgccccgaccggcagcggtaagagcacaaaggtcccggccgcttatgtagcacaaggatataatgttctcgtgttgaatccatcggtggcggccacactaggcttcggctctttcatgtctcgtgcctatgggatcgaccccaacatccgcactgggaaccgcaccgtaacaactggtgctaaactgacctattccacctacggtaagtttctcgcgggagggggttgctccgggggagcatatgatgtgattatctgtgatgattgccatgcccaagacgctactagcatattgggcataggcacggtcttggatcaggctgagacggctggggtaaggctgacggtcttagcgacagcaacccccccaggcagcatcactgtgccacattctaacatcgaggaagtggcgctgggctctgaaggtgagatccctttctacggtaaagctatcccgatagcctgcatcaagggggggaggcaccttatcttttgccattccaagaagaaatgtgataagatggcatccaaactcagaggcatggggctcaacgctgtagcgtactataggggtcttgatgtgtccgtcataccaacaacaggagacgtcgtagtttgcgctactgacgcacttatgacgggattcaccggagacttcgactctgtcatagattgcaacgtagctgttgaacagtacgttgacttcagcctagaccccaccttttccattgagacctgcactgctccccaagacgcagtttcccgcagccaacgtcgcggccgtacgggccgaggtagactcggcacgtaccgatatgtcacccccggtgaaagaccgtctggaatgttcgactcggtcgttctctgtgagtgctatgacgcaggctgctcgtggtacgacctgcagcccgctgagaccacagtcagactgagagcttacctgtccacgccggggttacctgtctgccaagaccatttagacttgtgggagagcgtcttcactggactaactcacatagatgcccactttctgtcacagactaagcaagcaggactcaacttctcgtacctcactgcttaccaagccactgtgtgcgcccgcgcgcaggctccccccccaagttgggacgagacgtggaagtgtctcgtgcggcttaagccaacactacatggacccacgccccttctataccggttggggcctgtccaaaatgaaatctgcttgacacaccccatcacaaagtacgtcatggcatgcatgtcagctgatctggaagtaaccaccagcacctgggtgttgcttggaggggttctcgcggccgtagcggcctactgcttgtcggtcggctgcgttgtgattgtgggccatattgagctgggaggcaagccggcactcgttccagataaagaggtgctgtatcaacaatacgatgagatggaggagtgctcgcaagcccgcccatatatcgagcaagctcaggtaatagcccaccagttcaaggaaaaagtccttggattgctgcagcgagccacccaacaacaagctgtcattgagcccatagtagtttccaactggcaaaagcttgaggtcttgtggcataagcatatgtggaattttgtgagcgggatccagtacctagcaggcctctccaccttgcctggcaaccctgctgtggcgtctcttatggcgttcactgcttcagtcaccagtcccctgacgaccaaccaaactatgttttttaacatactcgggggatgggttgctacccatttggcagggccccaggcctcttctgcattcgtggtaagcggcttggccggcgctgccatagggggtataggcttaggcagggtcttgcttgacatcctggcaggatacggagctggtgtctcaggcgccttggtggcttttaagatcatgggaggagaaccccccaccactgaggacatggtcaacctgttgcccgccatactatctccgggggctctcgtcgtcggtgtgatatgcgctgccatattacgtcgacacgtaggacctggggagggaccggtccagtggatgaacaggctcatagcattcgcatcccggggcaaccacgtctcaccagcgcactatgttcccgagagcgatgccgcagcgagggtcactgcattgctgagttccctaaccgtcacaagtctactccggcggttgcaccagtggatcaatgaagactacccaagtccttgcagcggcgattggctgcgtatcatctgggactgggtttgctcggtggtgtccgacttcaaaacatggctctccgctaagattatgccagcgctccctgggctgcccttcatttcctgtcagaagggatacaagggggtgtggcggggagacggtgtgatgtcgacacgctgtccttgcggagcatcaatagcaggtcatgtgaagaatgggtccatgcggctcgcagggccgcgtacatgtgctaacatgtgccacggtactttccccatcaacgagtacactaccggacccagcacaccttgcccaccacccaactacactcgcgcactatggcgcgtggctgccaacagctacgttgaggtgcgccgggtgggggacttccactacattacaggggctacagaagatgggctcaagtgtccgtgtcaagtgccggctactgagttctttactgaagtggatggggtgagaatccaccgttacgcccctccatgtaggcccctgttgagagatgagatcactttcatggtagggttgaactcctacgcgataggatctcaactcccctgtgagcccgaaccagatgtgtccgtgctgacctcgatgttgagagacccttcccatatcactgccgagacggcagcgcgccgtcttgcgcgcgggtcccctccatcagaggcaagctcatccgccagccaactatcggctccgtcgttgaaggccacttgccagacgcataggcctcatccagacgctgagctagtagacgccaacttgttatggcggcaagaaatgggcagcaacattacacgggtagagtctgaaacaaaggttgtgattcttgattcattcgaacctctgagagccgaaactgatgacgctgagctctcggcggctgcggagtgtttcaagaagcctcccaagtaccctccagcccttcctatctgggctaggccggactacaaccctcctctgttggaccgctggaaatcaccggattatgtaccaccaactgtccatggatgcgccttgccaccaaagggcgctccaccggtgcctcctcctcggaggaaaagaacaattcagctggatggttccaatgtgtccgcggcgctagctgcgctagcggaaaaatcattcccgtcctcgaaaccgcaggaagagaatagctcatcctcaggggtcgacacgcagtccagcactgcttccaaggtgctcccttcaccgggagaagagtccgactcagagtcatgctcgtccatgcctcctctcgagggagagccgggcgatccggacttgagttgcgactcttggtccaccgttagtgacagcgaggagcagagcgtggtctgctgctctatgtcgtactcttggaccggcgccctgataacaccatgtagtgctgaggaggagaaactgcccatcagtcccctcagcaactctttgttgaggcatcataacctagtctattcaacgtcgtctagaagcgcttctcagcgtcagaagaaggttaccttcgacaggctgcaggtgctcgacgaccattacaagactgcattacaggaggtaaaggagcgagcgtctagggtaaaggctcgcatgctatccatcgaggaggcctgcgcgctcgtccctcctcactctgcccggtcgaagttcgggtatagtgcgaaggacgttcgctctttgtccagcaaggccattaaccagatccgctccgtctgggaggacttgctggaagacaccacaactccaattccaaccaccatcatggcgaagaacgaggtgttttgtgtggaccccgctaaagggggccgcaaagccgctcgcctcattgtgtaccctgacctgggggtgcgtgtctgtgagaaacgcgccctatatgacgtgatacagaggctgtcaattgagacgatgggttctgcttatggattccagtactcgcctcggcaacgggtcgaacgtctgctgaagatgtggacctcgaagaaaacccccttggggttctcgtatgatacccgttgctttgactcaactgtcactggacaggacatcagggtggaagaggcggtttaccaatgttgtaatcttgagccggagccaggacaggccatctcctccctcacggagcggctttactgcgggggccctatgaacaacagcaagggggcccagtgtggttatctccgttgccgtgccagtggcgttctgcctaccagcttcggcaacacaatcacttgttacatcaaggccacagcggctgcgagggccgcaggcctccggaacccggactttcttgtctgcggagatgatctggtcgtggtggccgagagtgatggcgtcgatgaggatagagcaaccctgagagccttcacggaggctatgaccaggtattctgctccacccggagatgctccacagcccacctacgaccttgagctcattacatcttgctcctccaacgtctccgtggcacgggacgataaggggaagaggtactactacctcacccgtgatgccactactcccctggcccgtgcggcttgggaaacagctcgtcacactccagttaactcctggttgggcagcatcatcatgtacgcgcctactatctgggtgcgcatggtaatgatgacgcattttttctccatactccaatcccaggagatacttgatcgaccccttgactttgaaatgtacggggccacttactctgtcactccgctggatctaccagcaatcattgaaagactccatggtctaagcgcgttctcagtccacagttactctccagtagagctcaatagggtcgcggggacactcaggaagcttgggtgcccccccctacgagcttggagacatcgggcacgagcggtgcgcgctaagcttatcgcccagggagggagggccaaaatatgcggcctttatctctttaattgggcggtacgcaccaagaccaaactcactccactgccagccgctggccagttggatttatccagctggtttacggttggcgtcggcgggaacgacatttatcacagcgtgtcacgtgcccgaacccgctatttgctgctttgcctactcctactaacagtaggggtaggcatcttcctcctgccagcacggtgagctggtaggataacactccattccttttttgtttttccctttttttttt

SEQ ID NO: 768 - DNA, 9431 bp, Hepatitis C Virus
gccagccccctgatgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcatcatgagcacaaatccaaaaccccaaagaaaaatcaaacgtaacaccaaccgccgcccacaggacgttaagttcccgggcggtggtcagatcgttggtggagtttacctgttgccgcgcaggggccccaggttgggtgtgcgcgcgactaggaagacttccgagcggccgcaacctcgtggaaggcgacaacctatccccaaggctcgccaacccgagggtagggcctgggctcagcccgggtacccttggcccctctatggcaatgagggcttggggtgggcaggatggctcctgtcaccccgcggctcccggcctagttggggccccacggacccccggcgtaggtcgcgtaatttgggtaaggtcatcgataccctcacatgcggcttcgccgacctcatggggtacattccgctcgtcggcgcccccctagggggcgctgccagggctctagcgcatggcgtccgggttctggaggacggcgtgaactatgcaacagggaatctgcctggttgctccttttctatcttccttttggctttgctgtcctgtttgaccatcccagcttccgcctaccaagtgcgcaacgcgtccggggtgtaccatgtcacgaacgactgctccaactcaagtattgtgtatgaggcggcggacgtgattatgcacacccccgggtgcgtgccctgcgtccgggagaacaattcctcccgctgctgggtagcgctcactcccacgcttgcggccaggaacagcagcatccccactacgacaatacggcgtcatgtcgacttgctcgttggggcagctgctctctgttccgctatgtatgtgggggatttttgcggatctgttttcctcgtctcccagctgttcactttctcacctcgccggtatgagacggtgcaagactgcaattgctcaatctatcccggccatgtatcaggccatcgcatggcttgggatatgataatgaattggtcacctacaacagccctagtggtatcgcagctactccggatcccacaagccgtggtggatatggtggcaggggcccactggggagtcctggcgggccttgcctactattccatggtggggaactgggctaaggtcttggttgtgatgctgctcttcgccggtgttgacggggggacccacgtgacaggggggaaggtagcctacaccacccagggctttacatccttcttttcacgagggccgtctcagaaaatccaacttgtaaacactaacggcagctggcacatcaataggactgccctcaattgcaatgactcccttaacaccgggttccttgccgcgctgttctacacccacagcttcaacgcgtccggatgtccggagcgtatggccggttgccgccccattgacgagttcgctcaggggtggggtcccatcactcatgttgtgcctaacatctcggaccagaggccctattgctggcactacgcgcctcgaccgtgtggtatcgtacccgcgtcgcaggtgtgtggtccggtgtattgcttcaccccaagccctgttgtggtggggacgaccgatcgtttcggcgcccccacgtacaactggggaaacaatgagacggatgtgctactcctcaacaacacacggccgccgcagggcaactggttcggttgtacctggatgaatggcactgggttcacaaagacgtgcgggggccccccgtgcaacatcgggggggtcggcaacaataccttgacttgccccacggactgcttccggaagcaccccgaggccacttacacaaaatgtggttcggggccttggttgacacctaggtgcctagttcattacccatacaggctctggcactatccctgcactgtcaactttaccatcttcaaggttaggatgtatgtggggggcgtggaacacaggcttgaagctgcatgcaattggacccgaggagagcgttgtgacttggaggacagggatagatcagagcttagcccgctattgctgtccacaacagagtggcaggtactgccctgttccttcaccaccctgccggctctgtccactggtttgattcatctccatcagaacatcgtggacgtgcaatatctgtacggcatagggtcggcggttgtctccttcgcaatcaaatgggaatatattctgttgcttttcctccccctggcggacgcgcgcgtctgtgcctggttgtggatgatgctgctgatagcccaagctgaggccgccttggagaacctggtggtcctcaatgcagcatccatggcgggagcgcatggcatcctctctttccttgtgttcttctgtgccgcctggtacatcaaaggcaggctggtccctggggcggcatacgctttctatggcgtatggccgctgctcctgctcttgatggcgctacccgcacgggcgtacgccatggaccgggagatggctgcatcgtgcggaggcgcggtttttgtaggtctggtactcttgaccttgtcaccatactacaaagtgttcctcgctaagctcatatggtggttgcaatatctcatcaccagggccgaggcgcacttgcaagtgtggatcccccccctcaacgttcgggggggccgcgatgccatcatccttctcacatgtgcggtccacccggagctgatctttgacatcaccaagctcttgctcgccatactcggtccgctcatggtactccaggctggcctaacccaaatgccgtactttgtgcgtgctcaagggctcattcgtatgtgcatgttggtgcggaaagccgctgggggtcattatgtccagatggctctcatgaagctggctgcactgacaggtacgtacgtttatgaccatcttactccactgcaggactgggcccacgcgggcctacgagaccttgcggtagcagttgagcccgttgtcttctctgatatggagactaagatcatcacgtggggggcagagacggcggcgtgtggggacatcatctcgagtctacccgtttccgcccgaagggggagggagctgcttttgggaccggccgatagttttgacgggcaggggtggcgactccttgcgcctatcacggcctactcccagcagacgcggggcctgcttggttgcatcatcaccagccttacgggccgggataagaaccaggtcgagggggaggttcaagtggtctctaccgcaacacaatctttcctggcgacctgcatcaacggcgtttgctggactgttttccacggcgccggctcgaagaccttagccggcccaaaaggcccaatcacccaaatgtacaccaatgtagatcaggacctcgtcggctggtcggcgccccccggggcgcgttccttgacaccttgcacctgcggcagctcggacctttatttggtcacgaggcatgctgatgtcattccggtgcaccggcggggcgacagcagggggagcctcctctcccccgggcccatctcttacttgaagggttcctcgggtggtccgctgccttgcccctcgggccgtgttgtgggcatcttccgggctgccgtgtgcacccggggggttgcgaaggcggtggactttgtgcccgttgagtctatggaaaccaccatgcggtctccggtcttcacggataactcaacccccccggccgtaccgcagacattccaagtggcccacctacacgctcccactggcagcggcaaaagcaccagggtgccggctgcgtatgcggcccaagggtacaaggtactcgtcctgaacccgtccgttgctgccactttgggctttggggcgtacatgtccaaggcacatggtgttgaccctaacatcagaactggggtgaggaccatcaccacgggcgctcccatcacgtactccacctacggtaagttcctcgccgacggtggctgttctgggggtgcctatgacatcataatatgtgatgagtgtcattcaactgactcgacttccatcttgggcattggtacagtcctggaccaagcggagacggctggagcgcgccttgtcgtgctcgccaccgctacgcctccgggatcggtcaccgtgccgcatcctaatattgaggaggtggccttgtccaacactggagagatccccttctatggcaaggccatccccctcgaggccatcaagggggggaggcatctcattttctgccattccaagaagaaatgtgacgagctcgctgcgaagctgtcggccctcggagtcaacgctgtagcatattaccggggtcttgatgtgtccatcataccgacaagcggggacgtcgttgtcgtggcaacagacgctctaatgacaggctataccggtgactttgactcggtgatcgactgcaacacatgtgtcacccaaacagtcgatttcagcttggaccctactttcaccatcgagacgacgaccgtaccccaagatgcggtgtcgcgctcgcagcggcgaggcaggactggtaggggcagggggggcatatacaggtttgtaactccaggggaacggccctcaggcatgttcgattcttcggtcctgtgtgaatgttatgacgcgggctgtgcttggtacgagctcacgcccgccgagacctcggttaggttgcgggcttacctaaatacacctgggctgcccgtctgccaggaccatctggagttctgggagagcgtcttcaccggcctcacccacatagatgcccacttcttgtcccagaccaaacaggcaggagacaacttcccctacctggtagcataccaggctacagtgtgcgccagggccaaggctccacctccatcgtgggatcagatgtggaagtgtctcatacggctgaagcctacgctacacgggccaacgcccctgttgtataggttaggagccgttcagaacgaggttaccctcacacaccccataaccaagttcatcatggcatgcatgtcggctgacctagaggtcgtcactagcacttgggtgctggtaggcggggtcctcgcggctctggccgcgtactgcctgacaacgggcagcgtggtcattgtgggcaggatcatcttgtccgggaggccggccgttattcccgacagggaagttctctaccaagagttcgatgaaatggaagagtgcgcctcgcacctcccttacatcgaacaaggaatgcagctcgccgagcaattcaagcagaaggcgctcggtttgctgcaaacagccaccaagcaagcggaggctgctgctcccgtggtggagtccaagtggcgagcccttgagaccttctgggcgaagcacatgtggaattttatcagcgggatacagtacttagcaggcttgtccactctgcctggaaaccccgcaatagcatcactgatggcattcacagcctctatcaccagcccgctcaccacccaatataccctcctgtttaacatcttggggggatgggtggccgcccaactcgccccccccagtgccgcttcagccttcgtgggcgccggtatagctggcgcggctgttggcagcataggcctcgggaaggtgcttgtggacattctggcgggttatggagcaggggtggcaggcgcgctcgtggcctttaaggtcatgagcggtgacatgccctccaccgaggacctggtcaacttactccccgccatcctctctcctggtgccctggtcgtcggggtcgtgtgcgcagcaatactgcgtcggcatgtgggcccaggggagggggctgtgcagtggatgaaccggctgatagcgtttgcttcgcggggcaaccatgtctcccccacgcactatgtgcctgaaagcgacgccgcagcgcgcgtcacccagatcctctccaaccttaccatcactcagctgttgaagaggcttcaccagtggattaatgaggactgctccacgccatgctccggctcgtggctcagggatgtttgggactggatatgcacggtattggctgatttcaagacctggctccagtccaagctcctgccgcggttaccgggggtcccttttttctcatgccagcgtgggtacaagggggtttggcggggagatggcatcatgtataccacctgcccatgtggagcacaaatcaccggacatgtcaaaaacggttctatgaggatcgttgggcctagaacctgtagcaacacgtggcacggaacatttcccatcaacgcgtacaccacaggcccctgcacaccctccccggcgccaaactattccagggcgttgtggcgggtggccgctgaggagtatgtggaggtcacgcgggtgggggatttccactacgtgacgggcatgaccactgacaacgtgaaatgcccatgccaggttccggcccccgaattcttcacagaattggatggggtgcggctgcacaggtacgctccggcgtgcaaacctctcctgcgggatgaggtcacattccaggtcgggctcaaccaatatacggttgggtcacagctcccatgtgagcccgaaccggatgtaacagtggtcacctccatgctcaccgacccctcccacattacagcagaggcggctaggcgtaggctggccagagggtctcccccttccttggccagttcttcagctagtcagttgtctgcgctttctttgaaggcgacatgcactacccatcatggcgccccagacactgacctcatcgaggccaacctcctgtggcggcaggagatgggcggaaacatcacccgcgtggagtcagagaacaagatagtaattctagactcttttgaaccgcttcgagcggaggaggatgagagggaagtgtccgttgcggcggagatcctgcggaagaccaggaaattccccgcagcgatgcccgtatgggcacgcccggactacaacccaccattactagagtcttggaagaacccggactacgtccctccagtggtacacgggtgcccattgccgcctaccaaggcccctccaataccacctccacggagaaagagaacggttgtcctgacagaatccaccgtgtcctctgccttggcggagcttgctacaaagacctttggcagttccggatcgtcggccgtcgacagcggcacggcgaccggccctcctgaccaggcctccgccgaaggagatgcaggatccgacgctgagtcgtactcctccatgcccccccttgagggagagccgggggaccccgatctcaacgacgggtcttggtctaccgtaagcgaggaggccagcgaggacgtcgtctgctgctcgatgtcctacacatggacaggcgccttaattacaccatgcgccgcggaggagagcaagctgcccattaatgcgctgagcaaccctttgctgcgccaccacaacatggtctatgccacaacatcccgcagcgcaagccagcggcagaaaaaggtcacatttgacagactgcaagtcctggatgaccactaccgggacgtgctgaaggacatgaaggccaaggcgtccacagttaaggctaaacttctatctgtagaggaagcctgcaagctgacgcccccacactcggccagatctaaatttggctacggggcaaaggacgtccggagcctgtccagcaaggccgttaaccacatccgctccgtgtggaaggacttgctggaagacactgagacaccaattgacaccaccatcatggcaaaaaatgaggttttctgtgttcaaccagagaaaggaggccgcaagccagctcgccttatcgtattcccagacttgggggttcgtgtgtgcgagaaaatggccctctacgacgtggtctccactcttcctcaggccgtgatgggctcctcatacggattccagtactcccctggacagcgggtcgagttcctggtgaatgcctggaagtcaaagaagagccctatgggctttgcatatgacacccgctgttttgactcaacggtcaccgagaacgacatccgtactgaggagtcaatttatcaatgttgtgacttggaccccgaggccagacaggccataaggtcgctcacagagcggctttatatcgggggccccctgactaattcaaaggggcagaactgcggttatcgccggtgccgcgtcagcggcgtgctgacgactagctgcggtaataccctcacatgttacttgaaggcctctgcagcctgtcgagctgcaaagctccaggactgcacgatgcttgtgtgcggagacgaccttgtcgttatctgtgatagcgcgggaactcaggaggacgcggcgagcctacgagtcttcacggaggctatgactaggtactctgccccccccggggacccgccccaaccagaatacgacttggagctgataacatcatgctcctccaatgtgtcggtcgcgcacgacgcatcaggcaaacgggtgtactatctcacccgtgaccccaccacccccctagcgcgggctgcgtgggagacagctagacacactccagtcaactcctggctaggcaacatcatcatgtacgcgcccaccttatgggcaaggatgattctgatgacccacttcttctccatccttctagcccaggagcaacttgaaaaagccctagattgtcagatctacggggccacttactccattgagccacttgacctacctcagatcattcaacgactccacggtcttagcgcattttcactccatagttactctccaggtgagatcaatagggtggcttcatgcctcaggaaacttggggtaccgcccttgcgagtctggagacatcgggccagaagcgtccgcgctaagctactgtcccagggggggagggccgccacctgtggcaaatacctcttcaactgggcagtaaagaccaagctcaaactcactccaatcccagaagcgtcccagctggacttgtccggctggttcgttgctggttacagcgggggagacatatatcacagcctgtctcgtgcccgaccccgctggttcatgtggtgcctactcctactttccgtaggggtaggcatctacctgctccccaaccgatgagcggggagctaaacactccaggccaataggccatcccccttttttttttttaagctt

SEQ ID NO: 769 - DNA, 9431 bp, Hepatitis C Virus
gccagccccctgatgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcatcatgagcacaaatccaaaaccccaaagaaaaatcaaacgtaacaccaaccgccgcccacaggacgttaagttcccgggcggtggtcagatcgttggtggagtttacctgttgccgcgcaggggccccaggttgggtgtgcgcgcgactaggaagacttccgagcggccgcaacctcgtggaaggcgacaacctatccccaaggctcgccaacccgagggtagggcctgggctcagcccgggtacccttggcccctctatggcaatgagggcttggggtgggcaggatggctcctgtcaccccgcggctcccggcctagttggggccccacggacccccggcgtaggtcgcgtaatttgggtaaggtcatcgataccctcacatgcggcttcgccgacctcatggggtacattccgctcgtcggcgcccccctagggggcgctgccagggctctagcgcatggcgtccgggttctggaggacggcgtgaactatgcaacagggaatctgcctggttgctccttttctatcttccttttggctttgctgtcctgtttgaccatcccagcttccgcctaccaagtgcgcaacgcgtccggggtgtaccatgtcacgaacgactgctccaactcaagtattgtgtatgaggcggcggacgtgattatgcacacccccgggtgcgtgccctgcgtccgggagaacaattcctcccgctgctgggtagcgctcactcccacgcttgcggccaggaacagcagcatccccactacgacaatacggcgtcatgtcgacttgctcgttggggcagctgctctctgttccgctatgtatgtgggggatttttgcggatctgttttcctcgtctcccagctgttcactttctcacctcgccggtatgagacggtgcaagactgcaattgctcaatctatcccggccatgtatcaggccatcgcatggcttgggatatgataatgaattggtcacctacaacagccctagtggtatcgcagctactccggatcccacaagccgtggtggatatggtggcaggggcccactggggagtcctggcgggccttgcctactattccatggtggggaactgggctaaggtcttggttgtgatgctgctcttcgccggtgttgacggggggacccacgtgacaggggggaaggtagcctacaccacccagggctttacatccttcttttcacgagggccgtctcagaaaatccaacttgtaaacactaacggcagctggcacatcaataggactgccctcaattgcaatgactcccttaacaccgggttccttgccgcgctgttctacacccacagcttcaacgcgtccggatgtccggagcgtatggccggttgccgccccattgacgagttcgctcaggggtggggtcccatcactcatgttgtgcctaacatctcggaccagaggccctattgctggcactacgcgcctcgaccgtgtggtatcgtacccgcgtcgcaggtgtgtggtccggtgtattgcttcaccccaagccctgttgtggtggggacgaccgatcgtttcggcgcccccacgtacaactggggaaacaatgagacggatgtgctactcctcaacaacacacggccgccgcagggcaactggttcggttgtacctggatgaatggcactgggttcacaaagacgtgcgggggccccccgtgcaacatcgggggggtcggcaacaataccttgacttgccccacggactgcttccggaagcaccccgaggccacttacacaaaatgtggttcggggccttggttgacacctaggtgcctagttcattacccatacaggctctggcactatccctgcactgtcaactttaccatcttcaaggttaggatgtatgtggggggcgtggaacacaggcttgaagctgcatgcaattggacccgaggagagcgttgtgacttggaggacagggatagatcagagcttagcccgctattgctgtccacaacagagtggcaggtactgccctgttccttcaccaccctgccggctctgtccactggtttgattcatctccatcagaacatcgtggacgtgcaatatctgtacggcatagggtcggcggttgtctccttcgcaatcaaatgggaatatattctgttgcttttcctccccctggcggacgcgcgcgtctgtgcctggttgtggatgatgctgctgatagcccaagctgaggccgccttggagaacctggtggtcctcaatgcagcatccatggcgggagcgcatggcatcctctctttccttgtgttcttctgtgccgcctggtacatcaaaggcaggctggtccctggggcggcatacgctttctatggcgtatggccgctgctcctgctcttgatggcgctacccgcacgggcgtacgccatggaccgggagatggctgcatcgtgcggaggcgcggtttttgtaggtctggtactcttgaccttgtcaccatactacaaagtgttcctcgctaagctcatatggtggttgcaatatctcatcaccagggccgaggcgcacttgcaagtgtggatcccccccctcaacgttcgggggggccgcgatgccatcatccttctcacatgtgcggtccacccggagctgatctttgacatcaccaagctcttgctcgccatactcggtccgctcatggtgctccaggctggcataactagagtgccgtacttcgtacgcgctcaagggctcatccgtgcgtgcatgttagtgtggaaagccgccggaggtcattatgttcaaatggcctttgtgaagctggccgcgctgacaggtacgtacatttatgaccatcttaccccactgcgggactgggcccacgcgggcctacgagaccttgcggtagcagttgagcccgttgtcttctctgatatggagactaagatcatcacctggggggcagacaccgcggcgtgtggggacatcattttgggcctacctgtctccgcccggagggggaaggagatacttctgggaccggccgatagtcttgaagggcaggggtggcgactccttgcgcccatcacggcctactcccaacagacgcggggcctacttggttgcatcatcactagcctcacaggccgggacaagaaccaggtcgagggggaggttcaggtggtttccaccgcaacacaatctttcctggcgacctgtatcaacggcgtgtgttggactgtctatcatggtgccggctcaaagaccctagctggcccaaaaggcccaatcacccaaatgtacaccaatgtagaccaagacctcgttggctggccggcgccccctggggcgcgttccatgacaccatgcacctgcggcagctcggacctttacttggtcacgagacatgctgatgtcattccggtgcgccggcggggcgacagcagggggagcctcctctccccccggcccatctcctacctgaagggttcctcgggtggtccgctgctttgcccctcgggccatgttgtgggcatcttccgggctgctgtgtgcacccggggggttgcgaaggcggtagactttgtgcccgttgagtctatggaaaccactatgcggtctccggtcttcacggataactcaacccccccggccgtaccgcagtcattccaagtggcccacctacacgctcccactggcagcggcaaaagcaccaaggtgccggctgcgtatgcggcccaagggtacaaggtactcgtcctgaacccgtccgttgctgccactttgggctttggggcgtatatgtccaaggcacatggtgttgaccctaacatcagaactggggtgaggaccatcaccacgggcgctcccatcacgtactccacctacggtaagttcctcgccgacggtggctgttctgggggtgcctatgacatcataatatgtgatgagtgtcattcaactgactcgacttccatcttgggcattggtacagtcctggaccaagcggagacggctggagcgcgccttgtcgtgctcgccaccgctacgcctccgggatcggtcaccgtgccgcatcctaatattgaggaggtggccttgtccaacactggagagatccccttctatggcaaggccatccccctcgaggccatcaagggggggaggcatctcattttctgccattccaagaagaaatgtgacgagctcgctgcgaagctgtcggccctcggagtcaacgctgtagcatattaccggggtcttgatgtgtccatcataccgacaagcggggacgtcgttgtcgtggcaacagacgctctaatgacaggctataccggtgactttgactcggtgatcgactgcaacacatgtgtcacccaaacagtcgatttcagcttggaccctactttcaccatcgagacgacgaccgtaccccaagatgcggtgtcgcgctcgcagcggcgaggcaggactggtaggggcagggggggcatatacaggtttgtaactccaggggaacggccctcaggcatgttcgattcttcggtcctgtgtgaatgttatgacgcgggctgtgcttggtacgagctcacgcccgccgagacctcggttaggttgcgggcttacctaaatacacctgggctgcccgtctgccaggaccatctggagttctgggagagcgtcttcaccggcctcacccacatagatgcccacttcttgtcccagaccaaacaggcaggagacaacttcccctacctggtagcataccaggctacagtgtgcgccagggccaaggctccacctccatcgtgggatcagatgtggaagtgtctcatacggctgaagcctacgctacacgggccaacgcccctgttgtataggttaggagccgttcagaacgaggttaccctcacacaccccataaccaagttcatcatggcatgcatgtcggctgacctagaggtcgtcactagcacttgggtgctggtaggcggggtcctcgcggctctggccgcgtactgcctgacaacgggcagcgtggtcattgtgggcaggatcatcttgtccgggaggccggccgttattcccgacagggaagttctctaccaagagttcgatgaaatggaagagtgcgcctcgcacctcccttacatcgaacaaggaatgcagctcgccgagcaattcaagcagaaggcgctcggtttgctgcaaacagccaccaagcaagcggaggctgctgctcccgtggtggagtccaagtggcgagcccttgagaccttctgggcgaagcacatgtggaattttatcagcgggatacagtacttagcaggcttgtccactctgcctggaaaccccgcaatagcatcactgatggcattcacagcctctatcaccagcccgctcaccacccaatataccctcctgtttaacatcttggggggatgggtggccgcccaactcgccccccccagtgccgcttcagccttcgtgggcgccggtatagctggcgcggctgttggcagcataggcctcgggaaggtgcttgtggacattctggcgggttatggagcaggggtggcaggcgcgctcgtggcctttaaggtcatgagcggtgacatgccctccaccgaggacctggtcaacttactccccgccatcctctctcctggtgccctggtcgtcggggtcgtgtgcgcagcaatactgcgtcggcatgtgggcccaggggagggggctgtgcagtggatgaaccggctgatagcgtttgcttcgcggggcaaccatgtctcccccacgcactatgtgcctgaaagcgacgccgcagcgcgcgtcacccagatcctctccaaccttaccatcactcagctgttgaagaggcttcaccagtggattaatgaggactgctccacgccatgctccggctcgtggctcagggatgtttgggactggatatgcacggtattggctgatttcaagacctggctccagtccaagctcctgccgcggttaccgggggtcccttttttctcatgccagcgtgggtacaagggggtttggcggggagatggcatcatgtataccacctgcccatgtggagcacaaatcaccggacatgtcaaaaacggttctatgaggatcgttgggcctagaacctgtagcaacacgtggcacggaacatttcccatcaacgcgtacaccacaggcccctgcacaccctccccggcgccaaactattccagggcgttgtggcgggtggccgctgaggagtatgtggaggtcacgcgggtgggggatttccactacgtgacgggcatgaccactgacaacgtgaaatgcccatgccaggttccggcccccgaattcttcacagaattggatggggtgcggctgcacaggtacgctccggcgtgcaaacctctcctgcgggatgaggtcacattccaggtcgggctcaaccaatatacggttgggtcacagctcccatgtgagcccgaaccggatgtaacagtggtcacctccatgctcaccgacccctcccacattacagcagaggcggctaggcgtaggctggccagagggtctcccccttccttggccagttcttcagctagtcagttgtctgcgctttctttgaaggcgacatgcactacccatcatggcgccccagacactgacctcatcgaggccaacctcctgtggcggcaggagatgggcggaaacatcacccgcgtggagtcagagaacaagatagtaattctagactcttttgaaccgcttcgagcggaggaggatgagagggaagtgtccgttgcggcggagatcctgcggaagaccaggaaattccccgcagcgatgcccgtatgggcacgcccggactacaacccaccattactagagtcttggaagaacccggactacgtccctccagtggtacacgggtgcccattgccgcctaccaaggcccctccaataccacctccacggagaaagagaacggttgtcctgacagaatccaccgtgtcctctgccttggcggagcttgctacaaagacctttggcagttccggatcgtcggccgtcgacagcggcacggcgaccggccctcctgaccaggcctccgccgaaggagatgcaggatccgacgctgagtcgtactcctccatgcccccccttgagggagagccgggggaccccgatctcaacgacgggtcttggtctaccgtaagcgaggaggccagcgaggacgtcgtctgctgctcgatgtcctacacatggacaggcgccttaattacaccatgcgccgcggaggagagcaagctgcccattaatgcgctgagcaaccctttgctgcgccaccacaacatggtctatgccacaacatcccgcagcgcaagccagcggcagaaaaaggtcacatttgacagactgcaagtcctggatgaccactaccgggacgtgctgaaggacatgaaggccaaggcgtccacagttaaggctaaacttctatctgtagaggaagcctgcaagctgacgcccccacactcggccagatctaaatttggctacggggcaaaggacgtccggagcctgtccagcaaggccgttaaccacatccgctccgtgtggaaggacttgctggaagacactgagacaccaattgacaccaccatcatggcaaaaaatgaggttttctgtgttcaaccagagaaaggaggccgcaagccagctcgccttatcgtattcccagacttgggggttcgtgtgtgcgagaaaatggccctctacgacgtggtctccactcttcctcaggccgtgatgggctcctcatacggattccagtactcccctggacagcgggtcgagttcctggtgaatgcctggaagtcaaagaagagccctatgggctttgcatatgacacccgctgttttgactcaacggtcaccgagaacgacatccgtactgaggagtcaatttatcaatgttgtgacttggaccccgaggccagacaggccataaggtcgctcacagagcggctttatatcgggggccccctgactaattcaaaggggcagaactgcggttatcgccggtgccgcgtcagcggcgtgctgacgactagctgcggtaataccctcacatgttacttgaaggcctctgcagcctgtcgagctgcaaagctccaggactgcacgatgcttgtgtgcggagacgaccttgtcgttatctgtgatagcgcgggaactcaggaggacgcggcgagcctacgagtcttcacggaggctatgactaggtactctgccccccccggggacccgccccaaccagaatacgacttggagctgataacatcatgctcctccaatgtgtcggtcgcgcacgacgcatcaggcaaacgggtgtactatctcacccgtgaccccaccacccccctagcgcgggctgcgtgggagacagctagacacactccagtcaactcctggctaggcaacatcatcatgtacgcgcccaccttatgggcaaggatgattctgatgacccacttcttctccatccttctagcccaggagcaacttgaaaaagccctagattgtcagatctacggggccacttactccattgagccacttgacctacctcagatcattcaacgactccacggtcttagcgcattttcactccatagttactctccaggtgagatcaatagggtggcttcatgcctcaggaaacttggggtaccgcccttgcgagtctggagacatcgggccagaagcgtccgcgctaagctactgtcccagggggggagggccgccacctgtggcaaatacctcttcaactgggcagtaaagaccaagctcaaactcactccaatcccagaagcgtcccagctggacttgtccggctggttcgttgctggttacagcgggggagacatatatcacagcctgtctcgtgcccgaccccgctggttcatgtggtgcctactcctactttccgtaggggtaggcatctacctgctccccaaccgatgagcggggagctaaacactccaggccaataggccatcccccttttttttttttaagctt

SEQ ID NO: 770 - DNA, 9444 bp, Hepatitis C Virus
acctgcctctttcgaggcgacactccaccatgaatcactcccctgtgaggaacttctgtcttcacgcggaaagcgtctagccatggcgttagtacgagtgtcgtgcagcctccaggccccccccttccgggagagccatagtggtctgcggaaccggtgagtacaccggaatcgccgggatgaccgggtcctttcttggaacaacccgctcaatgcccggaaatttgggcgtgcccccgcgagatcactagccgagtagtgttgggtcgcgaaaggccttgtggtactgcctgatagggtgcttgcgagtgccccgggaggtctcgtagaccgtgcaacatgagcacacttcctaaacctaaaagacaaacaaaaagaaacacactccgccgcccaaagaacgttaagttcccggctggcgggcagatcgttggtgaagtatatgtcctgccgcgtaggggcccacaattgggtgtgcgcgaagtacgtaagacttccgagcgatcacaacctcgcggacggcgtcagcctacccccaaggcacgcccgcgcgagggccggtcctgggcccagcccgggtacccttggcccctctacgggaatgagggctgtggttgggcaggatggctcttgcccccccgcggttctcgccccagctggggccaaaatgacccccggcgtagatcccgcaacttgggtaaggtcatcgataccctaacgtgcggatttgccgacctcatggggtacattccgctcatcggcgcccctgtagggggcgtcgcaagagccctcgctcatggtgtgagagcacttgaggacggagtgaactacgcaacagggaatcttcctggttgctccttctctatcttcctcctcgctctcttctcctgcttgacttgccccgcgtccagtctggagtacaggaatgcgtctggcctatatttgcttaccaacgactgctccaacaggagcattgtgtatgaggccgacgacgtgatcttgcacttacccggatgcgtgccctgcgtcgaaaccgacaacaacaacacatcgtgctggacaccgatttcaccgacggtggccgtcaagcaccctggtgtgaccaccgcgtcgatccgaaatcatgtgaatatgttggtggccccgccaacgctgtgctcagcactatacgtcgaagacgccttcggggccgtgtcccttgtgggacaagcgttcacctttagacctcgccaacacaagactgtgcagacgtgcaactgctcaatatacccaggtcatgtctcaggacatcgtatggcttgggatatgatgatgaactggtcccccgcaatcgggctagtgatatcacacttgatgcggttgccccaaacgttctttgacctggtcgtgggggcccactggggcgtgatggcaggcctcgcctacttttccatgcaaggcaattgggccaaggtcgtcatcgtgctaatcatgttttcaggagtggacgcgacaacacacaccactggtggcagcgcggcccaagccactgccgggtttacaagttttttcacccgaggtccaagtcagaatttgcaattggtcaactcaaatgggtcatggcacattaacagcactgccttgaattgcaacgattccctaaacactggctttatagcgggcctcttctactatcacaaattcaactcctcggggtgccctgagcgaatgtccagctgtaagcccatcacatatttcaatcaggggtggggcccattgacagatgctaacataaatggtcccagtgaggacagaccatattgctggcactatccacccagaccctgtaacataaccaagccgttgaatgtctgtgggcccgtctactgctttacaccctcaccggtggtggtgggcaccactgatattaaaggcctgccaacttataggtttggtgtgaacgagtcagatgtcttcttgttgacctctttgagacccccccaaggccggtggtttggatgtgtgtggatgaacagtacagggtttgtaaagacttgtggggctcccccttgcaacatctatggggggatgaaggacattgaagcaaatcaaacccaccttaaatgccctaccgattgtttcaggaagcaccatgatgccacgtttacccgctgcgggtccgggccctggcttacgccaaggtgtctggtagactacccgtaccgactgtggcattatccttgcactgtgaacttctctatattcaaggtcagaatgttcgtaggaggacatgaacatcgattctcagccgcctgcaactggacgaggggagagcgctgtgatcttgaagatcgtgaccgcagtgagcaacaaccactgctccattcaacgactgactcgctaatattgccatgctcatttacacctatgcgccgcctgtcaacagggctcatacacctccaccagaacatcgtggacgtgcaatacctctatggtgttggttctgccgtagtgggctgggctctcaagtgggagttcgtcgtcctcgtcttcctccttctggcggacgcacgcgtgtgtgtggccctctggatgatgttactgatttctcaggcggaagcagcaatggagaacttggtgatgctgaacgccctcagcgcagcgggacaacagggttacgtctggtacctggttgcattctgcgccgcatggcacatccgggggaagctcgttccgctgataacctatggtttgacaggcctgtggcccctagccctgctcgacctcctgctccctcagcgtgcttacgcttggacgggagaagacgatgccaccatcggggccggggtgctcctgctcctcgggttctttaccttatcaccatggtataagcactggattggccgtcttatctggtggaaccagtatgccatatgcaggggtgaggccgccttgcaagtatgggtcccccccctgcttgttcgaggtagtcgggacagtgtgattttactagcaagcctactgtatccctctctaatctttgacatcacaaagctgctgatagccgtccttgggccactgtatttaatacaagccgcactcaccagcaccccctactttgtccgcgcccacgtgttgattcgtatctgcatgttggtgcgctctgcaatgggagggaagtacgtccaaatggccgtgctgacggttggccggtggtttaacacctatctgtatgaccacctgtcccccatacaggactgggctgccgagggtctcaaaggactggcggtggccacggagcccgtcatctttagtcctatggagattaaggttatcacctggggtgcagacacagcagcctgcggagacatcttgtgcgggttgcccgtttcggcgcggttgggccgcgagttgttgctgggtccggctgacgattacaagaagatgggatggcgcctactgtccccgatctcagcatacgcccagcaaactcggggactatttggaactattgtcaccagcctgacaggtagggataagaacgtggtgactggtgaggtgcaggtgctgtccacggccacccagaccttcttgggtacgacagtagggggggtcatgtggactgtttaccatggtgctgggtcgcggactcttgctggtaacaaacggcccgcgcttcaaatgtacaccaatgtggaccaggacctggtaggttggccagcgcctgcggggaccaagtcccttgacccctgcacgtgcggttcttccgacctgtacctggtgacgcgtgaggccgacgtcctccccgcccgccgtaggggagactcaacggcgagtttactcagtaccagaccactgtcctgcctcaaaggttcttctgggggtcctgtcatgtgcccttcggggcacgtggtggggatcttcagggcggcagtgtgcaccagaggtgtcgcaaaagccctgcagttcataccagtggaaactctgagtacgcaggtcaggtctccatcttttagtgacaattccaccccccctgccgtcccggagtcctaccaagtaggataccttcacgcccccactggaagcggcaaaagcaccaaagtccccgccgcttatgttgcacagggatattctgtcctagtgctaaatccatcggtagcggctaccctgggttttggcacgtacatgtcaaaagcctatgggattgaccccaacatccgtacggggacacgcaccatcacaaccggtgccaaactcacctactccacatacggcaagttcctcgccgatgggggttgttctggaggcgcctatgacgtgatcatctgcgatgaatgtcacgcgcaagacgctacctccatactgggtataggcacggtgctggatcaagcagagacagccggggtgaggctgacggtactggcaaccgcgacccctcccggcagcatcacggtgccgcatcctaatatcgaggaggtgggcctcaccagtgacggagaaatccccttttatggcaaagccctcccactggcaatgatcaagggaggaagacaccttgtattctgccattcaaaggaaaaatgtgacgagctggccagcaagctcagagggatgggggtcaacgctgtagcgttttatagaggcctcgacgtgtccgtgatacctgtatccggagacgtggtagtatgtgctactgatgccctcatgaccggatatacaggggattttgacaccgttatagactgtaacgtggctgtggagcagtacgtcgacttcagtctagaccccactttctccattgagacacgcacggttccccaggacgcggtgtcccgaagtcaacgcaggggccgtacgggccggggtagaccgggaatataccggtttgtcactccaggggagcggccgtccggcatgtttgactcggtggtgctatgtgagtgctatgacgcaggttgttcctggtatgacctacaacctgctgagaccacagtgcgactgagagcatacctgtccaccccggggctacctgtctgccaagaccacctagacttctgggagagagtgtttaccggactgactcatatagatgcccacttcttgtcacaggcaaaacagcagggcctaaactttgcatacttggtggcatatcaagccactgtctgcgctcgtgcaaaggcgagcccaccatgttgggatgagatgtggaaatgtctcatacgcctgaagccgactctgcaaggccctactcctctcctgtataggttaggagcaattcaaaatgacatctgcatgacacaccctattaccaagtacatcatggcttgcatgtcagctgacttggaagtcaccacgagcgcctgggtgctggttggtggtgttctagcagccctcgcagcctactgtttatcagtaggttgtgtcgtcatcgtggggcatatcgagctaggaggcaaacctgcgctcgtccctgacagacaagtactgtaccaacaatatgatgagatggaagaatgttcccagtctgctccttacatcgagcaagcacaggctatcgctcagcaattcaaggacaaagtcctcggcttgctgcaaagggcgagccaacaagaagctgaaattcgacccatagtgcaatcacaatggcagaaagcggaggcgttctggcaacagcacatgtggaactttgtgagcgggatccagtacctggccggtctctccacactgccaggcaaccctgccgtggcttcccttatggccttcaccgcctctgtaaccagccccctcacaaccaaccagactatgttctttaacatccttggaggttgggtagccacacacctagcgggacctgcagcatcttccgcgtttgtggtaagcggcttggctggcgccgctgtgggaggcataggcattggcagggtgttgcttgacgtgcttgccgggtatggggctggggtctccggcgccctagtggccttcaaaatcatgggaggagagctccctaccacagaggacatggtcaatcttctgcctgccatcttatcccctggagcgttggttgttggcgtgatatgtgctgcagtgttgcgccggcatgtaggccctggggaaggagcagtgcagtggatgaacagactcatagcgttcgcatctcgggggaaccatgtatcaccaacacactatgtccccgagagcgacgcggcagcaaaagtaacagcattgctgagctctctaaccgtcacccgattgcttcgccggttacaccagtggatcaacgaggactatcctagtccctgcaacggtgactggttacatgacatctgggactgggtctgtatcgtacttagtgactttaagacctggctttcggccaagatcatgcccaaggtgccaggcataccctttctctcatgtcaaaaggggtacaagggagtatggcgaggggatggggtgatgacaacgcgttgcccttgtggggaagactttacaggacacgtaaggaatgggtccatgaggatagcaggatcaggcctctgcgctaacatgtggcatggcaccttccccatcaatgaatacaccactgggccgagtacacccgtccccgcgcacaattactcgcgtgccctgtggcgcgtgacctccgacagttatgtcgaggtgcgtagggtgggggatactcattacgtggtgggggccacgaacgacggcctaaaaatcccatgccaggtgccagcgccagagttcttcaccgagttagacggagtgaggctccaccgctatgctcctccttgtaagccccttctgagggacgagatcaccttcagtgtaggattgcattcatatgcaaatgggtcccagctttcatgcgaacccgagccggacgtcgcagtgttaacctcgatgttgcgagatcctgctcacatcaccgccgccacagcggcccggcgccttgcgcgcggttcacctccatcggaagctagctcctctgccagccagctctcagctccgtcactgaaagccacttgtcaaacgcacaggccgcatcctgacgctgagctgatagacgctaaccttctatggaggcaagagatgggtagcaatatcactcgggtagagtccgagacgaaggtggtgatccttgactctttcgagcccctgagggccgaagaagacgacacagagctctcgataccggcagagtgcttcaagaaaccgcccaagtacccaccggcccttcctatctgggccagaccggactacaaccctcctttgctcccttcatggaaggacccaacctacgagccgcccgcagttcacgggtgtgccttgccaccaactcgtcccgcaccagtgcctcccccccgcagaaagaggacaatcaagctcgatgggtcgaatgtgtccgcggcactccttgccctggcagagagatctttcccgtcgacgaaaccggaagggacaggcacatcctcctcaggagtaggtacagaatccaccgctgagtccggtgactcgcccgaaactggcgaagaatcggacgtggagtcatattcgtccatgccgccccttgagggggaaccgggtgacccggacctggatgctgactcttggtccaccgtcagtgactccgaagagcagagcgtggtttgctgttctatgtcatactcctggactggcgccataataacaccatgcagcgccgaggaggaaaaactacctatcagtccactcagcaactcgttgctgagacaccacaatcttgtctactctacgtcatctcgaagcgccgccgcacgtcagaagaaggttaccttcgacagactgcaagtgctcgatgaccattacaaaaatgtactcaaggaggtgaaggagcgagcatctggggtgaagggtcgcctgctctctttcgaggaagcatgctctcttgtccccccccactccggccggtcgaagtacgggtatagtgcaaaggatgttcgttccttgtccagcaaagccatgaaccagatccgttccgtctgggaggacttgttggaggacaatagtaccccaattcccaccaccattatggcgaagaacgaggtgtttagcgtgaaccccgcgaaggggggccgcaaacctgcccgtctcatcgtctatcctgatctgggggtgcgggtctgtgagaaacgcgccctatatgacgtgatacagaagttgtcaattgcaacgatggggcctgcctacgggttccaatactcgcccaaacagcgagtggagcatcttcttaagatgtggacgtcgaagaagacccccttagggttttcatacgacactcgttgctttgactctactgtcaccgaacatgacatcaggacggaggaggggatataccaatgttgtgaccttgaaccagaggctcggaaggcaatcagcgctctcacagagcgactgtacatcgggggtcccatgtataacagcaaaggactccaatgcggttatcgccgctgccgcgctagcggcgtcttgcctaccagctttggcaacacaataacctgttacatcaaggccaccgcagccagcagagctgcgggtctcaaaaacccgtctttccttgtctgtggagacgatttggtggtgatatctgagagttgcggtgtcgaggaagacagaacagccctgcgagccttcacggaggccatgaccagatattctgctccccctggagacgccccacagcccacctacgacttggagctgatttcatcttgctcctcaaacgtctccgtggcatgcgacggagcgggtaagaggtactattacctcacccgggacccagagactcccttagcccgtgcggcttgggagactgctcgccacactccagttaactcctggttgggaaatatcatcatgttcgcccctaccatttgggtccgcatggtgttgataacccacttcttttccatactgcaagcccaggagcagcttgaaagagccctagactttgaaatgtacggggctacctactcagtcactccactggacttaccagctatcattgaaagactccatggtttgagcgcgttctcgcttcacggttactctccaactgagctcaacagagtggcgggggctctcagaaagcttgggatcccccccctacgagcgtggagacatcgggcacgagcagtacgcgccaaactcattgcccaaggaggaaaggccagaatatgcggtctatacctctttaactgggcagtgcgcaccaaaaccaaactcactccattgccgactgcgggccagctagatctttctagttggtttacggtcggtgtcggcgggaacgacatttatcacagcgtgtcgcgtgcccgaacccgccatttgctgctttgcctactcctacttaccgtaggggtaggcattttcctcctacctgctcggtgagctggtaggttaacaccccaaccctgtgttttt

SEQ ID NO: 771 - DNA, 9513 bp, Hepatitis C Virus
acccgcccctaaaaggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggtcatttgggcgtgcccccgcaagactgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacactaaccgccgcccacaggacgttaagttcccgggcggtggccagatcgttggcggagtatacttgctgccgcgcaggggcccgagattgggtgtgcgcgcggcgaggaaaacttccgaacggtcccagccacgtgggaggcgccagcccatccctaaagatcggcgctccactggcaagtcctggggtaggccaggatacccttggcccctgtaccggaatgagggcctcggctgggcaggatggctcctgtccccccgcggttctcgcccttcatggggccccagtgacccccggcataaatcgcgcaacttgggcaaggtcatcgataccctaacgtgcggttttgccgacctcatggggtacattcccgtcgtcggcgctcccgttggaggcgttgccagagctctcgctcatggggtgagggttctggaggacgggataaattatgcaacggggaatttgcccggttgctccttttctatctttcttttagccctcttgtcttgtatctctgtgccagtttccgctgtagaagtcagaaacaccagcagttcatacatggcgaccaacgattgctctaactccagcatcgtttggcagctcgaaggcgcagtgctccatactcctggatgtgtcccctgtgagaagaccggaaacaagagccgatgttgggtgccagtcactcccaatatagctataaatcaacccggcgctctcactaaggggttgcgagcgcacatcgatgtcatcgtgatgtctgctacgctctgttctgccctctatgtgggggatgtgtgtggcgcgttgatgatagccgctcaggtcgtcgtcgtatcgccacagcaccaccactttgtccaggaatgcaactgttccatatacccgggcaagatcacggggcaccgcatggcctgggatatgatgatgaactggtcgcccactaccaccatgctcctggcgtacttggtgcgcatcccggaggttgtcctggacatcatcactgggggtcactggggcgtgatgtttggcctggcttacttctccatgcagggggcgtgggcaaaggtcgtcgtcatcctcttgttgaccgctggggtggaggcatccacctacaccaccggggcggttgtcggaagaagcacgcatctctttaccagtatgttcagtttagggtcccaacagcgcgtccagctcatccacaccaacggaagctggcacatcaatcgcacagctctgaactgcaacgacagtctggaaaccggcttcctcgcggccctgttctataccagctcctttaacagctcaggatgccccgagcgcttagccgcttgtcggagcatcgagtccttccgcataggatggggctcccttgagtatgaggagagtgtcaccaatgatgcagacatgagaccgtactgctggcattatcctcctagaccttgtggcatagttcctgcacggactgtgtgtggcccggtgtactgcttcactcccagcccagtcgtggtgggcaccactgatagggctggggcgcccacctacaattggggggaaaacgagacagatgtcttcctgctcaacagcacccgcccaccgaagggtgcttggtttgggtgcacgtggatgaacggcaccgggttcaccaagacctgcggcgcgccaccttgccgcatcaggaaagatttcaacgccagtgaggacctgttgtgccccacggactgcttcaggaaacacccaggggcgacctacatcaaatgtggggctgggccgtggttaacaccccggtgcctagtcgattacccctacaggctgtggcattatccgtgcacagtcaactataccatctacaaagtacggatgttcgtagggggtattgaacacagacttcaagcagcctgcaacttcactcgtggggaccgctgcaatctcgaggacagggataggagtcagctaagcccgctgctgcactccaccactgaatgggctattctaccctgttcgtacacagatctaccagctttgtcaactggcctgctgcatctccaccaaaacatcgtggacgtgcagtatttatacggcctatcaccagccatcacgaagtacgtcgtcaagtgggagtgggtcgttcttctgttcctgcttttggcggacgccagggtttgtgcctgcttatggatgctcctcctactgggtcaggctgaagcggctctagagaagttggtcattttacatgcagccagtgctgctagctctaatggtcttctgtatttcatcctcttctttgtagccgcttggtgtattaaaggtcgtgcggtcccgatggtaacgtataccttactgggatgctggtcctttgtcttactgctcatggcgctgccccaccaggcttacgcccttgacgcggcagagcaaggccagatcggcatggcgttactgatcgccataaccgccttcacgatcacaccggcatacaaaatccttctcagccgatgtttgtggtggacgtgctacatgctggtcctggcggaagccctgattcaagattggataccaccgctgcaggcgcggggcggccgtgatggcgtcatctgggccatgaccatgttttacccgggtgtggtgtttgacataaccaagtggttgttggcgatcctcggacccggctacctcttcagagctgctgtgatgcgcacgccatacttcgttagggcaaatgctcttctgaggatgtgtgcgctggtgaagcaactcgcggggggcaagtacgtccaggtagcactgatcacccttggcaagtggacaggcacatacatctatgaccatctatcccccatgtcagactgggcagccgacggcctgcgcgacctagcggtggctgtcgagcctatcgtcttcagcccaatggagaggaaagtcatcgtgtggggggcggagacgacggcttgtggtgacatcatacacgggcttcccgtctctgcccggctcggccaagaggtcctgctgggccctgctgatggatacacctctaaagggtggagacttctcgcccctatcaccgcatacgcccagcaaacccgagggttgctgagcgccatagtggtgagcatgacggggcgcgacaagacggaccaggctggggagattcaggttttgtccactgttacacaatctttccttggaacatcaatctcaggggttctgtggaccgtcttccacggtgccggaaacaaaacgctggctggttcccgtggcccggtcacgcagatgtactccagcgccgagggagacctcgtgggatggcctagtccccctggtaccagatccctggaaccttgcacttgcggggcagttgacctctaccttgtcactcggaacgccgatgtcatcccggcccggagacggggggatcggagaggagcgctgctctccccgaggcccctgtcctccctcaaggggtcgtcgggagggcctgtcctctgccctaggggccacgccgtcggaatcttccgggcggccgtgtgctccaggggggtcgccaagtccatcgacttcatccccgtcgagtccctcgacgttgtgactaggtctccaaacttcactgacaacagtacacctccagctgtgccccagacctaccaggtgggatatctccatgctcccaccggtagcgggaagagtaccaaagtccccgcagcgtatgctgctcaggggtacaaagtactggtattgaacccctcggtggctgccaccctggggtttggggcctatatgtcaaaagcatatggaatcaatcccaacatcagaactggggttcgcacggtgacaactggggatgccatcacctactccacgtacggcaaattcctcgcggatggaggctgctccggcggcgcctatgatgtcataatatgcgacgagtgccattcagtggattctacgaccatccttggcatcgggacagtccttgaccaagctgagacggcaggggttaggttgacagtcctggccacagcaaccccaccagggtctgtgacaactccacatcccaacatagaggaggtggccctcggacatgagggcgaaatccccttctatgggaaggccattcccctctcagccatcaagggagggcgacatctaatcttctgccactcaaagaaaaagtgcgacgaactcgcggtggcccttcgagggatgggcctcaatgcggtggcatactacagagggcttgacgtctcaataataccaacacaaggagacgtggtggttgtcgccaccgatgccctcatgacaggatatactggggacttcgactctgtgatcgactgcaacgtggcggtcacccaagtcgtggacttcagtttagaccctacttttaccataaccacacaaactgtcccccaggactccgtgtcccgcagccagcgccggggcaggaccgggagagggaggttgggcatatataggtatgtctcttccggtgagagggcgtcggggatgtttgacaccgtggtgctctgtgagtgctacgacgccggagcggcctggtacgaactcactccggcagagaccaccgtcaggctgcgggcatacttcaatacacccggattgcccgtgtgccaagaccacctggaattctgggaggccgtgttcactggcctcacacatatagatgcccatttcctctcccagacgaagcaggcaggggagggtttcccgtacctggtggcctaccaggccacggtgtgcgccagagccaaagctccccccccctcctgggacgtaatgtggaagtgcctgatccggcttaaacccacacttgtgggccctacacccctgttatatcgcctaggctcggtcactaatgaggtcaccctcacccaccccgtaaccaagtacatcgccacgtgcatgcaagccgaccttgagatcatgacaagcacgtgggtccttgcggggggggtcttggccgctgtagctgcttattgcctagctactgggtgtgtaagcatcatcggccgcatccatgtcaaccagaagacgatcatcgctcctgataaggaggtcctttatgaggcatttgatgagatggaggaatgtgcctctaggaccgccctcatcgaggaggggcatcggatagccgagatgctaaaatccaaaatacagggcctaatgcaacaagcctccaagcaggcacagggagtacaacctgccgtgcaagcaacatggcccaagctagagcaattctgggccaagcacatgtggaacttcatcagtggcatccagtaccttgcggggctgtccacgttaccgggaaaccccgccgtagcctcaatgatgtccttcagtgctgctctcaccagcccactctccaccagcactaccatcctccttaacatcatgggggggtggctcgcttcccaaattgctccccctgcaggggccactggcttcgtcgtcagtggtctagtaggggccgctgtgggtagcataggcctagggaagatactggtggatgtattggccgggtatggcgcgggtatttcgggggctctcgttgctttcaagatcatgtctggcgagaagccctccgtggaggacgtcgtcaacctgctgcccgccatcctctctcccggtgctctcgtggtgggggtgatctgtgcggccattctgcgccgccacgtgggacaaggggaaggcgcggtccaatggatgaacaggcttatcgcctttgcgtccagaggtaaccatgtcgccccgacacactacgtggcggagtcagatgcgtcgcagcgggtcacccagctgcttggctcccttacaataaccagcctgctcaggagactacaccaatggatcacagaagattgccctgtcccctgctccggctcatggcttcgagacgtgtgggactgggtctgctcaatcctaatagacttcaagaactggctatctgctaaattattccctaggttacctggcattcccttcatttcctgtcaaaagggttacagagggacatgggccggtactggtattatgactacacggtgtccatgcggtgccaacatcaccggcaacgtccgcttgggcaccatgagaatatcaggacctaagacctgcttgaatacctggcaggggacattccccatcaactgttacacggagggctcgtgcgtgcccaaacccgctccaaatttcaaaaccgctatctggagggtggcggcatcagaatatgcggaggtaacgcagcacgactcccatgcgtatgtgacagggttgacagcagacaacctaaaggttccttgccagctgccatgtccggagtttttctcctgggtggacggggttcagatccatcgattcgctcccacgccaaaggcgttcatgagggacgaggtatcattcagcgtgggtctcaactcctacgtggtcgggtcacagctcccttgcgagcctgagccggacacggaggtgttggcatccatgctgacagacccgtcccacattacggccgaggcggcggcgagacgcctggcccggggctcacccccctctgcggctagttcttcggctagccagctgtcagcgccgtcgttgcgagctacctgtaccacccacgccaaatgtcccgacattgacatggtggatgccaatctcttctgctggtgtactatgggaggcaatatgactcgcatagagtctgagtctaaggtgctcatggtcgactccttcgaccccgtggtcgataaggaggacgaacgcgagccttcaataccatcagagtacttgcttcccaaaagcagattcccaccagcactaccaccctgggcgcggcctgattacaatccgccgctcctagagacctggaaaagaccagactatcaaccaccagtggtcgccggatgtgctctccctcctcctggaaccaccccagtgccgcctcctaggaggcggcgagctgtggtgctggaccagagtaacgtgggagaggctctcaaggagcttgccatcaagagctttggctgccccccccctagcggcgacccaggccactctacgggggggggtaccaccggcgagaccagcaaatcaccaccagacgaacctgatgattcggaggcgggatccgtgtcttccatgcccccccttgagggggagcctggagacccagacctggagcctgagcaggtagagcaccccgcccccccacaagaggggggagccgctcccggctcggactccgggtcctggtccacgtgctccgatgtggacgactctgtggtgtgttgctccatgtcatactcctggaccggggcgttgataactccctgtagtccagaagaggaaaagttaccaataaaccctctgagtaactcgttgttgcggtaccacaacaaagtgtactgcaccacgtcaaggagtgcctcacaacgggcgaaaaaggtgactttcgacagggtgcaactactagactctcattatgaatcagtcttgaaggacgtcaagcaggcagccaccaaggtcagtgctaagctcctctccatcgaggaggcatgtgcattgaccccgccccattccgctagatcaaagtacggatttggggcgaaggaggttcgcagcttgtccaggagggccgttgaccacatcaagtccgtgtgggaggacctcctggaagaccactgttcaccaattgatacaaccatcatggccaaaaacgaggtgttctgcgttgaccccaccaaaggtggaaagaaaccggctcgcctcatcgtgtaccctgatctaggtgtcagggtttgcgagaagatggccctctatgacataacacagaagcttcccgtcgcagtgatggggcagtcctacggattccagtactctccagcccagcgggtcgatttcctcctacaagcgtggaaggaaaagaagacccctatggggttttcctatgacacccgctgttttgactctacagtcacggagagagacatcagaaccgaggagtccatctatctgtcctgttccttgcctgaggaagctcgaactgctatacactcactgactgagagactatacgtagggggccccatgacaaacagcaaagggcaatcctgcggatacaggcgttgtcgcgcgagcggagtgctcaccaccagcatgggcaatactctcacgtgctacgtgaaagctaaggcggcgtgcaacgccgcaggcattgttgcccccaccatgttggtgtgcggcgacgacctggtcgtcatctcagagagtcagggggtcgaggaggacgagcggaacctgagagtcttcacggaggctatgaccaggtactccgcccctcccggcgatcctcccaaagcagaatatgacctggagctgataacatcttgctcttccaatgtatccgtggcgttagacccgcgaggccgccgcaggtactacctgactagagaccccaccactccactcgccagggctgcctgggagacagcaagacactcccctgtcaattcatggctgggaaacatcatccagtacgccccgacagtttgggtgcgcatggtcctaatgacacacttcttctccgtcttgatggcccaggataccctggaccaggatctcaacttcgaaatgtacggagcagtgtactcagtcagtcccctggacctcccggccataattgagagactacatgggcttgaagccttttcactgcactcatactctccccacgaactcactcgggtggctgccgctctcagaaaacttggggcgcccccccttagagcgtggaagagtcgagctcgtgcagtgagggcttccctcatcagccgaggggggagcgcggccacatgtggccgctacctcttcaactgggctgtgaggacgaagctcaaactcactccattgccggcggcacgcctcctggacttgtccagctggttcaccgtcagcgctggcgggggcgacatatatcacagcgtgtcgcgagctcggccccgcctcttactccttggcctactcctgctttgcgtaggggtaggcatcttcctactccccgctcggtagagcggcacatttagctacactccatagctaattgttccctttttttttttttttttttt

SEQ ID NO: 772 - DNA, 9410 bp, Hepatitis C Virus
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggcagggcctgggctcagcccgggtacccttggcccctctatggcaatgagggcttagggtgggcaggatggctcctgtcaccccgcggctcccggcctagttggggccccacggacccccggcgtaggtcgcgtaacttgggtaaggtcatcgataccctcacatgcggcttcgccgacctcatggggtacattccgctcgtcggcgcccccttgggaggcgctgccagggccctggcgcatggcgtccgggttctggaagacggcgtgaactatgcaacagggaatctgcccggttgctctttctctatcttcctcttggctctgctgtcctgtctgaccatcccagcctccgcttatgaggtgtgcaacgcgtccgggctgtaccatgtcacgaacgattgctccaactcaagcattgtgtatgaggcacaggacatgatcatgcacaccccggggtgcgtgccctgcgttcgggagaacaactcctcccgctgctgggtagcgctcactcccacgctcgcggccaggaatgccagcatccccactacgacaatacggcgtcacgtcgatttgctcgttggggcggctgctttctgctccgctatgtacgtgggggatctctgcgggtctgtcttcctcgtctctcagctgttcaccttctcgcctcgccggtatgagacagtacaggactgtaattgctcgatctatcccggccacgtatcaggccatcgcatggcttgggatatgatgatgaattggtcacctacaacagccctagtggtatcgcagttgctccggatcccacaagccgtcgtggacatggtggcaggggcccactggggagtcctggcgggccttgcctattattccatggtggggaactgggctaaggtgttgattgtgatgctactctttgccggcgttgacgggaacacctacacgacaggggcggcgcagggccgcaccgttagtaggttgacatccatctttacacctggagcatctcagaatatccagcttataaacaccaacggcagctggcacattaacaggactgccctgaactgcaatgactccctccaaaccgggttcattgccgcactgttctacgcacgcaggttcaactcgtccggctgcccacagcgcttggccagctgccgctccattgacaagttcgctcaggggtggggtcccatcacttacgctgagggccacgactcggaccagaggccctattgctggcactacgcaccgcgaccgtgcggtattgtacccgcgcagcaggtgtgtggtccagtgtattgcttcaccccaagccctgttgtggtggggacgaccgaccgtttcggcgcccctacgtataactggggggcgaacgagacggacgtgctgctcctcaacaatacgcggccgccgcaaggcaactggttcggctgtacatggatgaatggcactgggttcaccaagacgtgcgggggccccccgtgtaacatcgggggggccggcaacaacaccctaacttgccccacggactgcttccggaagcaccccgaggccacttacgcaaagtgcggttcggggccttggttaacacctagatgcatagttgactacccatacaggctttggcactacccctgcactgtcaatttttccatctttaaggttaggatgtatgtggggggcgtggagcacaggctcaccgccgcatgcaattggactcgaggagagcgttgtgatttggaggacagggacagatcagagctcagcccgctgctgttgtccactacagagtggcaaatactgccctgctccttcaccaccctaccggctctgtccactggtttgatccatctccaccagaacatcgtggacgtgcaatacctgtacggtgtagggtcagcggttgtctccttcgcaatcaaatgggagtatgtcctgttgcttttccttctcctggcagacgcgcgcgtctgtgcctgtttgtggatgatgctgttggtagcccaggccgaggctgccctagagaacctggtggtcctcaatgcagcatccttggccggagtgcatggcatcctctccttcctcgtgttcttttgtgctgcctggtacatcaaaggcaagctggtccctggggcggcatatgctctctacggcgtatggccgctactcctgctcctgctggcgttaccaccacgggcgtacgccatggaccgggagatggccgcatcgtgcggaggcgcggtttttataggtctggcactcttgaccttgtcaccatactacaaagtgttcctcgccaagctcatatggtggttgcaataccttatcaccagagccgaggcgcagttgcaagtgtggatccccccccttaacgttcggggggggcgcgatgctatcattctcctcacgtgtgcggtccatccagagctaatctttgacatcaccaaaattgtgctcgccatactcggtccgctcatggtgctccaggctggtatagcaaaagtgcccgactttgtgcgcgctcaaggggtcatccgtgaatgcattttggtgcggaaagtcggtgggggtcaatatgttcaaatggccttcatgaagttggccgaattgaaaggtacgtccgtctatgaccacctcactccactgcgggactgggcccacacaggcctacgagacctggcggtagcggtcgagcccgtcgtcttctccgacatggaaatcaagatcatcacctgggggggagacaccgcggcgtgtggggacatcattatgggtctacctgtctccgcccgaagggggagggagatactcctaggaccagccgacagtcttgaggggcaggggtggcgactcctcgcgcccatcacggcctactcccaacagacgcggggcctgtttggctgcattatcaccagcctcacgggccgggacaagaaccaagtcgagggggaagttcaagtggtttccaccgcgacgcagtctttcctagcgacctgcgtcaacggcgtgtgctggactgtctaccacggcgccggctcaaagaccctagccggcccaaagggtccaatcacccaaatgtacaccaatgtagaccaggacctcgtcggatggccggcgccccccggagcgcggtccttgacaccatgcacctgcggcggctcggacctttacttggtcacgagacacgctgatgtcattccggtgcgccggcggggtgacagcagggggagcttactatcccccaggcccatctcctacttgaagggctcctcgggcggtccactgctctgtccctcggggcacgttgtgggcatcttccgggctgctgtgtgcacccggggggttgcgaaggcggtggactttgtacccgttgagtctatggaaactaccatgcggtccccggtcttcacggacaactcgtcccccccagccgtaccgcagacattccaagtggcccacctacacgctcccactggaagcggcaagagcactaaggtaccggctgcatatgcagcccaagggtacaaagtgctcgtcctaaatccgtccgttaccgccaccttagggtttggggcgtatatgtctaaggcacacggtgtcgatcctaacatcagaactggggtaaggaccatcaccacgggcgcccccatcacgtactccacctatggcaagttccttgccgacggtggttgctctgggggcgcctatgacatcataatgtgtgatgagtgccactcaattgactcgacttccattttgggcatcggcacagtcctggaccaagcggagacggctggagcgcggctcgtcgtgctcgccaccgctacgcctccgggatcggtcaccgtgccacatcccaacatcgaggagatagccttgtccaacaccggagagatccccttctatggcaaagccatccccatcgagaccatcaaaggggggaggcatctcatcttctgccattccaagaagaaatgtgacgagctcgctgcaaagctgtcgggcctcggacttaacgctgtagcgtattaccggggtctcgacgtgtccgtcataccggccagcggggacgtcgttgtcgtggcaacagacgctctaatgacgggctttaccggcgattttgactcggtgatcgactgtaatacatgtgtcacccagacagtcgacttcagcttggacccaaccttcaccattgagacgacgaccgtgccccaagacgcggtgtcgcgctcgcagcggcgaggtaggaccggtaggggcaggagaggcatctacaggttcgtgactccaggagaacggccctcgggcatgtttgactcctcggtcctgtgtgagtgctatgacgcgggatgtgcttggtacgagctcacgcccgccgagacctccgttaggttgcgggcttacctaaatacaccagggttacccttctgccaggaccacctggagttctgggagggcgtcttcacaggcctcacccacatagatgcccacttcttgtcccaaaccaagcaggcaggagaaaacctcccctacctggtagcataccaagccacagtgtgcgccagggctcaggctccacccccatcgtgggatcaaatgtggaagtgtctcacacggctaaagcctacgttacacgggccaacaccactcctttatagactaggagccgtccaaaatgatgtcaccctcacacaccccataaccaaatacatcatgacatgcatgtcggctgacctggaggtcgtcaccagcacctgggtgctagtaggtggcgtcctggcagctctgaccgcgtattgcctgacgacaggcagcgtggtcattgtgggcagaatcatcttgtccgggaagccggctgttatccccgacagggaggctctctaccaggagttcgatgagatggaagagtgtgcctcacacctcccttacatcgaacagggaatgcagctcgccgagcagttcaagcagaaggcgctcgggttgctgcaaacagccacaaaccaagcggaggctgctgctcccgtggtggaatccaagtggcgagcccttgaggctttctgggcgaagcacatgtggaatttcatcagcgggatacagtacctagcaggcttgtccactctgcctggaaaccccgcgatagcatcattgatggcattcacagcctccatcaccagcccgctcaccacccaaagcaccctcctgttcaacatcttgggagggtgggtggccgcccaactcgctccccccagagccgtttcggccttcgtgggcgccggcatcgctggcgcggctgttggcagcataggccttgggaaggtgcttgtagacattctggcgggctatggagcaggagtggcgggtgctctcgtggccttcaaggtcatgagcggcgagatgccttctaccgaggacctggtcaacttactccctgccatcctctctcctggcgccctggtcgtcggggtggtgtgcgcagcgatactgcgtcggcatgtgggcccaggagagggcgctgtgcagtggatgaatcggctgatagcgttcgcttcgcggggcaaccatgtctcccccacgcactatgtgcctgagagcgacgccgcggcgcgcgtcactcaaatcctctccagcctcaccatcactcagctgctgaggaggctccatcagtggatcaatgaggactgctccacgccatgttccggctcgtggctaagggatgtttgggactggatatgcacggtgttgactgacttcaagacctggcttcagtccaagctcctgccgcggttgccgggagtccctttcttctcatgccaacgtgggtacaggggggtctggcggggagacggtatcatgcaaaccacctgcccatgcggagcgcagatcactggacatgtcaagaacggttccatgaggatcgtcgggcctaagacctgtagcaacacgtggcatggaacattccccatcaacgcatacaccacgggcccctgcacaccctccccggcgccaaactattctagggccctatggcgggtggccgctgaggagtacgtggaggttacgcgggtgggggatttccactacgtgacgggcatgaccactgacaacgtaaaatgcccgtgccaggttccgccccccgaattcttcacggaagtggatggggtacgcctgcacagaaacgctccggcgtgtggacctctcctacgggaggaggtcacatttcaggtcgggctcaaccaatacctggttgggtcacagcttccgtgcgagcctgaaccggatgtgacggtgctcacttccatgcttaccgacccctcccacattacaggagaggcggctaagcgtaggctggccagggggtctcccccctccttggccagctcctcagctagccagctgtctgcgccttctttgaaggcgacatgcactacccatcatgactccccagacgctgacctcatcgaggccaacctcctgtggcggcaggagatgggcgggaacatcactcgcgtggagtcagagaacaaggtaattatcctggactctttcgacccgctccgagcggaggaggatgagagagaggtgtccattccggcggagatcctgcggaaatccaagaagtttcctccagcgttacccatatgggcacgcccggattacaaccctccactactagagtcctggaaagacccagactacgtccctccggtggtacacgggtgcccactgccacctgccaaggcccctccaataccacctccacggaggaagaggacggttgttctgacagagtccaccgtgtcttctgccttggcggagctcgccacaaagacctttggcagctccggatcatcggccgctgacagaggtacggcgaccgccccccccgaccaggcctccaatgacggtgacgcgggatccgacgttgggtcgtactcctctatgcccccccttgagggggagccgggggatcccgatctcagcgacgggtcttggtctaccgtgagcgaagaggctggcgaggatgtcgtctgctgctcgatgtcctacacatggacgggcgccctgatcacgccatgcgctgcggaggaaagcaagttgcccatcaacgcgttgagcaactctttgctgcgtcaccacaacatggtctacgctacaacatctcgcagcgcaagccagcggcagaagaaggtcacctttgacagactgcaagtcctggacgaccactaccgggacgtgctcaaggagatgaaggcgaaggcgtccacagttaaggctaaacttctatccgtagaggaagcctgcagactgacgcccccacattcggccaggtccaaatttggttatggggcaaaggacgtccggaacctatccagcggggccgtcaaccacatccgctccgtgtggaaggacttgctggaagacactgagacaccaattgataccaccatcatggcaaaaaatgaggttttctgcgtccaaccagagaaaggaggccgcaagccagctcgccttatcgtgttcccagacttgggggttcgtgtgtgcgagaaaatggccctttacgacgtggtctccacccttcctcaggccgtgatgggctcttcatacggattccagtactctcctgggcagcgggttgagttcctggtgaatgcctggaaatcaaagaaatgccctatgggctttgcatatgacacccgctgttttgactcaacggtcaccgagagtgacatccgtgtcgaggagtcaatttaccaatgttgtgacttggcccccgaagccagacaggccataaggtcgctcacagagcggctttatatcgggggtcctctgactaattcaaaagggcagaactgcggttatcgccggtgccgcgcgagcggcgtgctgacgaccagctgtggtaatacccttacatgttacttgaaagcctctgcggcctgtcgagctgcgaagctccaggactgcacgatgctcgtgtgtggagacgaccttgtcgttatctgtgagagtgcggggacccaagaggacgcggcgagcctacgagtcttcacggaggctatgactaggtactctgccccccccggggacccgccccaaccggaatacgacttggagttgataacatcatgctcctccaacgtatcagttgcacacgatgcatctggcaaaagggtgtactacctcacccgtgaccccaccaccccccttgcgcgggctgcgtgggagacagctaaaagcactccagtcaactcctggttaggcaacatcatcatgtttgcacccactctgtgggtaaggatgattctgatgactcacttcttctccatccttctagcccaggagcaacttgagaaagccctagactgccagatctacggggcttgttactccattgagccacttgacctacctcagatcattcagcgactccatggtcttagcgcattttcactccatagttactccccaggtgagatcaatagggtggcatcatgcctcaggaaacttggggtaccacccttgcgaacctggagacatcgggccagaagtgtccgcgctaagctactgtcccagggggggagggccgccacctgtgggaggtacctcttcaactgggcagtaaagaccaaactcaaactcactccaatcccagctgcgtctcagttggacttgtccaactggttcgttgctggctacagcgggggagacgtgtatcacagcctgtctcgtgcccgaccccgctggttcatgctttgcctactcctactctccgtaggggtaggcatctacctgctccccaaccgatgaacagggagctaaacactccaggccaataggccatcccgtttttttttt

SEQ ID NO: 773 - DNA, 9410 bp, Hepatitis C Virus
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccagcccgagggcagggcctgggctcagcccgggtacccttggcccctctatggcaatgagggcatggggtgggcaggatggctcctgtcaccccgcggctctcggcctagttggggccccacggacccccggcgtaggtcgcgtaatttgggtaaggtcatcgataccctcacatgcgggttcgccgacctcatggggtacattccgctcgtcggcgcccccctagggggcgcttccagggccctggcacatggtgtccgggttctggaggacggcgtgaactatgcaacagggaatctgcccggttgctctttctctatcttcctcttggctttgctgtcctgtttgaccatcccagcttccgcttatgaggtgcgcaacgcgtccggggtgtaccatgtcacgaacgactgctctaacgcaagcattgtgtatgaggcagcggacatgatcatgcatacccccgggtgtgtgccctgcgttcgggaggccaattcctcccgctgctgggtagcgctcactcccacgctcgcggccaggaactccagcgtcccaactacgacaatacgacgccacgtcgatttgctcgttggggcggctgctttctgctccgctatgtacgtgggggatctctgcggatctgttttcctcgtctcccagctgttcaccttctcgcctcgccggcatgagacggtacaggactgcaattgttcaatctatcccggccacgtatcaggtcaccgcatggcttgggatatgatgatgaactggtcacctacaacagccctagtggtatcgcagctactccggatcccacaagctgtcatggacatggtggcgggggcccactggggagtcctggcgggccttgcctactattccatggtggggaactgggctaaggtcttgattgtgatgctactctttgccggcgttgacgggaacacctacgtgtcagggggggcgaagagccataccacccaagggctcgtgtccctctttgcacctggggcgcagcagaaaatccagcttgtgaataccaacggcagttggcacatcaacaggactgccctgaactgcaatgactccctcaacactgggttcctcgccgcgctgttctacacacacaggttcaactcttctggatgcccagagcgcatagccagctgccgctccatcgacgcgttcgctcaggggtggggtcccatcacttacgctgagccgggcagctcggaccagaggccctattgctggcactacgcccctcgaccgtgcggtatcgtacccgcgtcggaggtgtgtggtccagtgtattgcttcaccccaagccccgttgtggtggggacgaccgatcgttctggcgcccctacgtatagctggggggagaatgagacggacgtgctgctcctcaacaacacgcgggcgcctcaaggcaactggttcggctgtacatggatgaatggcactgggttcaccaagacgtgcgggggccccccgtgtaacatcgggggggtcggcaacaacactttgacctgccccacggactgcttccggaagcaccccgaagccacctacaccaaatgcggttcggggccttggttgacacccaggtgcatggtggactacccatacaggctttggcactacccctgcactgtcaactttaccatcttcaaggttaggatgtatgtggggggcgtggagcacaggctcaacgccgcatgcaattggactcgaggagagcgttgtgacttggaggacagggacagatcagagcttagcccgctgctgctatctacaacagagtggcagatactgccctgttccttcaccaccttaccggttctgtccaccggtttgatccatctccatcagaacatcgtggacgtgcaatacctgtacggtgtagggtcggcggttgtctcctttgtaatcaaatgggagtatatcctgctgctcttcctcctcctggcggacgcgcgcgtctgtgcctgcttgtggatgatgctgctgatagctcaggctgaggccgccctagagaacctggtggtcctcaatgcggcgtccgtggccggagcgcatggctttctctccttccttgtgttcttctgtgctgcctggtacatcaaggggaagctggtccctggggcggcatatgccttctatggcgtatggccgctactcctgctcctgctggcgttaccaccacgagcatacgccatggaccgggagatggctgcatcgtgcggaggcgcggttttcgtaggtctagcactcttgaccttgtcaccacactataaagtggttctcgcccgactcatatggtggttacaatattttatcaccagagccgaggcgtgtctgcaagtgtggatcccccccctcaacgtccgggggggccgcgatgccatcatcctcctcacgtgtgcgctccacccagagctaatcttttccatcaccaagatcttggtcgccatactcggcccgctcatggtgctccaggctggcataacaaaaatgccgtactttgtgcgcgctcaaggcctcatccgtgcatgcatgttggtgcggaaagtcgctgggggtcattatgtccaaatggctttcatgaagctggccgcactgacgggtacgtacgtctatgaccaccttactccactgcaggactgggcccacacgggtctacgggaccttgcggtggcagttgagcccgtcgtcttctctgacatggagactaagatcatcacctggggggcagacaccgcggcgtgcggggacatcatcttgggtcttgccgtctccgcccgaagggggaaggagatctttctgggaccggccgatagtcttgaagggtcggggtggcgactcctcgcgcccatcacggcctactcccagcagacacggggcctacttggctgcatcatcactagcctcacaggccgggacaagaaccaggtcgagggggaggtccaagtggtttccaccgcaacacagtccttcctggcgacctgcaccaacggtgtgtgttggactgtctaccatggtgccggctcgaagaccctagccggtcctaagggcccaatcacccaaatgtacaccaatgtggaccaggacctcgtcggctggcaggcaccctccggggcgcgttccttgacaccgtgcacctgcggcagctcggacctttacttggtcacgaggcatgctgatgtcattccggtgcgccggcggggcgacggcagggggagcttgctctcccccaggcccgtctcctacttgaagggctcttcgggcggcccactgctctgcccctcggggcacgccgtgggcatcttccgggctgccgtgtgcacccggggggttgcgaaggcggtggacttcatacccgttgagtctatggaaaccactatgcggtctccggtcttcacggacaactcgtcccccccggccgtaccgcaaacattccaagtggcccatctacacgctcccactggaagcggcaagagtaacaaggtgccggttgaatatgcagcccaagggtacaaggtacttgtcctgaacccatccgtcgccgccactttaggctttggggcgtatatgtctaaagcacatggtgttgaccccaacatcagaactggggtaaggactatcaccacgggcgcccctatcacatactccacctatggcaagttcctcgccgatggtggttgctctggaggcgcctacgacatcataatatgtgatgagtgccactcgactgactcgaccagcatcttgggcataggcacagtcctggaccaagcggagacggctggagcgcggcttgtcgtgctcgccaccgctacgcctccgggatcggtcaccgtgccacatcccaatatcgaggaggtggctctgtccaacactggagagatccccttctacggcaaagccatccccatcgagaccatcaagggggggaggcatctcattttctgccattccaagaagaaatgtgacgaactcgccgcaaagctgtcgggtctcggaatcaatgctgtagcatattaccggggtcttgatgtgtccgtcataccggccagcggagacgtcgttgttgtggcaacagacgctctaatgacgggctttaccggcgactttgactcagtgatcgactgtaatacatgtgtcacccagacagtcgatttcagcttggaccctaccttcaccattgagacaacgaccgtgccccaagacgcggtgtcgcgctcacaacggcggggcaggactggtaggggcagggcaggcatctacaggttcgtgactccaggagaacggccctcgggcatgttcgattcctcggtcctgtgcgagtgctatgacgcgggctgtgcttggtatgagctcacgcccgccgagacctcggttaggttgcgggcttacctaaatacaccagggttgcccgtttggcaggaccatctggagttctgggagagcgtctttacaggcctcactcacatagatgcccatttcctgtcccaaactaagcaggcaggagacaacttcccatacctggtagcataccaggctacggtgtgcgccagggctcaggctccacctccatcgtgggatcaaatgtggaagtgtctcatacggctaaagcctacgctgcatgggccaacacccctgctgtataggctaggagccgtccaaaacgaggtcatcctcacacaccccataaccaaatacatcatggcatgcatgtcggctgacctggaggtcgttacgagcacctgggtgctagtaggcggcgtccttgcagctctggctgcgtattgcctgacaacaggcagcgtagtcattgtgggcaggatcatcttgtccggaaagccggccatcattcccgacagggaagttctctaccgggagttcgatgagatggaagagtgcgcctcacaccttccttacatcgagcagggaatgcagctcgccgagcaattcaagcagaaagcgctcgggttgctgcagacggccaccaagcaggcggaggccgctgcccccgtggtggagtccaagtggcaagcccttgagaccttttgggcgaaacacatgtggaatttcatcagcgggatacaatacttagcaggcttgtccactctgcctgggaaccccgcgatagcatcattgatggcattcacagcctccatcaccagcccgctcaccacccaacacaccctcctgtttaatatcttgggaggatgggtggccgcccaactcgctccccccagagctgcctcggccttcgtaggcgctggcatcgccggtgcggctgttggcagcataggccttgggaaggtgcttgtggacattctggcgggttatggagcaggggtggcaggcgcgctcgtggccttcaaagtcatgagcggcgatatgccctccaccgaggacctggtcaacttactccctgccatcctctcccctggtgccctggtcgtcggggtcgtgtgcgcagcaatactgcgtcggcatgtgggcccgggagagggggctgtgcagtggatgaaccggctgatagcgttcgcttcgcggggcaaccacgtctcccccacgcactatgtgcctgagagcgacgccgcagcgcgtgtcactcagatcctctccagccttaccatcactcagctgttgaagaggctccaccagtggattaatgaggattgctccacgccatgctccggctcgtggttaagggatgtctgggactggatatgcacggtgctgtctgacttcaagacctggctccaatccagagtcctgccgcggctgccaggagtcccctttctctcatgtcaacgtgggtacaagggagtctggcgaggagacggcatcatgcagaccacttgcccatgtggagcacagatcaccggacatgtcaagaacggttccatgagaatcgttgggcctaagacctgcagcaatacgtggcatggaacattccccatcaacgcgtacaccacgggcccctgcacaccctccccggcgccaaactattccagggcgctgtggcgggtggctgcagaggagtacgtggaggttacgcgggtgggggatttccactacgtgacgggcatgaccactgacaacctaaaatgcccgtgccaggtcccggcccccgaattcttcaaagaactggacggggtgcggttgcacaggtacgctccggcgtccaaacctctcctgcgggatgaggtcacattccaggtcgggctcaaccaatacgtggttggatcacagctcccatgcgagcccgaaccggatgtagcggtgctcacttccatgctcaccgacccctcccacatcacagcagagacggccaagcgtaggctggccagggggtctcccccctccttggccagctcttcagctagtcagttgtctgcgccttccctgaaggcaacatgcactacccatcatgactccccagacgccgacctcatcgaggccaacctcctgtggcggcaggagatgggcgggaacatcacccgcgtggagtcagagaataaggtggtaatcctggactctttcgagccgcttcgagcggaggaggatgagagggaggtatcccttccggcggagatcctgcgaaaatccaggaaattcccccgggcaatgcccatatgggcacgcccggattacaaccctccactgatagagtcctggaaggacccggactacgtccctccagtggtgcacgggtgcccattgccacctaccaaggcccctccaataccacctccacggaggaagaggacggttgtcctgacagaatccactgtgtcttctgccttggcggagcttgctacaaagaccttcggcagctccgaatcgtcggccgccgatagcggcacggcgaccgcccctcctgaccagccctccagcgacggcgacgcaggatccgacgttgagtcgtactcctccatgcccccccttgagggggagccgggggaccccgacctcagcgacgggtcttggtctaccgtgagcgaagaggctggtgaggatgtcgtctgctgctcgatgtcctacacatggacaggcgccctgatcacaccatgcgctgcggaggaaagcaagttacccatcaatgcgttgagcaactctttgctgcgccaccataatatggtctatgccacaacatcccgcagcgcaagccaacggcagaagaaggtcacctttgacagactgcaagtcctggacgaccactaccgggacgtgctcaaggagatgaaggcgaaggcgtccacagttaaggccagactcttatccgtagaggaggcctgtaagctgacgcccccacattcggccagatccaaatttggctatggggcaaaggacgtccggaacctatccagcagggccattaaccacatccgctccgtgtggaaggacctgcaggaagacactgagacaccaattgacaccaccatcatggcaaaaaatgaggttttctgcgtccaaccagagaagggaggccgcaagccagctcgccttatcgtgttcccagatttgggggttcgtgtgtgcgagaaaatggccctttacgacgtggtctccacccttcctcaggccgtgatgggcgcctcatacggattccagtactctcctggacagcgggtcgagttcctggtgaatgcctggaaatcaaagaaatgccccatgggcttcgcatatgacacccgctgttttgactcaacggtcactgagaatgacatccgtgttgaggagtcaatataccaatgttgtgacttggcccccgaagccagacaggccataaggtcgctcacagagcggctttatatcgggggtcccctgactaattcaaaagggcagaactgcggttatcgccggtgccgcgcaagcggtgtgctgacgactagctgcggtaataccctcacatgttacttgaaggccactgcggcctgtcgagctgcgaagctccaggactgcacaatgctcgtgtgcggagacgaccttgtcgttatctgtgaaagcgcgggaacccaggaggacgcggcaagcctacgagtcttcacggaggctatgactaggtactctgccccccccggggacccgccccaaccagaatacgacttggagttgataacatcatgctcctccaatgtgtcagtcgcgcacgacgcatccggcaaaagggtgtactacctcacccgtgaccccaccaccccccttgcgagggctgcgtgggagacagctagacacactccagtcaactcctggctaggcaacatcatcatgtatgcgcccaccttgtgggcaaggatgattctgatgactcacttcttctccatccttctagcgcaggagcaacttgaaaaggccctagattgtcagatctacggggcctgctactccattgagccacttgacctacctcagatcattcaacgactccatggtcttagcgcattttcactccatagttactctccaggtgagatcaatagggtggcgtcatgcctcaggaaacttggggtaccgcccttgcgagtctggagacatcgggccagaagtgtccgcgctaagctactgtcccagggggggagggccgccatttgtggcaagtacctcttcaactgggcagtaaggaccaagctcaaactcactccaatccctgcagcgtcccagctggacttgtccggctggttcgttgctggttacagcgggggagacatatatcacagcgtgtctcgtgcccgaccccgctggttcatgtggtgcctactcctactttctgtaggggtaggcatctacctgctccccaaccgatagatggggagccaaccactccaggccaataggccatcctgtttttttttt

SEQ ID NO: 774 - DNA, 9410 bp, Hepatitis C Virus
ttgggggcgacactccaccatagatcactcccctgtgaggaactactgtcttcacgcagaaagcgtctagccatggcgttagtatgagtgtcgtgcagcctccaggtccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacaaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggttcgccggtccgagggcaggacctgggctcagcccgggtacccttggcccctctatggcaatgagggtctggggtgggcaggatggctcctgtcaccccggggctctcggtctagttggggccccacggacccccggcgtaggtcgcgtaatttgggtaaggtcatcgatacccttacatgcgggttcgccgacctcatggggtacattcccgtcgtcggcccccccctagggggcgttgccagggccctggcgcatggtgtccgggttctggaggtcggcgtgaactacgcaacagggaatcttcccggttgctctttctctatcttcctcttagccttgctgtcctgtctgaccattccagcttccgcttatgaagtgcgcaacgtgtccggggtgtaccatgtcacgaacgactgctccaactcaagtattgtgtatgaagcagaggacgtgatcatgcacacccccggatgcttgccctgcgtccgggagaataactcctcccgatgctgggtagcgctcactcccacgctcgcgggtaggaacagcagtatcccaactacgacaatacgacgccatgtcgatttgctcgttggggcggccgctttctgctccgcgatgtatgtgggggatctctgcggatctgtcttccttgtctcccagctgtttaccttctcacctcgccggtatgagacggtacaagactgcaattgctcgctctatcctggccacataacaggtcaccgcatggcctgggatatgatgatgaactggtcgcccacaacggccctagtggtatcgcagttgctccggatcccgcaagccgtcgtggatatggtggcgggggcccactggggagtcctggcgggccttgtctactattccatggtgggaaactgggctaaggttttgattgtgatgctactctttgtcggagttgatgggagcacccacgtgtcagggggcactacagcttacaatacccggagctttacgtccctcttttcatctggggcgcaacagaaaatccagcttgtaaacaccaatggcagctggcacatcaacaggactgccttgaactgcaatgacaccctccagactgggttccttgccgcgctgttctacacacacaggttcaacgattccggatgcccagagcgtatggccagctgtcggcccattgacaagtttgctcaggggtggggtcccatcacttatgtcaagcctgacatcttggaccaaagaccctattgctggcactacgcaccgcgaccatgcggtattgtgcccgcgtcggaggtgtgtggtccagtgtattgcttcaccccaagccctgttgtggtagggactaccgatcgttccggcgcccccacgtataactggggggggaatgagacggacgtgctactccttaacaacacgcggccgccgcaaggcaactggttcggctgcacatggatgaacagcaccgggttcaccaagacgtgcgggggccccccgtgtaacatcgggggggccggcaacaacacctttacctgccctacggactgtttccggaagcatcctgaggccacttacaccaaatgcggatcggggccttggctgacacctaggtgtatagttgactatccatacaggctttggtactacccctgcactgtcaattttaccatcttcaccatcaggatgtatgtggggggcgtggagcacaggctcaaagccgcgtgcaattggactcgaggagagcgttgtaacttggaggacagagatagagcggagcttagcccgctgctactgtccacaacagagtggcagatactcccctgttcctttaccaccctaccagctctgtccactggtctgatccacctccaccagaacatcgtggacgtgcaatacctgtacggtgtggggtcagcggttgtctctgttgtaatcagatgggagtatgtcctgttgctcttcctcctcctggcggacgcgcgcgtctgcgcctgcttatggatgatgctgctgatagcccaggctgaggccgccctagagaacttggtgatcctcaatgcggcgtccgtggccggagcgcatggtattctctcttttcttgtgttcttctgtgctgcctggtacattaagggcaagctggtccctggggcggcatacgctttttatggcgtatggccactgcttctgcttctgctgtcgttaccaccacgagcatacgccatggaccgggagatggctgcatcgtgcggaggcgcggttttcataggtctgatgctcttgaccttgtcaccacactacaaagcgttcctcgctaagctcatatggtggttacaatattttatcaccagggccgaggcgcacttgcaagtgtggatcccccctctcaacgttcggggaggccgcgacgccatcatcctcctcacatgtgcggtccactcagagctagtctttgaaatcactaagatcttgctcgccatattcggcccgcttatggtgctccaggctggcctaaccaaagtgccgtacttcgtgcgcgctcaagggctcatccgtgcatgcatgttggtgcggaaggtcgctgggggtcattatgtccaaatggctttcgtgaagctggccgcactgacgggcacgtatgtttacaaccatcttactccactgcaggactgggcccacacgggcctgcgagaccttgcggtggcggttgagcccgtcgtcttctccgacatggagaccaagatcatcacttggggagcggacaccgcggcgtgtggggacatcatctcgggcctggccgtctccgcccgaagggggagggagatactcctgggaccggccgatagctttgaagggcaaggttggcgactcctcgcgcctatcacggcctactcacaacagacgcggggcctacttgggtgtatcatcaccagtctcacagggcgggacaaaaaccaagtcgagggggaggttcaagtggtttccaccgcaacgcaatctttcctggcgacctgcgtcaacggtgtttgttggactgtctaccatggtgctggctcaaagaccttagccggcccaaaaggtccaatcacccaaatgtacaccaatgtagaccaggacctcgtcggttggcaggcgccccctggggcgcgttccttgacaccatgcacttgcggcagctcggacctttatttggtcacgagacatgctgatgtcattccggtgcgccggcggggcgacagcagagggagcctactctcacccaggcctgtctcctatttgaagggctcctcgggtggtccactgctctgcccctcggggcacgctgttggtatcttccgggccgctgtgtgcacccggggggttgcgaaggcagtggactttgtacccgttgagtctatggaaactactatgcggtcaccggtcttcacggacaactcatctcccccggccgtgccgcagacattccaagtggcccatctacacgctcccaccggaagcggtaagagcactaaggtgccggctgcatacgcagcccaagggtacaaggtactcgtcctgaacccgtccgttgccgctaccttaggatttggggcgtatatgtctaaggcacatggtgttgaccccaatattagaactggggcaaggactatcaccacgggcgctcccattacgtactccacctatggcaagttccttgccgatggtggttgctctggaggcgcctatgacatcataatatgtgatgagtgccactcaactgactcaacctctatcttgggcattggcacagtcctggaccaagcggagacggctggagcgcggctcgttgtgctcgccaccgctacgcccccggggtcggtcaccgtgcctcaccccaacatcgaggaggtggccctgtctaacactggagagattcccttctatggcaaagccatccccctcgacaccatcaagggggggaggcatcttattttttggcactccaagaagaagtgtgacgagctcgctacgaagttgtcggctctcggagtcaatgctgtagcgtactaccggggccttgatgtgtccgtcataccaacaagcggaaacgtcgttgttgtggcaacagacgctctgatgacaggctataccggtgactttgactcagtaatcgactgtaatacatgtgtcatccagacagtcgacttcagcctggaccctactttcaccattgagacgacaaccgtgccccaagacgcggtgtcgcgctcgcagcggcgaggcaggactggtaggggcagaaggggcatatataggtttgtgactccaggggaacggacttcaggcatgttcgattcttcggtcttgtgtgaatgctatgacgcgggctgtgcttggtacgagctcacgcccgccgagacctcggtcaggttgcgggcctacctaaatacaccagggttgcccgtctgtcaggaccatctggagttctgggagagcgtcttcacgggtctcacccacatagatgcccacttcttgtcccagactaagcaggcaggagacaatttcccctacctggtagcataccaggctacagtatgcgccagagcccaggctccacctccatcgtgggatcaaatgtggaaatgtctcatacggctaaagcctacgttgcacgggccaacacccctgttatataggctaggagccgtccaaaacgaggtcaccctcacacaccccataactaaattcatcatggcatgcatgtcggctgacctagaggtcgtcacgagcacttgggtgctagtgggcggggtccttgcagctctggccgcgtactgcctgacaacgggcagcgtggtcattgtgggcaggatcatcttgtccgggaagccggctgtcatccccgacagggaggttctctaccgggagttcgatgaaatggaagaatgtgcctcacacctcccctacatcgaacagggaatgcagcttgccgagcaattcaagcagaaggcgctcgggttgctgcaaacagccactaagcaagcggaggctgctgctcccgtggtggaatccaaatggcggacccttgaggttttctgggcgaagcacatgtggaacttcatcagcgggatacagtacttagcaggcttatccactctgcctgggaaccccgcgatagcatcactgatggcattcacagcctctattaccagcccgctcaccacccaacacaccctattgtttaacatcttggggggatgggtggctgcccaactcgccccccccagagctgcctcagctttcgtgggcgccggcatcgctggcgcggccgttggcagcataggccttgggaaggtgctcgtggacatcctggctggttatggagcaggggtggcaggagcactcgtggactttaaggtcatgagcggtgagatgccctccgccgaggacatagtcaacttactccctgccatcctctctccaggtgccctggttgtcggcgtcgtgtgcgcagcaatactgcgtcggcatgtgggaccgggggagggggctgtgcagtggatgaaccggctgatagcgttcgcttcgcggggtaaccacgtctcccccacgcattatgtgcctgagagcgacgccgcagtgcgtgtcacccagatcctctccaaccttaccatcactcagctgttaaagaggctccaccagtggatcagtgaagactgctccacgccatgttccggctcgtggctcagggatgtttgggactggatatgcactgtgttgactgacttcaagacctggctccagtccaagctcctgccgcggttgccgggaatccccttcttttcatgccaacgtgggtacaaaggagtctggcggggagatggggtcatgcacaccatctgcccctgtggagcacaaatcgccggacatttcaaaaatggttccatgaagatcgtcgggcctaaaacctgtagcaacacgtgggacggaacattccccatcaacggatacaccacagggtccagcacacccaccccagcgtcaaattattccaaggcgttgtggcgggtggtttttgaggagtacgtggaggttacgcgggtgggggatttccactacgtgacgggcatgaccactgacaacgtaaaatgcccatgccaggttccgccccccgaattcttcacggaattggatggggtgcgcctgcacaggtacgccccggtgtccaaacctctcctacgggatgaggtcacattccaggtcggactcaaccgctacccggtcggatcacagctcccatgtgagcccgaaccggatgtggcagtgctcacttccatgctcaccgacccctcccacattacagcagagacggctaagcgtagactggccaggggatctcctccttccttggccagctcttcggctagtcagctgtctgcgccttctctgaaggcgacatgtactacccaccatgactccccagatgccgacctcatcgaggccaacctcctgtggagacaggagatgggcgggaacatcacccgtgtcgagtcagagaataaggtagtgattctggactcttttgacccgcttcgagcggaagaggatgaaagggaagtgtccgtcgcggcggagatcctgcggaaaaccaggaaattccccccagcgctccccatatgggcacgcccggactacaacccaccactgctagagccctggagggacccggactacgcccctccggtggtacatgggtgcccattgccacctgccaaggaccctccaattccacctccacggagaaagaggacggtcgtcctgacagaatccaccgtgtcttctgccttggcggagcttgctaccaagacctttgggagctccgggtcgtcagccgtcgacagcggcacagcgaccgcccctcctgatcagacctccaatgacggtgatacagggtccgacgttgggtcgtactcctccatgcccccccttgagggggaaccgggggaccccgatctcagcgacgggtcttggtctactgtgagcgaggaggctggtgaggacgttgtctgctgctcgatgtcctacacatggacaggtgccttaatcacgccgtgcgctgcggaggagagcaaactgcccatcaatgcgctgagcaactctttgctgcgtcaccacaacatggtctatgctacaacctcccgcagcgcgagccagcggcagagaaaggtcacctttgacagactgcaagtcctggatgaccattaccgggacgtgctcaaggagatgaaggcgaaggcgtccacagttaaggccaaacttctatccgtagaagaagcctgcaagctgacgcccccacattcggccaaatccaagtttgggtatgggggaaaggacgtccggaacctatccagcaaggccgtcaaccacatccgctccgtgtggaaggacttgctggaagacactgaaacaccaattgataccaccgtcatggcaaagaatgaggtcttctgtgttcaaccagagaaaggaggccgcaaggcagctcgcctcatcgtattcccagatttgggggttcgtgtgtgcgagaaaatggccctttacgacgtggtctccactcttcctcaggccgtgatgggctcctcatacggattccagtactctcctgggcagcgggtcgagttcctggtgaacgcctggaaatcaaagaaaagccccatgggctttgcgtatgacacccgctgcttcgactcgacggtcactgagaatgatatccgtactgaggagtcgatttaccaatgttgtgacttggcccccgaggccagacaggtcataaggtcgctcacagagcggctttatgtcgggggccccctgactaattcaaaagggcagaactgcggttatcgccggtgccgtgccagcggtgttctgacgaccagctgcggtaatacccttacatgttacttgaaagccgctgcggcctgtcgagctgccaagctccaggactgcacgatgctcgtgtgcggagacgaccttgtcgtcatctgtgagagcgcgggaactcaggaggacgcggcgagcctacgagtcttcacggaggccatgactaggtactctgccccccccggggacccgccccaaccagaatacgacttggagttgataacatcatgctcttccaatgtgtcggtcgcgcacgatgcatctggcaaacgggtgtactatctcacccgtgaccccaccaccccccttgcgagggctgcgtgggagacagccagacacactccagttaactcctggctaggcaacattatcatgtatggacccactttgtgggcaaggatgattctgatgactcacttcttctccaaccttctagctcaggagtacctcgataaagccctagattgtcaaatctatgaggccatttactccattgggccacttgacctacctcaggtcattcaacgactccatggtcttagcgcattttcactccatagttactctccaggtgagatcaatagggtcgcttcatgcctcaggaaacttggggtaccacccttgcgagtctggagacatcgggccaggagcgtccgcgctaagctactgtcccagggggggagggccgccacttgtggcaaatacctcttcaactgggcagtaaaaaccaagctcaaactcactccaatcccggctgcgtcccagttggacttgtccagctggttcgttgctggttacagcgggggagacatatatcacagcctgtctcgcgcccgaccccgctggttcatgtggtgcctactcctactttctgtaggggtaggcatctatctgctccccaaccggtgaacggggagctaaacactccaggccaataggccatcctgtttttttttt

SEQ ID NO: 775 - DNA, 9410 bp, Hepatitis C Virus
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggcagggcctgggctcagcccgggtacccttggcccctctatggcaatgagggcttagggtgggcaggatggctcctgtcaccccgcggctcccggcctagttggggccccacggacccccggcgtaggtcgcgtaacttgggtaaggtcatcgataccctcacatgcggcttcgccgacctcatggggtacattccgctcgtcggcgcccccttgggaggcactgccagggccctggcgcatggcgtccgggttctggaagacggcgtgaactatgcaacagggaatctgcccggttgctctttctctatcttcctcttggctctgctgccctgtctgaccatcccagcctccgcttatgaggtgtgcaacgcgtccgggctgtaccatgtcacgaacgattgctccaactcaagcattgtgtatgaggcagaggacatgatcatgcacaccccggggtgcgtgccctgcgttcgggagaacaactcctcccgctgctgggtagcgctcactcccacgctcgcggccaggaatgccagcatccccactacgacgatacggcgtcacgtcgatttgctcgttggggcggctgctttctgctctgctatgtacgtgggggatctctgcggatctgtcttcctcgtctctcagctgttcaccttctcgcctcgccggtatgagacagtacaggactgtaattgctcgatctatcccggccacgtatcaggccatcgcatggcttgggatatgatgatgaattggtcacctacaacagccctagtggtatcgcagttgctccggatcccacaagccgtcgtggacatggtggcgggggcccactggggagtcctggcgggccttgcctattattccatggtggggaactgggctaaggtgttgattgtgatgctactctttgccggcgttgacggggacacctacacgacagggggggcgcagggccacaccactagtagggtggcatccctctttacatctggagcatctcagaatatccagcttattaacaccaacggcagctggcacattaacaggactgccctgaactgcaatgactccctccaaaccgggttcattgctgcactgttctatgcacacaggttcaactcgtccggatgcccacagcgcttggccagctgccgctccattgacaagttcgctcaggggtggggtcctatcacctacaccgagggccacaactcggaccagaggccctattgctggcactacgcaccgcggccgtgtggtatcgtacccgcatcgcaggtatgtggtccagtgtattgcttcaccccaagccctgttgtggtggggacgaccgaccgtttcggcgcccccacgtataactggggggcgaacgagacggacgtgctgctcctcaacaacacgcggccgccgcaaggcaactggttcggctgcacatggatgaatggcactgggttcaccaagacgtgcgggggccccccgtgcaacatcgggggggccggtaacgacaccttaacctgccccacggactgcttccggaagcaccccgaggccacttacgcaaagtgcggttcggggccttggttaacacctagatgcatagttgactacccatacaggctttggcactacccctgcactgtcaatttttccatctttaaggttaggatgtatgtggggggcgtggagcacaggctcaccgccgcatgcaattggactcgaggagagcgttgtgatttggaggacagggacagatcagagctcagcccgctgctgttgtccactacagagtggcaaatactgccctgctccttcaccaccctaccggctctgtccactggtttgatccatctccaccagaacatcgtggacgtgcaatacctgtacggtgtagggtcagcggttgtctccttcgcaatcaaatgggagtatgtcctgttgcttttccttctcctggcagacgcgcgcgtctgtgcctgtttgtggatgatgctgttggtagcccaggccgaggctgccctagagaacctggtggtcctcaatgcagcatccttggccggagtgcatggcatcctctccttcctcgtgttcttctgtgctgcctggtacatcaaaggcaagctggtccctggggcggcatatgctctctacggcgtatggccgctactcctgctcctgctggcgttaccaccacgggcgtacgccatggaccgggagatggccgcatcgtgcggaggcgtggtttttgtaggtctagcactcttgaccttgtcaccatactacaaagtgttcctcgctaggctcatatggtggttgcaataccttatcaccagagccgaggcgcagttgcaagtgtggatcccccccctcaacgttcggggggggcgcggtgccatcattctcctcacgtgtgtggtccacccagagctaatctttgacatcaccaaaattatgctcgccatactcggcccgctcatggtgctccaggctggtatagcaaaagtgccggactttgtgcgggctcaaggggtcatccgtgaatgcattttggtgcggaaagtcggtggggggcaatatgtccaaatggccttcatgaagttggccgaattgaaaggtacgtccgtctatgaccacctcactccactgcaggactgggcccacacaggtctacgagacctggcggtagcggtcgagcccgtcgtcttctccgacatggaaatcaagatcatcacctgggggggagacaccgcggcgtgtggggacatcattatgggtctacctgtctccgcccgaagggggagggagatactcctaggaccagccgacagtcttgaggggcaggggtggcgactcctcgcgcccattacggcctactcccaacagacgcggggcctgtttggctgcattatcaccagcctcacgggccgggacaagaaccaagtcgagggggaagttcaagtggtttccaccgcgacgcagtctttcctagcgacctgcgtcaacggcgtgtgctggactgtctaccacggcgccggctcaaagaccctagccggcccaaagggtccaatcacccaaatgtacaccaatgtagaccaggacctcgtcggatggccggcgccccccggagcgcggtccttgacaccatgcacctgcggcggctcggacctttacttggtcacgagacacgctgatgtcattccggtgcgccggcggggtgacagcagggggagcttactatcccccaggcccatctcctacttgaagggctcctcgggcggtccactgctctgcccttcggggcacgttgtgggcatcttccgggctgctgtgtgcacccggggggttgcgaaggcggtggactttgtacccgttgagtctatggaaactaccatgcggtccccggtcttcacggacaactcgtcccccccagccgtaccgcagacattccaagtggcccacctacacgctcccactggcagcggcaagagcactaaggtaccggctgcatatgcagcccaagggtacaaagtgctcgtcctaaatccgtccgttaccgccaccttagggtttggggcgtatatgtctaaggcacacggtgtcgatcctaacatcagaactggggtaaggaccatcaccacgggcgcccccatcacgtactccacctatggcaagttccttgccgacggtggttgctctgggggcgcctatgacatcataatgtgtgatgagtgccactcaattgactcgacttccattttgggcatcggcacagtcctggaccaagcggagacggctggagcgcggctcgtcgtgctcgccaccgctacgcctccgggatcggtcaccgtgccacatcccaacatcgaggagatagccttgtccaacaccggagagatccccttctatggcaaagccatccccatcgagaccatcaaaggggggaggcatctcatcttctgccattccaagaagaaatgtgacgagctcgctgcaaagctgtcgggcctcggacttaacgctgtagcgtattaccggggtctcgacgtgtccgtcataccggccagcggggacgtcgttgtcgtggcaacagacgctctaatgacgggctataccggcgattttgactcggtgatcgactgtaatacatgtgtcacccaaacagtcgacttcagcttggaccctaccttcaccattgagacgacgaccgtgccccaagacgcagtgtcccgctcgcagaggcgaggtaggaccggtaggggcaggagaggcatatacaggtttgtgactccaggagagcggccttcgggcatgttcgactcctcggtcctgtgtgagtgctatgacgcgggatgtgcttggtacgagctcacgcccgccgagacctccgttaggttgcgggcttacctaaatacaccagggttgcccttctgccaggaccatctggagttctgggagggtgtcttcacaggcctcacccacatagatgcccacttcttgtcccagaccaagcaggcaggagaaaacctcccctacctggtagcataccaagccacagtgtgcgccagggctcaggctccacccccatcgtgggatcaaatgtggaagtgtctcacacggctaaagcctacgctacacgggccaacacccctgctgtataggctaggagccgtccaaaatgatgtcaccctcacacaccccataaccaaatacatcatgacatgcatgtcggctgacctggaggtcgtcaccagcacctgggtgctagtaggtggcgtcctggcagctctgaccgcgtattgcctgacgacaggcagcgtggtcattgtgggcagaatcatcttgtccgggaagccggctgttatccccgacagggaggctctctaccaggagttcgatgagatggaggagtgtgcctcacacctcccttacatcgaacaggggatgcagctcgccgagcagttcaagcagaaggcgctcggattgctgcaaacagccaccaaccaagcggaggctgctgctcccgtggtggaatccaagtggcgagcccttgaggctttctgggcgaagcacatgtggaatttcatcagcgggatacagtacctagcaggcttgtccactctgcctgggaaccccgcgatagcatcattgatggcattcacagcctccatcaccagcccgctcaccacccaaagcaccctcctgttcaacatcttgggagggtgggtggccgcccaactcgctccccccagagccgtttcggccttcgtgggcgccggcatcgctggcgcggctgttggcagcataggccttgggaaggtgcttgtagacattctggcgggctatggagcaggagtggcgggtgctctcgtggccttcaaggtcatgagcggggagatgccttctaccgaggacctggtcaacttactccctgccatcctctctcctggcgccctggtcgtcggggtggtgtgcgcagcgatactgcgtcggcatgtgggcccaggagagggcgctgtgcagtggatgaatcggctgatagcgttcgcttcgcggggcaaccatgtctcccccacgcactatgtgcctgagagcgacgcagcggcgcgcgtcacacaaatcctctccagcctcaccatcactcagctgctgaggaggctccatcagtggatcaatgaggactgctccacgccatgttccggctcgtggctaagggatgtttgggactggatatgcacggtgttgactgacttcaagacctggcttcagtccaagctcctgccgcggttgccgggagtccctttcttctcatgccaacgtgggtacaggggggtctggcggggagacggtatcatgcaaaccacctgcccatgcggagcgcagatcactggacatgtcaagaacggttccatgaggatcgtcgggcctaagacctgtagcaacacgtggcatggaacattccccatcaacgcatacaccacgggcccctgcacaccctccccggcgccaaactattctagggcgctatggcgggtggccgctgaggagtacgtggaggttacgcgggtgggggatttccactacgtgacgggcatgaccactgacaacgtaaaatgcccgtgccaggttccgccccccgaattcttcacggaagtggatggggtacgcctgcacagaaacgctccggcgtgtggacctctcctacgggaggaggtcacattccaggtcgggctcaaccaatacctggttgggtcacagctcccatgcgagcccgaaccggatgtagcagtgctcacgtccatgctcaccgacccctcccacattacaggagagacggctaagcgtaggctggccagggggtctcccccctccttggccagctcctcagctagccagctgtctgcgccttcttcgaaggcgacatacattacccaatatgactccccagactttgacctcatcgaggccaacctcctgtggcggcaggagatgggcggtaacatcactcgcgtggagtcagagaataaggtagttaccctggactcttttgacccgcttcgagcggaggaggatgagagagaggtgtccattccggcggagatcctgcggaaatccaagaagtttccttcagcgttacccatatgggcacgcccggattacaaccctccactactagagccctggaaagacccagactacgtccctccggtggtacacgggtgcccattgccacctgccaaggcccctccaataccacctccacggaggaagaggacggttgttctgacagagtccaccgtgtcttctgccttggcggagctcgccacaaagaccttcggcagctctgaatcatcggccgctgatagaggtacggcaaccgccccccccgaccagacctccaatgacggtgacgcaggatccgacgttgagtcgtactcctctatgcccccccttgagggggagccgggggatcccgatctcagcgacgggtcttggtctaccgtgagcgaagaggctggcgaggatgtcgtctgctgctcgatgtcctacacatggacgggcgccctgatcacgccatgcgctgcggaggaaagcaagttgcccatcaacgcgttgagcaactctttgctgcgtcaccacaacatggtctacgctacaacatctcgcagcgcaagccagcggcagaagaaggtcacctttgacagactgcaagtcctggacgaccactaccgggacgtgctcaaggagatgaaggcgaaggcgtccacagttaaggctaaacttctatccgtagaggaagcctgcagactgacgcccccacattcggccaggtccaaatttggttatggggcaaaggacgtccggaacctatccagcggggccgtcaaccacatccgctccgtgtggaaggacttgctggaagacactgagacaccaattgataccaccatcatggcaaaaaatgaggttttctgcgtccaaccagagaaaggaggccgcaagccagctcgccttatcgtgttcccagacttgggggttcgtgtgtgcgagaaaatggccctttacgacgtggtctccacccttcctcaggccgtgatgggctcttcatacggattccagtactctcctgggcagcgggttgagttcctggtgaatgcctggaaatcaaagaaatgccctatgggctttgcatatgacacccgctgtttcgactcaacagtcaccgagagtgacatccgtgtcgaggagtcaatttaccaatgttgtgacttggcccccgaagccagacaggccataaggtcgctcacagagcggctttatatcgggggtcctctgactaattcaaaagggcagaactgcggttatcgccggtgccgcgcgagcggcgtgctgacgaccagctgtggtaataccctcacatgttacttgaaagcctctgcggcctgtcgagctgcgaagctccaggactgcacgatgctcgtgtgtggagacgacctggtcgttatctgtgaaagtgcggggacccaagaggacgcggcgagcctacgagtcttcacggaggctatgactaggtactctgccccccccggggacccgccccaaccggaatacgacttggagttgataacatcatgctcctccaacgtatcagttgcacacgatgcatctggcaaaagggtgtactacctcacccgtgaccccaccaccccccttgcgcgggctgcgtgggagacagctagaagcactccagtcaactcctggctaggcaacatcatcatgtttgcacccactctatgggtaaggatgattctgatgactcacttcttctccatccttctagcccaggagcaacttgagaaagccctagactgccagatctacggggcttgttactccattgagccacttgacctacctcagatcattcagcgactccatggtcttagcgcattttcactccatagttactccccaggtgaaatcaatagggtggcatcatgcctcaggaaacttggggtaccacccttgcgaacctggagacatcgggccagaagtgttcgcgctaagctactgtcccagggggggagggccgccacctgtggcaggtacctcttcaactgggcagtaaagaccaaactcaaactcactccaatcccagctgcgtctcagttggacttgtccaactggttcgttgctggctacagcgggggagacgtgtatcacagcctgtctcgtgcccgaccccgctggttcatgctttgcctactcctactctccgtaggggtaggcatctacctgctccccaaccgatgaacagggagctaaacactccaggccaataggccatcccgtttttttttt

SEQ ID NO: 776 - DNA, 9410 bp, Hepatitis C Virus
ttgggggcgacactccaccatagatcactcccctgtgaggaactactgtcttcacgcagaaagcgtctagccatggcgttagtatgagtgtcgtgcagcctccaggtccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacaaatcctaaacctcaaagacaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggttcgccggtccgagggcaggacctgggctcagcccgggtacccttggcccctctatggcaacgagggtctggggtgggcaggatggctcctgtcaccccgtggctctcggtctaattggggccccacggacccccggcgtaggtcgcgtaatttgggtaaggtcatcgatacccttacatgcgggttcgccgacctcatggggtacattccggtcgtcggcccccccctagggggcgttgccagggccctggcgcatggtgtccgggttctggaggtcggcgtgaactatgcaacagggaatcttcccggttgctctttctctatcttcctcttagccttgctgtcctgtctgaccattccagcttccgcttatgaagtgcgcaacgtgtccggggtgtaccatgtcacgaacgactgctccaactcaagtattgtgtatgaagcagaggacgtgatcatgcacactcccggatgcttgccctgcgtccgggagaataattcctcccgatgctgggtagcgctcactcccacgctcgcgggtaggaacagcagcatccccactacgacaatacgacgtcatgtcgatttgctcgttggggcggccgctttctgctccgctatgtatgtgggggatctctgcggatctgtcttccttgtctcccagctgtttgccttctcacctcgccggtatgagacggtacaagactgcaattgctcgctctatcctggccacataacaggtcaccgcatggcctgggatatgatgatgaactggtcgcccacaacggccctagtggtatcgcagttgctccggatcccacaagccgtcatggacatggtggcaggggcccactggggagtcctggcgggccttgtctactattccatggtgggaaactgggctaaggtcttgattgtgatgctactctttgtcggagttgatgggagtacccgcgtgtcagggggcactacagcttacaatacccggggccttacgtccctcttttcatctggggcgcaacagaaaatccagcttgtaaacaccaatggcagctggcacatcaacaggactgccttgaactgcaatgacaccctccagactgggttccttgccgcgctgttctacacacacaggttcaacgattccggatgcccggagcgtatggccagctgtcggcccattgacaagtttgctcaggggtggggtcccatcacttatgccaagcctgacatcttggaccaaagaccctattgctggcactacgcaccgcgaccatgcggtattgtgcccgcgtcggaggtgtgtggtccagtgtattgcttcaccccaagccctgttgtggtagggactaccgatcgttccggcgcccccacgtataactggggggggaatgagacggacgtgctactccttaacaacacgcggccgccgcaaggcaactggttcggctgcacatggatgaacagcaccgggttcaccaagacgtgcgggggccccccgtgtaacatcgggggggccggcaacaacaccctgacctgccctacggactgtttccggaagcatcctgaggccacttacaccaaatgcggatcggggccttggctgacacctaggtgtatagttgactatccatacaggctttggtactacccctgcactgtcaattttaccatcttcaccatcaggatgtatgtggggggcgtggagcacaggctcaaagccgcgtgcaattggactcgaggagagcgttgtaacttggaggacagagatagagcggagcttagcccgctgctactgtccacaacagagtggcagatactcccctgttcttttaccaccctaccagctctgtccactggtctgatccacctccaccagaacatcgtggacgtgcaatacctgtacggtgtagggtcagcggttgtctctgttgtaatcagatgggagtatgtcctgttgctcttcctcctcctggcggacgcgcgcgtctgcgcctgcttatggatgatgctgctgatagcccaggctgaggccgccctagagaacttggtgatcctcaatgcggcgtccgtggccggagcgcatggtattctctcttttcttgtgttcttctgtgctgcctggtacatcaagggcaggctggtccctggggcggcatacgccttttatggcgtatggcccctgcttctgcttctgctgtcgttaccaccacgagcatacgccatggaccgggagatggctgcatcgtgcggaggcgcggttttcataggtctgatactcttgaccttgtcaccacactacaaagcattcctcgctaagctcatatggtggttacaatattttatcaccagggccgaggcgcacttgcaagtatggatcccccctctcaacgttcggggaggccgcgatgccatcatcctcctcacatgtgcggtccactcagagctagtctttgaaatcactaagatcttgctcgccatattcggcccgcttatggtgctccaggctggcctaatcagagtgccgtacttcgtgcgcgctcaagggctcatccgtgtgtgcatgttggtgcggaaggtcgctgggggtcattatgttcaaatggctttcgtgaagctggccgcactgacgggcacgtatgtttacaaccatctcactccactgcaggactgggcccacacgggcctgcgagaccttgcggtggcagttgagcccgtcgtcttctccgacatggagaccaagatcatcacttggggagcggacaccgcggcgtgtggggacatcatctcgggtctgcccgtctccgcccgaagggggagggagatactcctgggaccggccgatagctttgaagggcaaggttggcgactcctcgcgcctatcacggcctactcccaacagacacggggcctacttggctgtatcatcaccagcctcacagggcgggacaagaaccaagtcgagggggaggttcaagtggtttccaccgcaacgcaatctttcctggcgacctgcgtcaacggtgtgtgttggactgtctaccatggtgccggctcaaagaccttagccgggccaaagggtccaatcacccaaatgtacaccaatgtagaccaggacctcgtcggttggcaggcgccccctggggcgcgttccttgacaccatgcacctgcggcagctcggacctttatttggtcacgagacatgctgatgttattccggtgcgccggcggggcgatagcagagggagcctactctcccccaggcctgtctcctatttgaagggctcctcgggtggtccactgctctgcccctcggggcacgctgtcggcatcttccgggccgctgtgtgcacccggggggttgcgaaggcggtggactttgtacccgttgagtctatggaaactactatgcggtcaccggtcttcacggataactcatctcccccggccgtaccgcagacattccaagtggcccatctacacgcccccaccggaagcggtaagagcactaaggtgccggctgcatatgcagcccaagggtacaaggtactcgtcctgaacccgtccgttgccgccaccttaggatttggggcgtatatgtctaaggcacatggtgttgaccccaatattagaactggggcaaggactatcaccacgggcgctcctattacgtactccacttatggcaagttccttgccgatggtggttgctctggaggcgcctatgacatcataatatgtgatgagtgccactcaactgactcaacctctatcttgggcattggcacagtcctggaccaagcggagacggctggagcgcggctcgttgtgctcgccaccgctacgcccccggggtcggtcaccgtgcctcaccccaacatcgaggaggtggccctgtctaacactggagagattcccttctatggcaaagccatccccctcgacaccatcaagggggggaggcatcttattttttggcactccaagaagaagtgtgacgagctcgctacgaagttgtcggctctcggagtcaatgctgtagcgtactaccggggccttgatgtgtccgtcataccaacaagcggaaacgtcgttgttgtggcaacagacgctctgatgacaggctataccggtgactttgactcagtaatcgactgtaatacatgtgtcatccagacagacgacttcagcctggaccctaccttcaccattgagacgagaaccgtgccccaagacgcggtgtcgcgctcgcagcggcgaggcaggactggtaggggcagaaggggcatatataggtttgtgactccaggggaacggacttcaggcatgttcgattcttcggtcttgtgtgaatgctatgacgcgggctgtgcttggtatgagctcacgcccgccgagacctcagtcaggttgcgggcctacctaaatacaccagggttgcccgtctgtcaggaccatctggagttctgggagagcgtcttcacgggtctcacccacatagatgcccacttcttgtcccagactaagcaggcaggagacaacttcccctacctggtagcataccaggctacagtatgtgccagagcccaggctccacctccatcgtgggatcaaatgtggaaatgtctcacacggctaaagcctacgttgcacgggccgacaccactgttatatagactaggagccgtccaaaacgaggtcatactcacacaccccataactaaattcatcatggcatgcatgtcagctgaccttgaggtcgtcacgagcacttgggtgctagtgggcggggtccttgcagctctggccgcgtactgcctgacaacgggcagcgtggtcattgtgggcaggatcatcttgtccgggaagccggctgttatccccgacagggaggttctctaccgggagttcgatgaaatggaagagtgtgcctcacacctcccctacatcgaacaggggatgcagcttgccgagcaattcaagcagaaggcgctcgggttgctgcaaacagccaccaagcaagcggaggctgctgctcccgtggtggaatccaaatggcggacccttgaggttttctgggcgaagcacatgtggaacttcatcagcgggatacagtacttagcaggcttatccactctgcctgggaaccccgcgatagcatcactgatggcattcacagcctctatcaccagcccgctcaccacccaacacaccctattgtttaatatcttggggggatgggtggctgcccaacttgccccccccagagctgcctcagctttcgtgggcgccggcatcgccggcgcggccgttggcagcataggccttgggaaggtgctcgtggacatcctggctggttatggagcaggggtggcaggcgcactcgtggactttaaggtcatgagcggtgagatgccctccgccgaggacatagtcaacttactccctgccatcctctctcctggtgccctggttgttggcgtcgtgtgcgcagcaatactgcgtcggcacgtgggcccaggggagggggctgtgcagtggatgaaccggctgatagcgttcgcttcgcggggtaaccacgtctcccccacgcattatgtgcctgagagcgacgccgcagtgcgtgtcacccagatcctctccagccttaccatcactcagctgttaaagaggctccaccagtggattagtgaagactgctccacgccatgttccggctcgtggctcagggatgtttgggactggatatgcactgtgttgactgacttcaagacctggctccagtccaagctcctgccgcggttgccgggaatccccttcttttcatgccaacgtgggtacaaaggagtctggcggggagatggggtcatgcacaccatctgcccctgtggagcacaaatcgccggacatttcaaaaatggttccatgaagatcgtcgggcctaaaacctgtagcaacacgtgggacggaacattccccatcaacggatacaccacagggtccagcacacccaccccagcgtcaaactattccaaggcgttgtggcgggtggtttttgaggagtacgtggaggttacgcgggtgggggatttccactacgtgacggggatgaccactgacaacgtaaaatgcccatgccaggttccgccccccgaattcttcacggaattggatggggtgcgcctgcacaggtacgccccggtgtccaaacctctcctacgggatgaggttacattccaggtcggactcaaccgctacgcggtcgggtcacagctcccatgtgagcccgaaccggatgtaacagtgatcacttccatgctcaccgacccctcccatattacagcagagacggctaagcgtagactggccaggggatctccaccctccttggccagctcttcggctagtcagctgtctgcgccttctctgaaggcgacatgtactacctgccatgactccccagatgccgacctcatcgaggccaaccttctgtggcgacaggagatgggcgggaacatcacccgtgtagagtcagagaataaggtagtaattctggactcttttgacccgcttcgagcggaagaggatgaaagggaagtgtccgttgcggcggagatcctgcggaaaaccaagaaattccccccagcgctccccatatgggcacgcccggactacaacccaccactgctagagtcctggagggccccggactacgcccctccggtggtacatgggtgcccattgccacctgccaaggaccctccaattccacctccacggagaaagaggacggtcgtcctgacagaatccaccgtgtcttctgccttggcggagctcgctaccaagacctttggcagctccgggtcgtcagccgtcgacagtggcacagcgaccgcccctcctgatcagccctccaatgacggtgatacaggatccgacgttgggtcgtactcctccatgcccccccttgagggggagccgggggaccccgatctcagcgacgggtcctggtctaccgttagcgaggaggctggtgaggacgttgtctgctgctcgatgtcctacacatggacaggtgccttaatcacgccatgcgccgcggaggagagcaaactgcccatcaatgcgttgagcaactctttgctgcgtcaccacaacatggtctatgctacaacgtcccgcagcgcaagtcagcggcagagaaaggtcacctttgacagactgcaagtcctggatgatcattaccgggacgtgctcaaggagatgaaggcgaaggcgtccacagttaaggccaaacttctatccgtagaagaagcctgcaagctgacgcccccacattcggccaaatccaagtttgggtatgggggaaaggacgtccggaacctatctagcaaggccgtcaaccacatccgctccgtgtggaaggacttgctggaagacactgaaacaccaattgataccaccgtcatggcaaagaatgaggtcttctgtgttcaaccagagaaaggggggcgcaaggcagctcggctcatcgttttcccagatttgggggttcgtgtgtgcgagaaaatggccctttacgacgtggtctccactcttcctcaggccgtgatgggctcctcatacggattccagtactctcctgggcagcgggtcgagttcttggtgaacgcctggaaatcaaagaaaagccccatgggctttgcgtatgacacccgctgcttcgactcaacggtcactgagaatgacatccgtgttgaggagtcaatataccaatgttgtgacttggcccccgaagccaggcaggtcataaggtcgctcacagagcggctttatatcgggggtcccctgactaattcaaaagggcagaactgcggttatcgccggtgccgtgcaagcggtgtgctgacgactagctgcggtaataccctcacatgttacttgaaggccgctgcggcctgtcgagctgcgaagctccaggactgcacgatgctcgtgtgcggagacgaccttgtcgttatctgtgaaagcgcgggaacccagggggacgcggcaagcctacgagtcttcacggaggctatgactaggtactctgccccccccggggacccgccccaaccagaatacgatttggagttgataacatcatgctcctccaatgtgtcagtcgcgcacgatgcatctggaaaaagggtgtactacctcacccgtgaccccaccaccccccttgcgagggctgcgtgggagacagccagacacactccagttaactcctggctaggcaacattatcatgtatggacccactttgtgggcaaggatgattctgatgactcacttcttctccaaccttctagctcaggagtacctcgataaagccctagattgtcagatctatgaggccatttactccattgggccacttgacctacctcaggtcattcaacgactccatggtcttagcgcattttcactccatagttactctccaggtgagatcaatagggtcgcttcatgcctcaggaaacttggggtaccacccttgcgagtctggagacatcgggccaggagcgtccgcgctaagctactgtcccagggggggagggccgccacttgtggcaaatacctcttcaactgggcagtaaaaaccaagctcaaactcactccaatcccggctgcgtcccagttggacttgtccagctggttcgttgctggttacagcgggggagacatatatcacagcctgtctcgcgcccgaccccgctggttcatgtggtgcctactcctactttctgtaggggtaggcatctatctgctccccaaccggtaaatggggagctaaccactccaggccattaggccatcctgtttttttttt

SEQ ID NO: 777 - DNA, 9410 bp, Hepatitis C Virus
ttgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccagcccgagggcagggcctgggctcagcccgggtacccttggcccctctatggcaatgagggcatggggtgggcaggatggctcctgtcaccccgcggctctcggcctagttggggccccacagacccccggcgtaggtcgcgtaatttgggtaaggtcatcgataccctcacatgcgggttcgccgacctcatggggtacattccgctcgtcggggcccccttagggggggcttccagggccctggcacatggtgtccgggttctggaggacggcgtgaactatgcaacagggaatctgcccggttgctctttctctatcttcctcttggctttgctgtcctgtttgaccatcccagcttccgcttatgaggtgcgcaacgcgtccggggtgtatcatgtcacgaacgactgctccaacgcaagcattgtgtatgaggcagcggacatgatcatgcatacccccgggtgcgtgccctgcgttcgggaggccaattcctcccgctgctgggtagcgctcactcccacgctcgcggccaggaactccagcgtcccaactacgacaatacgacgccacgtcgacttgctcgttggggcggctgctttctgctccgctatgtacgtgggggatctctgcggatctgttttcctcgtctcccagctgttcaccttctcgcctcgccggcatgagacggtacaggattgcaattgttcaatctatcccgggcacgtttcaggtcaccgcatggcttgggatatgatgatgaactggtcacccacaacagccctagtggtatcgcagctactccggatcccacaagctgtcatggacatggtggcgggggcccactggggagtcctggcgggccttgcctactattccatggtggggaactgggctaaggtcttgattgtgatgctactctttgccggcgttgatgggcgcaccaccgtgacagggggggcgcagggccataccacccaaaggctcgcgtccctctttacatttggggcgcagcagagaatccagcttgtgaataccaacggcagttggcacatcaacaggactgccctgaactgcaatgactccctcaacactgggttcctcgccgcgctgttctacacacacaggttcaactcgtccggatgcccagagcgcatagccagctgccgctccatcgacgcgttcgctcaggggtggggtcccatcacttacgctgagccgggcagctcggaccagaggccctattgttggcactacgcacctcgaccgtgtggtatcgtacccgcgtcggaggtgtgtggtccagtgtattgcttcaccccaagccccgttgtggtggggacgaccgatcgttctggcgcccctacttatagctggggagagaatgagacggacgtgctgctcctcaacaacacgcgggcgccgcaaggcaactggttcggctgtacatggatgaatggcactgggttcaccaagacgtgcgggggccccccgtgtaacatcgggggggtcggcaacaacactttgacctgccccacggactgcttccggaagcaccccgaggccacctacacaaaatgcggttcggggccttggttgacacccaggtgcatggtggactacccatacaggctttggcactacccctgcactgtcaactttaccatcttcaaggttaggatgtatgtggggggcgtggagcacaggctcaacgccgcatgcaattggactcgaggagagcgttgtgacttggaggacagggacagatcagagcttagcccgctgctgctatctacaacagagtggcagatactgccctgttccttcaccaccctaccggttctgtccaccggtttgatccatctccatcagaacatcgtggacgtgcaatacctgtacggtgtagggtcggcggttgtctcctttgtaatcaaatgggagtatatcctgctgctcttcctcctcctggcggacgcgcgcgtctgtgcctgcttgtggatgatgctgctgatagctcaggctgaggccgccctagagaacctggtggtcctcaatgcggcgtccgtggccggagcgcatggctttctctccttccttgtgttcttctgtgctgcctggtacatcaaggggaagctggtccctggggcggcatatgccttctatggcgtatggccgctactcttgctcctgctggcgttaccaccacgagcatacgccatggaccgggagatggctgcatcgtgcggaggcgcggttttcgtaggtctggcactcttgaccctgtcaccacactataaagtggtcctcgcccggctcatatggtggttacaatattttatcaccagagccgaggcgtgtttgcaagtgtggatcccccccctcaatgtccggggggggcgcgatgccatcatcctcctcacgtgtgcgctccacccagagctaatcttttccatcaccaagatcttggtcgccatactcggcccgctcatggtgctccaggctggcataaccaaaatgccgtactttgtgcgcgctcaaggcctcattcgtgcatgcatgttggtgcggaaagtcgctgggggtcattatgtccaaatggctttcatgaagctggccgcactgacgggtacgtacgtctatgaccatcttactccactgcaggactgggcccacgcgggtctacgggaccttgcggtggcagttgagcccgtcgtcttctctgacatggagactaagatcatcacctggggggcagacaccgcggcgtgcggggacatcatcttgggtctggccgtctccgcccgaagggggaaggagatcttcctgggaccggcagatagtcttgaagggtcggggtggcgactcctcgcgcccatcacggcctactcccagcagacacggggcctacttggctgcatcatcactagcctcacaggccgggacaagaaccaggtcgagggggaggttcaggtggtctccaccgcaacacagtctttcctggcgacctgcaccaacggtgtgtgttggactgtctaccatggtgccggctcgaagactctagccggttctaagggcccaatcacccaaatgtacaccaatgtggatcaggacctcgtcggctggcaggcaccctccggggcgcgctccttgacaccgtgcacctgcggcagctcggacctttacttggtcacgaggcatgctgatgtcattccggtgcgccggcggggcgacggcagggggagtttgctctcccccaggcccgtctcttacttgaagggctcttcgggcggcccactgctctgcccctcggggcacgccgtgggcatcttccgggctgccgtgtgcacccggggggttgcgaaggcggtggacttcatacccgttgagtctatggaaaccactatgcggtctccggtcttcacggacaactcgtcccctccagccgtaccgcagacattccaagtggcccatctacacgctcccactggaagcggcaagagtaacaaggtgccggttgaatatgcagcccaagggtacaaggtacttgtcctgaacccatccgtcgccgccactttaggctttggggcgtatatgtccaaagcacatggtgttgaccctaacatcagaactggggtaaggactatcaccacgggcgcccctatcacgtactccacctatggcaagttcctcgccgatggtggttgctctggaggcgcctacgacatcataatatgtgatgagtgccactcaactgactcgaccagcatcttgggcataggcacagtcctggaccaagcggagacggctggagcgcggcttgtcgtgctcgccaccgctacgcctccgggatcggtcaccgtgccacatcccaacatcgaggaggtggccctgtccaacattggagagatccccttctacggcaaagccatccccattgagaccatcaagggggggaggcatctcattttctgccattccaagaagaaatgtgacgaactcgccgctaagttgtcgggtctcggaatcaatgctgtggcatattaccggggtcttgatgtgtccgtcataccggccagcggagacgtcgttgtcgtggcaacagacgctctaatgacgggcttcaccggcgactttgactcagtgatcgactgtaacacatgtgtcacccagacagtcgatttcagcttggaccctaccttcaccattgagacgacgaccgtgccccaagacgcggtgtcgcgctcacaacggcggggcaggactggtaggggcagggcaggcatctacaggttcgtgactccaggagaacggccctcgggtatgttcgattcctcggtcctgtgcgagtgctatgacgcgggctgtgcttggtatgagctcacgcccgccgagacctcggttaggttgcgggcttacctaaatacaccagggttgcccgtttggcaggaccatctggagttctgggagagcgtctttacaggcctcacccacatagatgcccacttcctgtcccagactaagcaggcaggagacaacttcccctacctggtagcataccaagctacggtgtgcgccagggctcaggctccacctccatcgtgggatcaaatgtggaagtgtctcatacggctaaagcctacgctgcatgggccaacacccctgctgtataggctgggagccgtccaaaacgaggtcatcctcacacaccccataaccaaatacatcatggcatgcatgtcggctgacctggaggtcgtcacgagcacctgggtgctagtaggtggcgtcctcgcagctctggctgcgtattgcttgacaacaggcagcgtggtcattgtgggcaggatcatcttgtccggaaagccggccatcattcccgacagggaagttctctaccgggagttcgatgagatggaggagtgcgcctcacaccttccttacatcgagcagggaatgcagctcgccgagcaattcaagcagaaggcgctcgggttgctgcagacggccaccaagcaagcggaggccgctgctcccgtggtggagtccaagtggcaagcccttgagaccttttgggcgaaacacatgtggaatttcatcagcgggatacaatacttagcaggcttgtccactctgcctgggaaccccgcgatagcatcattgatggcattcacagcctccatcaccagcccgctcaccacccaacataccctcctgtttaacatcttgggaggatgggtggccgcccaactcgctccccccagagctgcttcagctttcgtaggcgctggcatcgccggtgcggctgttggcagcataggccttgggaaggtgcttgtggacattctggcgggttatggagcaggggtggcaggcgcgctcgtggcctttaaagtcatgagcggcgatatgccctccactgaggacctggtcaacttactccctgccatcctctcccctggtgccctggtcgtcggggtcgtgtgcgcagcaatactgcgtcggcatgtgggcccgggagagggggctgtgcagtggatgaaccggctgatagcgttcgcttcgcggggtaaccacgtctcccccacgcactatgtgcctgagagcgacgccgcagcacgtgtcactcagatcctctccagccttaccatcactcagctgttgaagaggctccaccagtggattaatgaggactgctccacgccatgctccggctcgtggctaagggatgtctgggactggatatgcacggtgttgactgacttcaagacttggctccaatccagggtcctgccgcggttaccaggagtccccttcctctcatgtcaacgtgggtacaagggagtctggcggggggacggcatcatgcagaccacttgcccatgtggagcacagatcaccggacatgtcaagaacggttccatgagaatcgttgggcctaagacctgcagcaatacgtggcatggaacattccccatcaacgcgtacaccacgggcccctgcacaccctccccggcgccaaactattccagggcgctgtggcgggtggctgctgaggagtacgtggaggtcacgcgggtgggggatttccactacgtgacgggcatgaccactgacaacttaaaatgcccgtgccaggtccctgcccccgaattcttcaaagaactggacggggtgcggttgcacaggtacgctccggcgtccaaacctctcctgcgggatgaggtcacattccaggtcgggctcaaccaatacgtggttggttcacagctcccatgtgagcccgaaccggatgtagcagtgctcacttccatgctcaccgacccctcccacatcacagcagaggcggctaagcgtaggctggccagggggtcccccccctccttggccagctcttcagctagccagttgtctgcgccttctctgaaggcaacatgcactacccgtcacgactccccagatgccgacctcatcgaggccaacctcctgtggcggcaggagatgggcgggaacatcacccgcgtggagtcagagaataaggtggtgattctggactctttcgagccgcttcgagcggaggaggatgagagggaggtatccctcccggcggagatcctgcgaaaatccaggaaattccccccggcaatgcccatatgggcacgcccggattacaaccctccactgatagagtcctggaaggacccggactacgtccctccagtggtgcacgggtgcccattgccacctaccaaggcccctccaataccacctccacggaggaagaggacggttgtcctgacagagtccactgtgtcttctgccttggcggagctcgccacaaagaccttcggcagctccgaatcgtcggccgccgatagcggcacggcgaccgctcctcctgaccagccctccaacgacggcgacgcaggatccgacgttgagtcgtactcctccatgcccccccttgagggggagccgggggaccccgatctcagcgacgggtcttggtctaccgtgagcgaagaggctggtgaggatgtcgtctgctgctcgatgtcctacacatggacaggcgccctgatcacaccatgcgccgcggaggaaagcaagctacccatcaatgcgttgagcaactctttgctgcgccaccataatatggtctatgccacaacatcccgcagcgcaagccaacggcagaagaaggtcacctttgacagactgcaagtcctggacgaccactaccgggacgtgctcaaggagatgaaggcgaaggcgtccacagttaaggccagactcttatccgttgaggaggcctgtaagctgacgcccccacattcggccagatccaaatttggctatggggcaaaggacgtccggaacctatccagcagggccattaaccacatccgctccgtgtggaaggacctgctggaagacactgagacaccaattgacaccaccatcatggcaaaaaatgaggttttctgcgtccaaccagagaagggaggtcgcaagccagctcgccttatcgtgttcccagatttgggggttcgtgtgtgcgagaaaatggccctttacgacgtggtctccacccttcctcaggccgtgatgggcccctcatacggattccaatactctcctggacagcgggtcgaattcctggtgaatgcctggaagtcaaagaaatgccccatgggcttcgcatatgacacccgctgttttgactcaacggtcactgagagtgacatccgtgttgaggagtcaatataccaatgttgtgacttggcccccgaagccagacaggccataaggtcgctcacagagcggctttatatcgggggtcccctgactaattcaaaagggcagaactgcggttatcgccggtgccgcgcaagcggtgtgctgacgactagctgcggtaataccctcacatgttacttgaaggccactgcggcctgtcgagctgcgaagctccaggactgcacaatgctcgtgtgcggagacgaccttgtcgttatctgtgaaagcgcgggaacccaggaggacgcggcaagcctacgagtcttcacggaggctatgactaggtactctgccccccccggggacccgccccaaccagaatacgacttggagttgataacatcatgctcctccaatgtgtcagtcgcgcacgatgcatccggcaaaagggtgtactacctcacccgtgaccccaccaccccccttgcgagggctgcgtgggagacagctagacacactccagttaactcctggctaggcaacatcatcatgtatgcgcccaccttgtgggcaaggatgattctgatgactcacttcttctccatccttctagcgcaggagcaacttgaaaaggccctggattgtcagatctacggggcctgctactccattgagccacttgacctacctcagatcattcaacgactccatggtcttagcgcattttcactccatagttactctccaggtgagatcaatagggtggcgtcatgcctcaggaaacttggggtaccgcccttgcgagtctggagacatcgggccagaagtgtccgcgctaagctactgtcccagggggggagggccgccatctgtggcaagtacctcttcaactgggcagtaaggaccaagctcaaactcactccaatccctgcagcgtcccagctggacttgtccggctggttcgttgctggttacagcgggggagacatatatcacagcgtgtctcgtgcccgaccccgctggttcatgtggtgcctactcctactttctgtaggggtaggcatctacctgctccccaaccgatgaacggggagctaaacactccaggccaataggccatcctgtttttttttt

SEQ ID NO: 778 - DNA, 9450 bp, Hepatitis C Virus
acctgcctctttcgaggcgacactccaccatgaatcactcccctgtgaggaacttctgtcttcacgcggaaagcgtctagccatggcgttagtacgagtgtcgtgcagcctccaggcccccccctcccgggagagccatagtggtctgcggaaccggtgagtacaccggaatcgccgggttgaccgggtcctttcttggaactacccgctcaatgcccggaaatttgggcgtgcccccgcgagactgctagccgagtagtgttgggtcgcgaaaggccttgtggtactgcctgatagggtgcttgcgagtgccccgggaggtctcgtagaccgtgcatcatgagcacacttcctaaaccacaaagaataaccaaaagaaacatcaaccgccggccacaggacgttaagttcccaggcggcggtcagatcgttggtggagtttacgtactaccacgcaggggccccaagttgggtgtgcgtgcagtgcgcaagacttccgagcggtcgcaacctcgtagtaggcgccaacccatccccagggcgcgccgaaccgagggccggtcctgggctcagcccgggtacccttggcccctatatgggaatgagggctgcgggtgggcagggtggctcctgtccccgcgcggctctcgcccatcgtggggcccaaatgacccccggcgtagatcccgcaatttgggtaaggtcatcgataccctcacatgcggattcgccgacctcatggggtacattccgctcgtaggcgcccctgttgggggcgtcgcaagagctcttgcacatggtgttcgagctcttgaggacggaatcaatttcgcaacagggaatttacctggttgctctttctctatcttcctcttggctttgctctcatgcttgcttacacccacagccgggctggagtatcgtaatgcctccggactctacacggtaaccaacgactgtagtaacggtagcatcgtgtatgaggccggggatgttatcctccacttgcctggctgtatcccctgcgtgcgcttaaacaatgcatcaaaatgctggacccctgtaagccctaccgtcgccgtgagtcgccctggcgccgctaccgcctctctccgcacgcacgtggacatgatggtgggagcggccaccctatgctcagctctctacgtaggagatctttgtggagcgctatttcttgttgggcaggggttctcatggagacatcgccagcattggactgtccaggattgcaactgttcgatctaccctggacatttgacaggccatcgtatggcttgggacatgatgatgaattggtcccctgccatgacactgatagtgtcccaagtgttgcgtttgccacagaccatgttcgatctggtcattggggcacattggggcgtgatggccggtgtggcttactactccatgcaagggaattgggccaaggtgtttctcgtgttatgtctattctccggagtggacgctagcacgacgataactggtggcgtcgcggccagtggtgcctttacaatcacatcacttttcagtacgggcgcaaagcaacccctacacttggtcaataccaacggctcgtggcacataaaccgcacggccctgaattgcaatgattccctaaacaccgggtttattgcgggtttgctctactaccacaagttcaattcatcagggtgtgtcgagcgaatgtctgcttgcagtccccttgaccgtttcgcgcaagggtggggtccattggggccagctaacatctctggcccttcatctgaaaagccatactgctggcattatgcacctagaccttgcgacactgtccccgctcaaagtgtttgtggccctgtctactgtttcaccccttcgcccgttgtggtgggagcgactgacaaacgtggagcccccacttacacctggggggagaatgaatcagacgtgttcctgttggaatcagcacggccccctacggagccctggttcgggtgcacgtggatgaacggctcggggtatgtcaagacatgtggtgcccccccctgtcacatctacggagggcgggaaggcaagtccaacaacagtctcgtctgtcccacggactgtttcaggaaacaccccgatgccacctacaatcgttgcggtgctggcccgtggttaacaccaaggtgtttggttgactacccgtaccgcctctggcactatccctgtaccgtgaattacaccatcttcaaggtcaggatgttcgttggcggattggaacatcgttttaacgccgcctgcaactggactagaggagagcgttgcaacctggaggaccgggatcgcagcgaaatgtatcctctgctacactcaaccacagaacaagcaatactaccttgctcttttgtgccaatacccgccctatcaacaggtctcatacatctccaccaaaatatcgtggatgttcaatacctgtacggaattagttcaggtctggtgggctgggcaatcaagtgggagttcgtcatcctcatcttcctcctgctagcagatgcaagagtgtgtgtcgttttgtggatgatgatgttgatatcacaagctgaagctgctttggagaatttgattgtcctgaacgccatctccgctgcgggcacacatgggatctggtggtcccttgttgccttttgcgttgcttggcacgttcggggcaggatattccccatagcggtgtacagtattgttggtctttggcccctactcttacttgtcctcatgcttccctatcgggcatacgcttggacgggtacagacacgtccaccttgggtgccggagtgctgagcttgtttgcccttttcaccttgtccccctggtataagcattggatagcccgccttatctggtggaaccagtacactattgccaggtgtgaagcagcactgcagatatgggttcctcccctgctggccagaggagcccgcgatggtatcattctgcttgctggcttgttttatcccgctctagtctttgacatcactaagctcttgttagcaatactagggcctctttacatcctacaagccagccttgttcgcgtcccctactttgtgcgggcccatgcagttgttcgcctatgcatcctggtgcggaacatcactggcggtaaatatgtgcaaatggtgcttctggcactagcccgggggttcaatacttacctatatgaccatctttcacccatgactgattgggcggctgagggcttgaaagacctagccgtggccgtcgagcccgtcatcttcagtcctatggaggttaaggttattacatggggagctgatacgacagcatgcggggacatactctgcggcttgccggtgtcggctcgtcttgggaaggaggtgctactaggccctgcggatgattaccgctccatggggtggaggttgctggcgccgataacagctcacgcgcagcaaaccagaggcctattcggcacgattgtcaccagtctcactggtagggacaagaacatcgtcactggggagatccaggtcctctctactagtacgcagacgttcttgggcacatcagtggggggggtcatgtggaccgtctaccacggagctggttctaggacattagctggtaataagagaccagctctgcaaatgtacaccaacgtagaccaggacttggtcggctggccctctccacccggcgccaaatcccttgtgccgtgcacgtgcggctcagccgacctgtacctgatcacgcgtgatgcagatgtcctgccagcacgacgcagaggggactccacggctagcttgctcagtcctagacccctagcatgcttgaaaggctcttcgggcggtcccatcatgtgcccctctggtcatgtcgccggcatcttcagagcagctgtgtgtaccaggggtgtggcgaaggccttacagttcataccagtagagagcctaagtgcacagaccagatccccctccttctctgacaattcaactccaccagcagtgccgcaaactttccaagtgggttatctccatgcgcccaccggcagcggtgagagtacaaaagtgcccgccagctatgtggctcaagggtataccgtgcttgtgctgaacccatccgttgccgctaccctcgggttcggcaggttcatgtcacatgcttacggtatcgaccctaacgtgcgcaccggcacccgcaccataaccaccggcgcaaagctcacatactcaacatatgggaagtttctagccgatggggggtgttcgggcggtgcttatgatgtcatcatttgtgacgaatgtcacgcgcaggatgccactagtatactgggcataggcactgtgctggaccaggcagagaccgctggagcacggttggttgttttagcaaccgcaaccccgcctggtagtatcactgtcccacactctaacatcgaggaggtggctcttaccggggaaggggaaatccccttttacggcagggctatacccttaggtgtgatcaagggtggtagacatctcatcttctgccattcaaagaaaaaatgtgatgagttggctaagcagttgacatcactgggcgtcaacgctgtagcattttacaggggtcttgatgtgtccgtgataccaacacaaggagatgtcgtggtgtgtgccactgacgctctcataactgggtacacgggggacttcgactctgtgatagactgcaacgtcgccgtcgagcagtatgttgactttagccttgaccctacgttttctattgagacccacacagtccctcaagacgcggtgtccagaagtcagagaaggggccgcaccggtcgaggcaaaagtggcacttatcgctacgtctcgcccggtgaacggccgtcaggaatgtttgactccgtggtgctctgtgaatgctatgacgccggctgcgcttggtacgagcttactcccagcgagacaacagtgcggctcagagcatatttatcaacacctggactgcccgtctgccaagaccatctggagttctgggaaggtgtatttactggattgacccacatagatgcccacttcctatctcaaacaaaacaacagggcctgaattttccatacttgacagcatatcaggctacggtctgcgctcgtgctgcagctctcccccctagctgggacgagacgtggaaatgcctcatccggctcaagccaactctgcacgggcccacacccctcctttacaggctgggagctgtgcaaaatgagatctgcacgactcacccggttacaaaatacattgcaacttgtatggcagctgatctcgaggttgcgaccagcgcctgggtgttgcttgggggggtgatggcggcgctaacagcctactgtttgtcagtgggtagcgttgtcatcgtaggtcacctggtactaggggggaagcctgctcttgtcccagacaaagaagtgctataccagcagtatgatgagatggaagaatgttctcgagcggctccttacatcgagcaagctcaggggatagcccaacagtttaaggagaaggtcatcggccttctccaacaagctgaccaaaaggctgctgatatcaagcctatagctacaccgtattggcaaaagttggagaccttttggagcaaacacatgtggaactttgtcagcgggattcaatacttggccggattgtccaccttacccggtaatcctgctatagcatctctcatggcatttactgcatctgtgaccagcccacttacaacaaatcaaaccctactgttcaacataatggggggttgggtggccagtaatttggcacccccccctgcctccaccgcatttgtggtgagcggcttggccggtgccgctgtaggaagcatcggcctgggcaaggtcttactggacatactggcaggttatggggctggggtagctggtgctttggtcgcgtttaagatcatgggaggtgaaatgcccagcacggaggacatggtaaatctcttgcctgccatcttatcccccggtgctctagtggttggcgtgatctgcgcagctattctgcgccggcacgttggacccggggagggtgcagtacaatggatgaataggttaatagctttcgcatccagaggcaaccatgtagcaccaactcactatgtccctgagagcgatgctgcagcgaaggttacagcactgctaagctctttgaccgttacacagctcctccgccggctccaccagtggatcaacgaagactatcccactccttgcgatgggaattggctttatgacatttggaattgggtctgtactgtgcttgctgacttcaagctgtggcttggagcaaagatcttgcccaagatgccaggtatccctttcctttcttgtcagaagggatacaggggtacttggcgaggcgatggagtcgtgtctacgcgctgcccttgcggagccctcctctctggtcacgtgaagaacgggactatgagacttgtaggtccgcgatggtgcgcgaacacatggcacggtaccttccctatcaatgggtacaccactggtcctagcacgccagccccctcttatgcttactcgcgcgccttatggcgggtagcttctgacagctacgtcgaggtacgcaaagtgggggacttccactatgtcacagggacgaccgatgacgggttgaaatgcccgtgtcaggtcccactaccagagtttttcactgagcttgacggggtgagactccaccgctacgctccggtttgtaggccccttttaagggatgatgtcaccttcactgtggggttgaactcctacgtaataggatcgcagctcccctgtgagcctgagccggacgtcgcggtggtgacctcaatgctgcaagatccatcgcacataactgtcgagacggccaagcgccgacttgatcgaggatctcccccctcacttgcaagctcttctgccagtcaattgtcagccccgtcgaggaaagctacgtgcactacgcacggacggcatccagacgctgagcttatcactgccaatttgttgtggaggcaagagatgggtagtaacatcacgcgggtggagtccgagtccaaggtggtgatccttgactcatttgagcctctgagggcctgtgatgatgaagacgagctctcagtagctgctgagtgtttcaagaaaccaccgaagtatcctccggcccttcccatttgggccagaccggactacaacccaccattggtggaaccatggaaagaccccgactatgtgccgcccaccgtgcatgggtgtgcattgccaccacagaaacttccacccgtgccacctccgcgcaggaagagaaccatcgttctcagcgagtctacagtgtcaaaagcactggccagcttagctgagaaaagcttcccgcaaccaacatgttccgcggaggatgagagtacctcaggggtcggcactcaatctggcagcctgaccggtcctgtccaactagatgatgacgactcggacaacgagtctcattcatctatgccccctcttgaaggagagccgggcgatccggacctaagttccggttcttggtccacggtcagcggggaagagcagagtgtggtgtgttgttccatgtcctactcctggacgggggcactcatcacgccatgtgccgctgaggaagaaaagctccccatcagtccactcagtaactcgttgctgagacaccacaatcttgtctactccacgtcatcacgtagcgctgcccaacggcaaaagaaggttaccttcgataggctacaagtgcttgatgaccactataacactactctgaaggagatcaaggaactagcatctggggtaaaggctgagctgctctctgtagaagaagcgtgccgccttgtcccctctcactccgccagatcgaaatttggctacggagcgaaggaggtgcggtccttgtccagcaaggccattaaccatatcaactccgtatgggaggacttgctggaagacaacactacacctataccaaccaccatcatggcaaaaaacgaggtctttgctgtggccccccataaggggggtcgtaagccagcccgcctgattgtgtatcctgacctgggagtgcgtatctgcgagaagcgcgctctatatgatgtgatacagaagttgcccagtgcaataatgggatccgcctacgggttccaatattcgcccaagcagagggtcgagtatcttcttaagatgtggaactcaaagaagacacctttgggtttctcctatgacacccgctgcttcgactccactgtcactgaacaggacatcagggtagaagagtccatctatcaggcctgtgacctcaaggacgaggctaggagggtgataacttcactcacggagcggctttactgtggtggccctatgttcaacagcaagggacagcactgcggttaccgccgctgccgtgctagtggggtgctacccactagttttggaaacacagtcacctgttacctcaaagcaaaggcagccaccaaagccgccgggatcaaagatccatcattccttgtctgcggagacgacttggtcgtaattgctgagagtgcagggatcgatgaggacaaaagtgccttgagagctttcacggaagctatgaccaggtactcagcccctccaggcgacccgcctcagcccacttacgacttggagcttattacatcttgctcttcaaacgtctctgtagcccatgacggcgcggggaaaagatattactatcttacccgcgacccggagacccccctggcccgcgcggcctgggagactgcccgccacactccagttaactcctggttgggaaatatcattatgtacgcacctaccatctgggtgcgcatggtgattatgacccattttttctccatactgcaagctcaggagcaactagaaaaagccctcgacttcgagatgtacggggctgtctattctgtcactccactggacttgccagccatcattgaacgactccatggcctaagcgcgttctcactccacagttactctccagttgagctcaatagggtagcaggggctctcaggaaacttgggatccctcctctacgagcctggagacatcgggcaagagcggtgcgcgcaaagctcatttcccagggagggaaggccaaaatctgtggcctttacctcttcaactgggcagtgcgcacaaaggcaaaactcactccattgcctcaagcgggcctcttggacttgtccaggtggttcactgtaggcgcaggcgggaacgacatttatcacagcgtgtcacgtgcccgatcccgccatttactccttggcctactcctacttacggtaggggtaggcatcttcctgttaccagcccgataggctggtaactaacactccatttttaacttatttgttttttttttttttttt

SEQ ID NO: 779 - DNA, 9461 bp, Hepatitis C Virus
gccagccccttacggggcgacactccaccatgatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcatcatgagcacaaatccaaaaccccaaagacaaaccaaaagaaacaccaaccgtcgcccacaggacgtcaagttcccgggcggtggtcagatcgtgggtggagtatacttgttgccgcgcaggggccctcgattgggtgtgcgcgcgactaggaagacttccgaacggtcccagcccagaggcaggcgtcagcccattccaaaggctcgccgccagacgggccgtgcctggggtcagcctgggtacgcatggcccctgtatgggaatgagggctgcgggtgggcagggtggctcctgtccccccgcggctctcgcccaacgtggggcccaaacgacccccggcgtaggtctcgcaacttgggtaaggtcatcgatacccttacttgcggcctcgccgacctcatggggtacatccccgtcataggcggccccttagggggcgtcgcagcagctctggcgcatggcgtcagggctgttgaggacggggtaaattatgcaacagggaatcttcccggttgctccttttctatcttccttctggcacttctttcgtgcctaactgtaccagcctcggcagtcaattatgccaataagagcggcatctaccatcttaccaatgactgcccaaacagcagcatggtgtacgaggccgaggcaatcatcctgcaccttccagggtgcgttccgtgcatcaggaccggaaatcagtccaggtgctggacaccggcgacgcccactcttgccatcccaaattcaactgtgcctgctagcgggttccgccagcacatcgacctcatggttggcgctgccgcactctgttcggctatgtatttgggcgatttgtgcggaggagtcttcctggtagggcaactcttcacttttcgaccccgcatacatcagactgtgcaggactgcaattgctccatctacaccggccatgttacggggcacaggatggcgtgggacatgatgatgaattggtcgccaaccgctacattcgtggtctccagcgctctacgggcgccacaggtcttgtttgacatctttgcgggcggccattggggtatcataggggcgttgctgtactacagcacggccgctaattgggctaaggtcatcatagtcctactcctgttcgcaggagttgatgcctccacctacgttgccagttcagtcagccaagccacgtctggtctcgtgagcctgttctccgctggtgcccggcagaatctccagcttatcaacaccaacggaagctggcatatcaacaggaccgcgcttaactgtaacgactcattacagactggtttcatcgcgagcttgttctaccgcaacaaatttaatgccactggttgcccagaaagattgtccgcgtgtaagaccttggactctttcgatcaaggttggggccccattacgtatgccaacatcagtggtcccgctgtggaaaagccttactgctggcactacccgcctagaccatgtgaggttgtgtcagctcttaatgtctgtggtcctgtctactgctttacaccaagccctgtggtacttggcaccaccgataggaggggcaaccctacctacacctggggggccaatgaaaccgacgtctttatgatgtcgagcttgcgacccccagcgggagggtggtatgggtgcacatggatgaatacttcggggtttgttaagacatgcggcgctccgccgtgcaacatcaggcccaaccccgaggagaacaggaccgaaacgctgcgatgtcctaccgattgcttccggaagcacccgggcgccacttatgcaaaatgtgggtcggggccgtggctcacccctaggtgtttggtggactacccttatagactgtggcactatccttgcactgtgaactataccctacacaaggtcaggatgtacatagctggcagtgagcataggttcacggctgcctgcaactggaccaggggggaacggtgcgatttggcagatcgcgacaggattgagatgagcccgctgttgttctccaccaccgaacttgctatcctgccgtgctcatttacaacaatgccagctctgtccaccggcctgatacatctacaccagaacgtggtggatgtccaatacttgtatgggctctcgacttccatcgttaattgggccatcaagtgggagtatgttgtcctcctattcctggtgctggcagattctcgcatttgtctggctctttggctgatgctgctcataggtcaggccgaggcggcgctagagaacctaatagtcctcaacgccgcttcggccgcagccactcgtggctgggagtgcttcctgctcttcatgtgctgggcgtggtatgtgcggggtcgcgttgtccctgctgtcacatatggcctcctcaacctatggccactactactgctggtcctattgttaccccatcgggcgtacgcctacgacggcgttcaggccgggtcgatcggcgctgcggttatagccgccctgaccatcttcagcctcacaccagcatacaagactctgctagcacatttcctgtggtggacccagtacttcatagcacacattgaagccaagctacatgtttgggtccccttcctccgggtgcgcgggggccgtgacgccatcatcctgctcacgtgtgttttccacccaagcctgggttttgaggtaacaaagatcttactagcattgataggaccgctgtacctcctgcacgccagcctcctgcgggtgccatactacgtacgtgcacatgcgctcattcgcatatgcgcgcttgtgcagaacgtagcagggggaaagtacgttcaagcggcaatcttgagagctggatcttggacgggcacctacatctatgaccacctggtccctctacgcacctgggccagcgacggcctacgtgatcttgctgtcgcagtggaacccgtcgtcttttcgcctatggagaagaaagttatcacgtggggggcggacactgcagcctgcggggacattctcgcaggtctccctgtttccgccagacgaggcaacttgatccttctcggacccgctgatgacgttaaggacaagggttggtcattgcttgctccaattacagcctacgcccaacagacgcgcgggttgctgggtacaatagttaccagcctcaccggccgtgacaagaatgaggcagctggcgagatacaaatcctctcaacggccactcaaactttcctggcaacctgtgttaacggtgtgtgctggactgtctaccatggtgcagggtcgaagaccttggcagggcccagggggcccgtctgccagatgtacactaatgtagatcaagacatggttggctggcctgctccggcaggcaccaggtcgtacacgccttgcacatgtggcgcaagtgacctctacctcatcacgcggcaagctgatgtcatcccagcacgtcgtcgcggcgataatcgagccggtcttatcagcccacggccgatatccactctcaaggggtcgtcaggaggcccgctgctttgtccatcaggccatgtggtcgggctgtttcgcgcagctgtctgcacccgtggtgttgccaaggcgcttgattttgtgccttgtgaggccatggacgcgaccacgcggtctcccaccttcactgacaactccacaccgccagctgtgcctcaggcctaccaagttggctacctccatgctcctacgggtagtgggaaaagcacgaaggtccccgtagcctatgcctcccaggggtacaaggtgctcgtgcttaacccgtcggtggctgcaaccctgtcctttggttcatacctcagcagagcccacggcattgaccctaacatcaggactggggttaggactatcaccactggtgcgcccatcacttactccacttatggcaaatttttggcggacgggggctgctcagggggcgcctacgacgtcatcatttgtgacgagtgccactctacagatcccactacagtcctgggaataggtaccgtgctcgaccaggcggagacagcaggctgccgccttacggtgttagccacagccacaccgcctggctctgttacggtccctcacccaaacatacaggagacggcacttcccctaacgggagaggtgccgttttatgggaaggccatccctctagaatacatcaaggggggtaggcatttaatattttgtcactcaaaaaagaaatgcgacgagctagcggcccaactgagaactctgggcctcaatgccgtcgctttctacagaggcgtggacgtctccgtcatccccacctcgggtgacgtagtcgtctgtgccacagatgctctcatgacagggtatacgggcgatttcgacagcgtgatcgattgcaacgttgcagtcacgcagatcgttgacttcagcctggatcccaccttctcgattgagactactactgttccccaagatgcagtggcccgcagtcaacgtcgtggccggactggtagggggaagcctggggtgtatagatatgtctcacaaggagaacggccgtcgggaatgttcgacacggttgtcctctgtgaggcctatgataccggagctgcgtggtacgagctaacacccgcagaaaccactgtcagactccgtgcttacctcaacacccccggactccccgtatgccaggatcatctagagttctgggaggcagttttcactggacttacacatatagacgcccacttcctttcccaaacaaaacaaggaggggagaacttcgcgtacctggtagcctaccaggctaccgtctgcgcgagagccaaagctccccccccctcatgggacacgatgtggaagtgtctactcaggcttaagcccaccctgaccggacctactcctctgttgtataggctgggtgctgttcaaaatgaggttacaccaacccatcctgttaccaagtacatcatggcctgcatgtctgccgatctggaggtcatcaccagcacctgggtggtagccggtggcatcctcgctgcaatagctgcttactgtttaacagtgggtagcgttgtcatctgcgggaggatcaccacgtctagcaggcctgcagtcatacctgacagggaggtgatgtatcagcagtatgacgagatggaagaatgctctcggcacctcccttacctggttgaaggacagcaattagctgagcaattcaaacaaaatgtgctcggcttgatccaggtcacgacgaagcaggcggaagaacttaaaccagccgtccactctgcttggcctaagctcgaacagttttggtataagcatatgtggaacttcataagtggtatacaatatctggccggcttgtccactttgcctggtaaccctgctgtcgcagctctgatgtcattctcagcctccttaaccagcccactgacaacagcgcaaaccctcctcctcaacgtgttgggggggtgggtagcatctcaactggccactccggtcccagctacagcttttgtggttagcggcttagccggcgctgctattggtagcataggactgggtaaggtcattgtggacatcctggctggatatggcgctggtgtgtcgggagccctcgtagcctttaaaatcatgagcggcgagactccgtcagtcgaggacatggtgaacctactccccgcccttctgtcaccaggggcactggtagtgggggttgttcgtgctgccattttgcggcgccacgtgggccccagcgaaggagctgcccagtggatgaaccgcttgatagctttcgcgtcacggggcaatcacgtgtcgcctacacactatgtgcctgagacagatgcatctcgggcagtgaccaacatacttagttcccttaccatcactagtctcttgcgtaaactccatcactggattaccgaggactatgccacaccatgtgggtcaacatggcttagagacatctgggactgggtgtgtactgtcctgtcagactttagagtttggcttaaatccaagctcatgcccagcctcccaggggtcccctttttctcgtgtcagcgaggctacagggggacctggagaggcgatgggatttgcaacactacgtgcccctgcggtgccagcattgcgggccatgttaagaacgggactatgagaatagtcggaccccgcacctgcagcaacgtatggaatggcactttccccattaatgcgacgacgaccggtccaagcatacccatcccggcgccaaactacaaaaaagcgctgtggagggtaagtgctactgaatacgtcgaagtcgtacgggtgggagactcccattacatcacaggggttacagctgagaacaccaagtgcccctgtcaggtgccggctccagagttcttcacggaggtggatggcgtgaggttacacaggtacgccccagaatgcaagcccatccttagggatgaggtaacgttcactgtggggctgtccacttacgtggtggggtcacaattaccctgtgagcctgagccagacgtgctggtggtgacatcaatgttaagggaccctgaccacatcaccgcagaggaggcatctcgccgccttaagaggggatctccaccatccctagccagctcatctgccagtcagttgtcagctccgtctctcaaggctacatgcaccactcacgccgaccatccggacgctgaactcgtggaagcaaatctcttatggaggcaggaaatggggggaaacatcacgagggtggagtcagaaaataagatcgtcattttagactcctttgagccactcaaagcggagtttgacgacagggagatttcggtggcggcggaatgccacaggccgccgaggttcaagtatcctcctgctcttcccgtgtgggctcgacctgattataacccgcctttacttgagacctggaaggcaccagattatgaccctccggtagtgtccgggtgcgctcttcccccacaggggcttcctcctgttccacccccaaggaggaagaagctcgtacagctggatgactcagtcgtgggacatgtactggctcagctagctgaaaagagtttcccagccacaccggaccaaccccaaaccaattcagactctggtcacggcactaacggcgctgcgtcgctaccatcagctgaagatgacgatgcctcagatgcagactcgtatagttctatgccgcctcttgagggcgagcctggcgatcctgacctctccgatgggggaggttcggggtcgtggtctacggtcagctctgaggaaaccagcgtcgtttgctgttcgatgtcatactcatggacgggggctctcatcactccatgcgctgctgaggaggaaaagttgccaattagtcctttgagcaacactctgatccgacaccataatatggtttactccactacatcacgtagcgcagctctccgccagaaaaaagtaacctttgacagacagcaggtcgttgaccaacattattatgacacccttaaggagatgaaggcccgggcgtcgactgtgagcgcaaagttgctcagcgttgaggaagcatgcgacctcacgccagctcactctgcccgttccaagtttggatacggtgcgaaggacgtccgaggccgcactagcaaagcccttaaccacatcaactccgtgtgggaggatctgctagaagacaatgtgacacctattcctactactataatggcaaagaatgaggtgttttgtgtggacgtctcaaaggggggtcgtaagccggcccggctgatcgtgtacccggacctgagtgtccgggtctgcgagaaaagggccctgtacgacgtcacacgcaaattgcccgtagccgtgatgggagcagcatatggcttccagtactcacccagtcaacgggtagagtacctcctcaagatttggcgctcgaagaagacacctatggggttctcctatgataccaggtgttttgattcaacagtgactgagcgtgacatccggacagaggagtctatataccaatgctgcgagttagaccccgtggcccggaaggccatctcatcactcaccgagcggttatacgtgggaggccctatgtacaattcacagggtcaatcctgcggctaccgccggtgtagggccagcggggtcctccccacgagcatgggcaacacactgacttgctatttaaaggccatggcggcttgtaaggctgctggcctcaaaaactttgacatgttggtctgcggagacgatttggtggtcatctctgagagtttgggggtctcggaggacgccagtgccctgcgagcgtttacggacgctatgaccaggtactcggcgcctcctggagacgaaccgcacccggagtatgacttggagcatattacatcctgctcatccaacgtatccgtggcccacgaccacaccggacagagatattactacctcacccgtgatccgaccaatgtcctagcccgggctgcttgggaaactgctcgacacactcccgtgaattcctggttgggcaacatcattatgtacgcgcccactatatgggtgcgtatggtgctgatgacgcacttctttgggatactccagcctcaagagcagctccacaaagcactcgactttgacatgtacggggtcacgtacaatatcactccacttgatctaccccagatcattcagcgcctccatggcatggctgccttttcactccatggttactctccaggtgagctcaatagggttggagcgtgcctcaggaaacttggggcccctcccttgcgggcctggagacatcgggctagggcagtccgagctaagcttatcgcccagggtgggaaagctgctatatgcggcatgtacctcttcaactgggccgtaaaaactaagctcaaactcactccattgcgcgacgctcaccgcctcgacttatctgggtggtttgtggcgggctacagcgggggggacatatttcacagcgtgtcccatgcccgaccccgcgtattactcctgtgcctactcctacttacagtaggggtaggcatcttttttctccccccccgataaacgggcggcctcaagcaacactccatttgccctttttttttttttttttttttt

SEQ ID NO: 780 - DNA, 9295 bp, Hepatitis C Virus
gtatgagtgtcgtgcagcctccaggaccccccctcccgggagagccatagtggtctccggaaccggtgagtacaccggaattgccaggacgaccgggtcctttcttggattaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacacctaccgccgcccacaggacgttaagttcccgggcggcggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggcaggacctgggctcagcccgggtacccttggcccctctatggcaatgagggcatggggtggacaggatggctcctgtcaccccgtggctcccggcctagttggggccccacggacccccggcgtaggtcgcgcaatttgggtaaggtcatcgatacccttacatgcggcttcgccgacctcatggggtacatcccgctcgtcggtgctcctcttgggggcgctgccagggccctggcacatggtgtccgggttctggaggacggcgtgaactatgcaacagggaatttggccggttgctccttttctatcttcctcttggctctgctgtcctgtttgaccaccccagcttccgcgtatgaagtgcgcaacgtctccgggatataccatgtcacgaacgactgctccaactcaagcattgtgtatgaggcagtggacatgatcatcgatagtcccgggtgcgtgccctgcgttcgggagaataacctctcccgttgctgggtagccctcactcccacgctcgcggccaggaaccccagcgtccccaccacgacaatacgacgccacgtcgacttgctcgttggggcggctgctttctgttccgctatgtacgtgggggatctttgcggatccgttttccttgtctcccagctgttcaccttctcgcctcgccggtatgagacagtgcaggactgcaattgctcactctatcccggccatgtaacaggtcatcgcatggcttgggatatgatgatgaactggtcacctacagcagcgctagtggtgtcgcaattactccggatcccacaagccgtcgtggacatggtggctgggggccactggggggttctggcggggctcgcctactattccatggtggggaactgggctaaggtcttgattgtgatgttactctttgccggcgttgacggaagcaccgtcgtgacagggggggtgcaggggcgcaccaccagcgtgtttacgtccctcttctcacctggggcatcccagagagtccagcttataaacaccaacggcagctggcacatcaacaggactgccctgaactgcaatgactccctccacactgggtttcttgctggtgttttctatcacaacaagttcaactcttccggatgtccagagcgcttggccacgtgccgccccattgataagttcgatcagggatggggccccatcacttacaacaatagtggcaactcggaccagaagccttattgctggcactacgcgcctcgacagtgcggtatcgtacccgcgtcggatgtgtgtggtccggtatattgcttcactcccagccccgtcgttgtgtggaccaccgatcgtctcggtgtccctacgtacacctggggtgagaatgagacggacgtgctgctcctcaacaataccaggccgccgcatggtaattggtttggctgtacatggatgaacagcaccgggttcaccaagacgtgcgggggccccccctgcaatattgggggggtcgggaacaacaccttgatttgccccacggactgcttccggaagcaccccgaggctacttacacaaaatgtggttcggggccttggttgacacctaggtgcatggttgactatccgtacaggctctggcattacccctgcactgtcaacttcaccatcttcaaggttaggatgtatgtagggggcgtggagcacaggcttgatgctgcatgcaattggactcgaggagaacgttgtgacctggaggacagggatagatcagagctcagtccgctgctgctgtctacaacagagtggcagatactgccgtgttccttcaccaccctaccggccttgtccactggccttatccatctccatcggaacatcgtggacgtgcaatacttgtacggtatagggtcagcggttgtctccttcgcaatcaaatgggaatatgtcctgttgcttttccttctcctggccgatgcgcgcgtctgtgcctgcctgtggatgatgctgctgatagcccaggctgaggctgccttagagaacctggtagtcctcaatgcggcgtctgtggccggagcccatggtgtcctctccttccttgtgttcttctgtgccgcttggtacatcaaaggcaggctggtccctggggcggcatatgctctctatggcgtatggccgctgctcctgcttctgctggcgttaccaccacgagcttacgccatggaccgggagatggctgcatcgtgcggaggcgccgttctcgtaggtctggtattcctgactttatcaccatactataaagtgttcctcgccaggctcatatggtggttacaatattttatcaccagagccgaggcgcacttgcaagtgtgggtcccccctctcaacgttcggggaggccgcgatgccatcatcctcctcacgtgcgtggtccatccagagctaatctctgacatcaccaaacttctcgtcgccatactcggtccgctcatggtcctccaagctggcatatccagactgccgtacttcgtgcctgctcaagggctcattcgtgcatgcatgttagtgcggaaagtcgctgggggccattatgttcaaatggccttcatgaagctggccgcgctgacaggcacgtacgtttatgaccatctaactccactgcaggattggccacgtgcgggcctacgagaccttgcggtggcagtagagcccgtcgtcttctctgacatggagactaagatcatcacctggggggcagacaccgcggcgtgtggggacatcatctcgggtctgcccgtctccgcccgaaggagaagggagatactcctgggaccggccgatagtcttgaagggcagggatggcgactcctcgcgcccatcacggcttactcccaacagacacgaggcctacttgggtgcatcatcactagcctcacaggccgggacaagaaccaggtcgagggcgaggttcaagaggtgtccaccgcaacacaatctttcctggcgacctgcgtcaacggcgtgtgttggactgtgttccatggtgccggctcaaagatcttagtcggcccaaagggtccaattacccaaatgtacactagtgtggaccaggacctcgtcggctggtgggagcgccccggtgcgcgttccctgacaccaggcacctgtggcagctcggtcctttacttggtcacgagaaatgctgatgtcattccggtacgccgggggggcgacggcagggggagcttgctctcccccaagccggtctcctacttgaagggctcttcgggtggtccactactctgcccttcggggcacgctgtgggcatcttccgggcggctgtatgcacccggggggtcgcgaaggcggtagacttcatacccgtcgagtctatggaaaccactatgcggtcccttgtcttcacagacaactcatcccctccggccgtaccgcaggcattccaagtggcacatctacacgctcccactggcagcggcaagagcaccaaagtgccggctgcgtatgcggcccaagggtacaaagtactcgttctcaacccgtccgttgccgccaccttagggtttggggcgtatatgtctaaggcacatggtaccgaccctaacatcagaactgggataaggaccatcaccacgggtgcccccatcacgtactccacctatggcaagttcctcgccgacggtggttgttctgggggcgcctatgacatcataatatgtgatgagtgccactcaactgactcgactaccatcttgggcatcggcacagtcctggaccaagcggagacggctggagcgcggcttgtcgtgctcgccaccgctacgcctccgggatctgtcaccgtgccacaccccaatattgaggaggtggccctgtccaacactggagaggtccccttctatggcaaagccatccccctcgaggccatcaaggggggaaggcatctcattttctgccattccaagaagaagtgcgatgagctcgccgcaaagctgtcaaccctcggaattaatgctgtggcatattaccggggtcttgacgtgtccgtcataccggctagcggagacgtcgttgtcgtggcaacagacgctctgatgacgggctttaccggcgactttgactcagtgatcgactgcaacacatgtgtcactcagacggtcgatttcagtttggaccccaccttcaccatcgagacgacgaccgtgccccaagacgcggtgtcgcgctcccagcggcggggtagaactggcaggggtaggagaggcatctacagatttgtgaccccaggagaacgccccttgggcatgttcgactcctcggtcctgtgtgagtgctatgacgcgggttgtgcttggtatgagctcacacccgctgagaccacggtcaggttacgggcttacctaaatacaccggggtttgccgtctgccaggactatctggagttctgggaggacgtcttcacaggcctcacccacatagagtcccacttcttgtcccagactaaacaggcaggagataacttcccctacctggtagcataccaagccacagtgtgcgccagggctcaggctccacctccatcgtgggatcaaatgtggaagtgtctcatacggctaaaacctacactgcacgggccgacacccctgctttataggctaggagccgtccaaaatgagattaccctcacgcaccccataaccaagtacatcatgacatgcatgtcggctgacctggaggtcgtcactagcacctgggtgctggtaggcggagtccttgcagctctggccgcatactgcctgacaacaggcagcgtggtcattgtgggtaggatcatcctctccgggaggccggctgttgttcccgacagggaagttctctaccgggagttcgatgaaatggaagagtgcgcatcacacctcccttacatcgaacaaggaatgcagctcgccgagcagttcaaacagaaggcgctcgggttgctgcaaacagccaccaagcaagcggaggctgctgctcccatggtggagtctaaatggcgggcccttgagactttctgggcaaagcacatgtggaatttcatcagcgggatacagtatttagcaggcttatccactctgcctgggaaccccgcgatagcatcactgatggcattcacagcttccatcaccagcccgctcaccacccaaaataccctcctgtttaacatcttagggggatgggtggctgcccaactcgccccccccagcgccgcttcagccttcgtgggcgccggcattgccggtgcggctgttggcagcataggccttggaaaggtacttgtggacatcctggcgggctatggggcaggggtggctggcgcgctcgtggcctttaaggtcatgagcggcgaggtgccctccactgaggacctggttaatttactcccagccatcctctctcctggcgccctggtcgtcggggtcgtgtgtgcagcaatactgcgtcgacacgtgggcccaggagagggggcagtgcagtggatgaaccggctgatagcgttcgcttcgcggggtaaccatgtttcccccacgcactatgtgcctgagagcgacgctgcagcgcgtgttactcagatcctctccagccttaccatcactcagctgctgaagaggcttcaccagtggattaatgaagactgctccacgccatgctccggctcgtggctaagggatgtttgggactggatatgcacggtgttgactgacttcaagacctggctccagtccaagctcctgccgcagttgccgggaatccctttcctttcatgccaacgcgggtacaagggagtctggcggggggacggcatcatgctaaccacctgcccatgtggagcacagatcaccggacatgtcaaaaatggttccatgaggatcgttgggcccaaaacctgtagcaacacgtggcatggaacattccccatcaacgcatacaccacgggcccctgcacaccctccccggcgccaaactattccagggcgctgtggcgggtggctgctgaggagtacgtggaggttacgcgggtgggagatttccactacgtgacgggcatgaccactgacaacgtaaagtgcccatgccaggttccggcccccgagttcttcacggaagtggatggagtgcgactgcacaggtacgctccggcgtgcagacctctcctacgggaggaggtcaaattccaggtcgggctcaaccagtacctggttgggtcgcagctcccatgcgagcccgaaccggatgtagcagtgctcacttccatgcttaccgatccctcccacattacagcagagacggctaagcgtaggttggctagggggcctcccccctccttggccagctcttcagctagccagttgtctgcgccttccttgaaggcgacatgcactacccatcatgactccccagacgctgacctcatcgaggctaacctcctgtggcgtcaggagatgggcggaaacatcacccgcgtggagtcagagaataaggtagtgattttggactctttcgacccgcttcgagcggaggaggatgagagggaggtgtccgttgcggaggagatcctgcggagatccagaaagtttcccccagcgatgcccatatgggcacggccggactacaaccctccattgctagagtcctggaaggacccggactatgttcctccggtagtacatgggtgcccattgccacctgctaaggcccctccaataccacctccacggaggaaaaggacggttgtcctgacagagtccaccgtgtcttctgccttggcggagctcgccactaagacctttggcagctccggatcgtcggctgtcgacagcggcacggcgaccgcccttcctgaccagacctccgacgacggcgacaaaggctccgacgttgagtcgtactcctccatgccccctcttgagggagagccgggggaccccgatctcagcgacgggtcttggtctaccgtgagcgacgaggcgagtgaggacgtcgtctgctgctcaatgtcctactcatggacgggcgccatgatcacgccatgcgctgcggaggaaagcaagctgcccatcaacccgttgagcaactctttgctgcggcaccacaacatggtttatgccacaacatctcgcagcgcaggcctgcggcagaagaaggtcacctttgacagactgcaagtcctggataaccactaccgggacgtgctcaaggagatgaaggcgaaggcgtccacagttaaggctaaacttctatccgtagaagaagcctgcaagctgacgcccccacactcggccagatccaaatttggctatggggcaaaggacgtccggaacctatccagcagggccgttaaccacatccgctccgtgtggaaggacttgctggaagacactgagacaccaattgacaccaccatcatggcaaagaatgaggttttctgcgtccaaccagagaaaggaggccgcaagccagctcgccttatcgtattcccagatctgggagttcgtgtatgcgagaagatggctctttacgatgtggtctccactcttcctcaggccgtgatgggcccctcatacggattccagtactctcctaagcagcgggtcgagttcctggtgaacacctggaaatcaaagaaatgccctatgggcttctcatatgacacccgctgttttgactcaacagtcactgagaatgacatccgtgttgaggagtcgatttaccaatgttgtgacttggcccccgaagctaagcaggccataaagtcgctcacagagcggctctatatcgggggtcccctgactaactcaaaagggcagaactgcggttatcgccggtgccgcgcaagcggcgtcctgacgactagctgcggtaataccctcacatgctacttgaaggcctctgcggcctgtcgagctgcgaagctccaggactgcacgatgctcgtgaacggagacgaccttgtcgttatctgtgaatgcacgggaacccaggaggatgcagcgaacctacgagccttcacggaggctatgaccaggtactctgccccccccggggacccgccccaaccagaatacgacttggagctaataacatcatgttcctccaatgtgtcggtcgcgcacgatgcatctggcaaacgggtgtactacctcactcgtgaccccaccacccccatcgcacgggctgcgtgggagacagctagacacactccagttaattcctggctaggcaacatcatcatgtacgcgcccaccttatgggcaaggatgattttgatgactcacttcttctccatccttctagctcaggagcagcttggaaaagccctggactgtcagatctacggggcctgttactccattgaaccacttgatctacctcagatcattgagcgactccatggtcttagcgcattttcactccatagttactctccaggtgagatcaatagggtggcttcatgcctcaggaaacttggggtaccacccttgcgagtctggagacatcgggccagaagtgtccgcgctaggctactgtcccagggggggagggccgccacgtgtggcaaatacctcttcaactgggcagtaaggaccaagctcaaactcactccaatcccggctgcgtctcggttggacttgtccggctggttcgttgctggttatagcgggggagacatatatcacagcctgtctcatgcccgaccccgctggtttatgttgtgcctactcctactttctgtaggggtaggcatctacctgctccccaaccggtgagtggggagcgaaac

SEQ ID NO: 781 - DNA, 9449 bp, Hepatitis C Virus
gccagccccttaacggggcgacactccaccatgatcactcccctgtgaggaactactgtcttcacgcagaaagcgtctagccatggcgttagtatgagtgtcgtgcagcctccaggcccccccctcccgggagagccatagtagtctgcggaaccggtgagtacaccggaattgccaggacgaccgggtcctttccattggatcaaacccgctcaatgcctggagatttgggcgtgcccccgcaagactgctagccgagtagcgttgggttgcgaaaggccttgtggtactgcctgatagggtgcttgcgagtgccccgggaggtctcgtagaccgtgcaacatgagcacacttcctaaacctcaaagaaaaaccaaaagaaacaccaaccgtcgcccaatggacgtcaagttcccgggcggcggccagatcgttggtggagtttacttgctgccgcgcaggggcccacgattgggtgtgcgcgccacaagaaagacatccgagcgatcccagcccagaggtaggcgccaacctatacccaaggcgcgcccatctcagggccggacctggggtcagcctggctacccctggcccctgtatgggaatgagggctgcgggtgggcaggctggcttatgtctccccgcggctctcgcccttcttggggcccaaacgacccccggcgtcggtcccgtaatttgggtaaggtcatcgataccctgacatgcggactcgccgacctcatggggtacattcccgtcgtaggcggacccttgggtggcgtcgcggctgcgctcgcacatggtgtgagggcaatcgaggacgggattaactatgcaacagggaatcttcctggttgctctttttctatcttcatcctggcactgctctcgtgcctcaccacaccagcctcggcgctcacatacggcaactccagcgggttgtaccatctaaccaatgattgtccacgctccagcatagtgctggaagcggaggccatgatcctacacctagctggttgtgtgccttgcgtgagagccggaaacatttcacgctgctggcatcctgtttcacccaccctggctgtaccgaatgcctcggtgcctgcgagcgggttccgcaaacatgtggatctcctcgcaggcgctgcagtcgtttgctcttcgatgtatatcggagacctctgcggtgccgtatttttggcaggacagttggctaccttcagtcctcgcatccacgacataacgcaggactgcaattgttcggtttatacaggccatgttaccggccacagaatggcgtgggacatgatgatgaactggtcgcctaccactaccctggtcctgtcgagcattctgagagtgcccgaaatagtgctcgaggtgttcgccggcggtcactggggtgtcctgatcgccatcgcctacttcggcatgtcaggcaattggttgaaggtaatcgctgtgttattcctgtttgcaggggtagaggcaaccaccaccgtcggcagagcggccggccgttctgcttatctcttcacctccattttctcgtctggtccaaatcagaagatacagcttattaacaccaatggtagctggcacataaataggaccgctctaaactgtatcgacagtctccaaactgggtttcttagcgcgttgttctaccgcagcaatttcaactccacgggttgctcagaacggcttggcgcatgcaagcccttggaacacttccagcagggatggggccctataacccacaagtccaacatcacagggccgtctgaggaccggccctactgctggcactatgctcctagggagtgtagtgtagtgccggcgtcatcagtgtgtggtcctgtttactgcttcacacctagccctgtcgtggtgggcaccaccgacaggctgggcaaccctacttacaactggggagaaaacgagacggatgtgttcatgctagagagcctgcggcctccgcaaggaggttggttcgggtgcacgtggatgaactctacgggcttcaccaagacctgcggagccccgccttgccagttaatcccaggagactataatagttcttctaaccagctcctgtgccctactgactgcttccggaaacatccggaggccacatatcagaagtgtgggtcggggccctggctgacccccaggtgtctggtggactatccctacagattgtggcactatccatgcactgtcaactacacaatacacaaggttcgcatgttcattgggggcgttgagcacaggttcgatgccgcctgtaattggacgcgtggcgaccgttgcgacttgtatgacagagataggattgagatgagtcccctcctcttttcaaccacgcagcttgctatcttgccttgcagctttaccaccatgcccgccttgtcaacaggacttatacatctccatcaaaacattgtagatgtgcaatacctctacggagtctcctcgagcatagtatcgtgggccgtgaagtgggagtatgtcgtcctcatgtttttggtcctggcggatgctcgaatatgcacttgcctttggttgatgctgctcgtcggcaaggtcgaagcagcattggagcggctcgtcgtcctcaatgcagccagcgccgcgggtaccgccggttggtgttggaccctcatcttcctgtgctgcgtgtggcacgtgaaggggcgccttgtgcccgcatgcacctacacagctctaggcatgtggccgattctcctggtgattctggccctgccccaacgggcatatgcctgggacaatagtcaggctgcatcacttggggtcgttgcccttctggtgttgacaatctttaccctcagccctatgtacaaacagctgctcacacacgctatctggtggaaccaatacatgttggctcgggctgaagctatgatacatgattgggtgccagatttgcgggtcaggggcggtagggatgccatcattctgctcacctgcttgttacacccacatctcgggtttgaggtcacaaagattttgttagccatcttagcccctctgtatatcctccagcacagtctgctcaaggtgccctactttgtgcgcgcccacatcctcctgcgggcttgtatgttcttccgcaaagtggcggccggtaaatatgtgcaagcttgcctcttgaggttgggcgcctggactggcacatacatatacgatcatctagctcctctcagtgagtgggcgagcgacggcttgcgtgatctagccgtagctgttgagccagtcatcttttcccccatggagaaaaagatcattacgtggggtgcagacaccgctgcgtgtggcgacatcttgaggggtctccctgtgtccgcgagactaggggacttggtgctgctgggacccgcggatgacatgcgtcacggaggttggaagcttctggctcccatcaccgcatacgcccaacagacgcggggactggttggcactatagtgactagtttgaccggccgcgacaagaatgaagctgagggggaagtgcaggttgtatcaacagccactcagagtttcctggcgaccactatcaacggtgtcctatggactgtttatcacggtgctggctcgaaaaaccttgccggaccaaaagggcccgtatgccagatgtatacaaatgttgaccaagacctggtgggctggccagcccccctgggggctaggtcacttgccccctgcacctgtgggtctagcgacctctacctggtcacgagaggtgctgatgttatccctgcacgtcgtaggggtgatactcgcgctgctcttttgtcccccagacccataagcaccctcaaaggctcttcaggaggcccccttatgtgcccatcagggcacgtagtagggctcttcagggcggccgtgtgtacgaggggcgtggccaaggccctggacttcatccctgtggagaatatggacacaaccatgcgatctcctgtgtttaccgacaactcctcgccgcctgcggtgcctcagacctaccaggtggggtacctgcacgctccgacgggtagcggtaaaagtactcgtgtcccggcagcttacgccacccagggatacaaggtgctagttctgaatccgtctgtagcggcaacgctgagcttcggggcatacatgagcaaagctcatggtatagacccgaatatccggacgggtgtcaggaccatcaccacagggggtcccgtaacatactcaacatatgggaagtttctggccgatgggggatgttcaggaggagcatatgatatcatcatctgtgacgagtgccactccacagacccaacgacggtgcttggcatcggcactgtcctagaccaggcagaaaccgcgggggtccgcctcacggtgctcgctacggcgacgccgccaggctctgtcactgtcccccatcctaatataacagagacagctctcccgactacgggggagataccattttatggcaagtgtatccccctcgaatttatcaaggggggaagacatctcatcttctgtcactcaaagaagaaatgcgacgaactgtctaaacaactaacctcattaggtctcaatgctgtcgcattctatagaggtgtcgatgtggctgtgatccccacctcaggcgacgtcgtcgtctgcgcgacggacgcccttatgaccggctacacgggcgactttgactctgtcattgattgtaacgtagccgtgacgcaggtggtagacttcagcttggacccaactttttccatagagaccaccacagtcccccaagacgctgtctcgagaagccaacggcgtggtcgcacgggacgaggaaagccgggggtgtataggtttgtctcgcagggggaaagaccttcaggtatgtttgatagcgtcgtgctctgtgaagcttatgacacggggtgcgcatggtatgagctaactcctgcagagacaacggttagactacgtgcctacctaaacactcccgggttgcccgtctgccaagaccacctggagttttgggagggggtattcacaggattgactcacatagatgcccacttcttgtcccagacgaagcaggggggcgagaactttgcctacctcgtggcctatcaggccacggtgtgtgccagagccaaagcccccccgccgtcatgggacgtgatgtggaaatgtctcaccagacttaagccgaccctcacaggtcctacccccctcctatatcgtctgggggctgtccaaaatgagatagtaacaacacatccaatcacaaagtacatcatgacctgcatgtctgcagacctggaagtcatcacaagtacgtgggtaatcgtaggtggagtccttgccgcattagcagcctactgtttgacagtgggctgtgttgtcatctgtggcaggatcgtgacaagcggcaagcctgcggttgtccctgatcgggaggtcctgtaccagcagtttgatgagatggaggagtgctctaagcacatcccctacctagttgagggtcagcagattgctgagcagttcaagcaaaaggtccttgggctgctccaggccggcaccaaacatgcagaagaactgaaacccgctatccattccacgtggcccagggtggaggagttctggaggaaacacatgtggaactttgttagtgggattcagtacctggcgggcttatcaacactaccaggtagtccggcggtggcgtcgctaatgtcattcacagcgtccttgactagtcctctaaggacctcccagaccctgttgctcaacatattgggcggctggatagcttcccaagtagctcccccctccgcgtccacagctttcgtcgtgagcggcttagcaggcgccacggtggccagcataggactggggagggttattgttgacatccttgccgggtacggggccggtgtggcgggtgcactggtcgcctttaagatcatgagcggcgagtgtccatcaacagaggacatggtgaacttgctacccgccttgctgtcgccgggtgcccttgtggtgggagttgtgtgtgctgccatcctgagacgccacgttggcccctctgaaggcgctaaccagtggatgaacaggctaatagcctttgcctccaggggcaaccatgtctctcctacacactatgtgcccgagacggacgcatcaaacaaagtcacccaaatactcagttcacttaccatcactagcctgttacgcaggctacaccagtggattcacgaggatacgtccacgccttgcgcgtcctcatggctgcgagacgtgtgggactgggtgtgtacagtgctatctgacttcaagacctggctcaaggccaaaataacgccccgcatacctggaatcccctttatatcttgccaggcagggtataggggagtttgggctggtgacggggtgtgtcacaccacttgctcatgcggggctcaaattgctggacacgtgaagaacgggtctatgaagatcacaggaccccggatgtgcagcaacacttggcatggaacgtttccgatcaacgccacaactaccagccctagtgtgccggtaccggcccccaactacaaacgcgctctctggcgagtttccgctgaggagtacgttgaagtagagaggcacggcgaccgtcactatgtggtgggagtcactgctgatggccttaaatgcccttgccaagttcccggacctgagttcttcactgaggtggatggcgtaaggatacatcgttatgcgccaccctgcaaacccctgcttagagatgaggtgagcttctctgtgggcctcctagagtttgttgtggggtctcagctcccttgtgagccagagcctgacgtgaccgtagtcacgtcaatgctcactgacccctcacacatcaccgcagagacagcctctcggcgcttgaagaggggatctcccccctccctggcgagttcatccgccagccagttgtcagcgccatcacttaaagccacttgcacggcgaacggagaccacccggacgccgagctgatcgaggccaatctcctatggagacaggagatgggaagcaacatcacccgggttgagtcggagaccaaagttgtcatcctcgactcgtttgatcctctggttgcagagtatgacgacagggagatatcagtgtcagcagagtgccatagaccacctaggcctaagttccctcctgctctcccgatttgggccagacctgactacaatccacctctcctacagaaatggcaaatgcccggatacgagccccccgtcgtgtctggatgtgcgttgcctccagctaaaccaacacctatcccgccaccaaggcggaagaggctcatacagctggacgagtctgctgtatcgcaagctctacaacagctggctgataaggtgtttgtggaggacactagcacctcagagccgagctccggcctcggagggtcaatagccggcccatcatctcctgacccgacaacagcagatgacacgtgttctgacgcgggatcctttagctcaatgccccccctcgagggggaacctggagacccagacttgagcactggttcctggtccactgttagtgaagaggacgatgtcgtctgttgctctatgtcatacacttggacgggggccttgatcacaccatgcgctgctgaggaggagaaattgccaataaaccctttgagcaattctctcataagacaccacaacatggtctactccacgacatcacgtagcgccggccttcgccagaagaaagtcacatttgacagactacaggtagttgaccaacactaccaagatgtcctaaaggagattaagctcagagcatcgaccgtgcacgccaggctcctatccaccgaggaggcctgttcgctcactccaccgcactcagcccgatcaaggtatgggtatggagcacgggatgttaggagccatactagcaaggccgttaaacacatcgactccgtgtgggaggacttgctagaagacaatgccaccccaatacctaccactatcatggccaagaatgaagtcttctgtgtagacccgtcaaaagggggtcgcaagcccgcgcggttaattgtttatccagacttatccgtgcgggtttgcgagaagatggcactctacgatgtgacgcagaagttgcctaagaccgtgatgggatctgcatacggtttccagtactccccctcccaacgggtagagtacttgctcaaaatgtggcgctcgaagaaaacgccaatggggttttcatatgacaccaggtgcttcgattcgaccgtcaccgagcgggatatccgaactgaagaggacatctaccaatcttgccaactagaccctaccgcgaggaaagcaatatcatccctcacagaacgcctctattgtggtggcccgatgtttaactccaaaggggaatcatgtggctatcgcagatgccgtgccagtggggtgctcactaccagtttggggaacaccctcacttgttatcttaaggcacaggcggcgtgtagggcagccaacatcaaaaattttgacatgctggtatgcggagatgatctggtggtcatttgtgagagcgccggcgtacaggaggatgtcgtagcactgagagcgtttacagacgctatgatcagatactcagctcccccaggagatgcgccacagcccacatacgaccttgagctgataacatcatgctcgtccaacgtctccgtagcccacgatggcaccggacagagatattactacctcacccgtgactgtaccactccacttgcgcgagctgcttgggagacagctcgccatacccctgtcaattcgtggttgggcaacatcatcatgtacgcccccacaatatgggtacgcatggtcctcatgacccatttcttctccatcctccaatgccaggagcagttggaggcggcacttaattttgacatgtatggggtaacctactccgtcactccactcgatctccctgcaatcattcaacgactccatggtatggcagctttttccctacatgggtactctccaactgaactcaacagggtgggagcgagcctcaggaagcttggggcgccacccttaagagcttggagacatcgagccagagctgtcagagccaaactcattgcccaaggtgggaaagcagcgatatgcggcaagtacctctttaactgggcagtgaagaccaagctcaaactcactccattggctgcggcaagccagcttgatttgtcaggctggtttgtcgcaggctacgacgggggggacatttatcacagcgtgtcccgggctcgaccccgtctgttactccttggcctactcctactcactgtaggggtaggcatctttttactccccgctcggtagacgagcggccctaaacaacactccataacattttttttttttttttt

SEQ ID NO: 782 - DNA, 9426 bp, Hepatitis C Virus
gccagcccctaatggggcgacactccaccatgatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcatcatgagcacacttccaaaaccccaaaaaagaaaccaaagaaacacaaaccgtcgcccacaggacgtcaagttcccgggtggcggtcagatcgttggtggagtctacttgctgccgcgcaggggcccccggttgggtgtgcgcgcgacgaggaagacttctgaacggtcccagcccagaggtaggcgccagcccataccaaaggcgcgccgccagacgggccgtacctgggcacagcctgggtatccctggcccctctacgggaatgagggctgcggctggatgggatggctcctgtccccccgtggctcccgcccgcactggggccctaatgacccccggcgaaggtcccgcaacttgggtaaagtcatcgatacccttacctgcggctttgccgacctcatggggtacatccctgtcgtcggtgcccccctagggggcgtcgctgcagcgctggcgcatggcgtcagggccgtagaggacgggattaactacgcaacagggaaccttcccggttgctccttttctatcttcctcttggcattgttgtcctgccttactacgcctgcctcagcagtgcactatgccaacaaatctggtatctaccatctgaccaatgattgtcccaacagcagcatcgtgtacgaggcggaagatttcatcatgcacctacctgggtgtgtcccgtgtatcaagtcaggtaacgggtctagctgttggctgccggccacgctcaccatcgcggtgccgaatgcttccatacccgtccgtgggttccgcagacatgtggatctcatggtgggcgctgctgcattttgctccgctatgtatgtgggcgacctctgtggaggcatctttttggtcggacagctcttctccttcaatccccgccgccactgggtagtccaagactgcaattgttccatctatgttggtcatattaccggccacaggatggcatgggatatgatgatgaattggtctccaactgcaaccctggtcttgtcgtatgtcatgcgaatacctcaggtgatcatggacatcttcactggcggtcactggggcattctcgcgggcatactgtattacagtatggtggccaattgggccaaagtcctctgcatcctgttcctgttcgctggtgtggatgctaccacccgcaccaccggagcacaggcggcgcgcgcgacgctgggctttacaggcttatttcagaccggggccaagcagaatatccacctgattaacaccaacgggagttggcatataaataggacagcgctgaattgcaatgacagccttaatactggcttcatggcagcgctgttttacctccataaattcaactccacaggatgtcccgagcgccttagcgcctgcaagtccatcacacaattcgcccaggggtggggacctgtcacctatgccaacgtgtccgggtcctcagaagacagaccgtactgctggcactatgcaccacggccctgtggcgtcgtctcagctcggagtgtctgcggtccggtgtattgtttcactcccagccccgtggtcgtaggcaccaccgaccgaaggggagtaccaacttacacgtggggcgagaatgagtcggatgtgtttttgttggagagcctgcgaccgccggcgggtgcttggtatggatgcacatggatgaactccacaggatacaccaagacatgtggtgctccaccatgccacattgggccacccgatcagttctgccccaccgattgcttccggaagcaccccgaagcaacctacagaaagtgtggatcaggcccctggcttacacccagatgcttggtcgattacccatacaggctgtggcattacccttgtactgtgaactacaccatccacaaggttcgcctcttcatcaatggtttggagcacaggttcgatgcagcgtgcaactggacccggggggagcgctgcgagctcgaggacagagatcggatcgaaatgagcccactcttgttctcgacgacagagctcgcgatccttccctgctcgttcactactatgccagccttgtcaactggactggtacacctgcaccagaacatagtggacatccagtacttgtacgggttggcccctgccctggtctcctgggccgtcaggtgggagtatgtggtacttgctttcctgctgttggctgacgcgcgtatttgcgcgtgcctgtggatggtgttactcatatcacaagtagaggcagcgcttgagaacctaatcgttctcaatgctgcttctgctgctagcagccaggggtggatctactgccttgttttcatttgttgtgcttggtacatcaaaggacgggttgtcccgggcgccacttacgccatattacatctatggcccctcctgctcctggttctagcgttgccccagcgggcttacgctcaagatcgggagcagggggcatccatcggggtggtcgtcatcgctgctattaccatcttcacactgactccagcatacaagacgatgcttgtgcatttcttgtggtggaatcagtatttcatagcacggagtgaggccttgattcagcagtgggtcccgagtctccgggtccggggaggtcgtgatgctgtgatcctgctcacatgcctgctacatccctctctgggttttgacatcaccaagatgcttttggcgctgttgggtccactttacctcctgcaggtgagtttgttgcgcgtgccgtactatgtgcgcgcgcacgccctgttgcgagtgtgcatccttgtgcggcgcgtcgcaggcggcaaatacattcaggccgctcttctgaagctgggggcatggaccgggacctacatctatgatcatctagcacccctttccacatgggcgagcgacggtctccgcgatctcgcggtcgccgtggagccagtcaccttctcgcctatggagaagaaaattatcacctggggtgcagacactgcagcgtgtggcgatatcctggctgggcttccggtctctgcacgcttgggtcatttgctcttccttgggccggccgatgatatgaagagcatgggctggagactacttgctcccattaccgcgtactgccaacagactcgtggattactgggaacaattgttaccagcctcaccggccgggataggaatgtggttgaaggagagatacaagtgctctccacagcgacccagtctttcctgggtaccgccatcaacggggtgatgtggacggtctaccatggtgctggatccaagacactagctggccctaagggaccagtgtgccagatgtacaccaacgtggaccaggacatggttggctggcctgcacctcccggcactaggtcgttgaccccgtgtacatgcggggccagcgacctgtatctggtaaccaggaacgctgacgtcattccggcgagacgtagaggcgacactcgtgccggcttgcttagccccagaccgctgagcacgctcaagggatcgtcgggaggacctcttatgtgtccctctgaccacgttgtcgggctcttccgtgccgctgtctgcactaggggtgtagccaaggcgctggacttcgtgcccgtggagaacatggagacaaccatgaggtctcccgtcttcactgacaactcaactccaccggcagtaccccaaacataccaagtggggtacctccatgctccaactggtagcgggaagagcacaaaggtcccggcagcgtatgcctcccaaggttacaaagtgttggtgcttaacccgtcagtggctgccacccttgggtttggcagctacatgagcacagcccacggcatcgaccctaacatcaggaccggcgtcaggactattacaacagggggtcccataacatattccacctatgggaagttcctcgctgatggcggttgctctgggggcgcgtatgatatcatcatatgtgacgagtgccactccacggatccgaccacggtcctaggaatcggcaccgtcttggatcaggcagaaacagctggtgtacgcctcaccgtcctagcgacagcaacgcctccggggtcagtgacagtcccgcacccgaacatcacagagacggccttgcccagtacgggagaggtccccttttatgggaaagccatccccctggagtgcatcaaaggtggtagacatctgatcttctgtcactcaaagaaaaagtgcgacgaattggccaagcaacttcgtacgctgggcctaaatgcagtcgcattttacagaggtgtcgacgtgtcggtgatacccacagcaggagacgtggttgtctgcgccacggacgccctcatgaccgggtacacgggcgatttcgactctgtgattgactgcaatgtcgcagtgactcagatagttgattttagcctggaccccaccttctcaattgagaccaccactgtcccacaggacgcagttgccaggagtcaacggcgtgggcggactggcagaggtaagccgggagtgtaccgatacgtctcacaaggtgaacggccgtctggcatgtttgacactgtcgttctttgcgaggcgtatgatgttgggtgcgcatggtatgaactgactccatcagagacgaccgtcagactgcgcgcctacctcaacaccccgggtctccctgtatgccaagaccacctcgagttttgggagggagtgttcaccggtatgactcatatcgatgctcatttcctatcccaaactaaacagggaggggagaatttcgcctacctcgtggcctatcaagccaccgtgtgtgcgcgagcaaaggcgccccccccctcgtgggacaccatgtggaaatgcctcatacggctcaagcctatgcttacgggcccaacacccctcttgtatagacttggtgccgttcaaaatgagattatcaccactcatccaatcaccaaatacatcatgacctgcatggcagctgacctggaggtgatcaccagcacgtgggtgcttgccggggggattgtcgcggcattggcagcctattgtctgacagtgggcagtgtcgtgatctgcggcagaatagtcacgtcagggaagcctgtgccgctacctgatagagaagttctctaccggcaattcgacgagatggaggagtgctcacggcacatcccctacctcgccgagggtcaacagattgccgaacagttcaagcagaagatccttggactgttgcagaacactgccaagcaagcagaggacctgaagccagcggttcagtccgcatggcctaagctggaacagttctggcagaaacatttgtggaattttgtcagcggggtgcagtacctagccggcttgtccaccttgccaggtaatcccgctgtggcctccctaatgtccttctccgccgccctgactagcccgctttctacgtcaacgaccctcctgctcaacatcttgggcgggtgggtggcatcccagctagcaccacccacggcatccacggcattcgttgtcagtgggcttgccggagctgcggtgggcagcattgggctgggtaaggtcatcattgacattttagcgggttatggggcaggggtttcgggagcccttgtagcttttaagatcatgagcggcgaggcccccgctgtggaggacatggtcaaccttctgcctgctcttctctcacctggtgctctggtcgtgggcgttgtctgtgctgccgttctacggcgacacgtcggcccatctgaaggggctacccagtggatgaacagactcatagctttcgcttcgcggggcaaccatgtgtctccaacacattatgtgcccgagacggatgcctcgcgggctgtgaccaccatacttagttccctcaccataaccagcctcttacgcagactccacgagtggatcagcggggactggtcagcaccatgttcctgttcttggttaaaggatgtttgggattgggtctgtacggtattgtctgacttcaagacgtggctgagagccaagcttgtgcccactctcccgggtatccccttcatctcgtgtcagcggggtttcaggggcgtttggcgaggcgatggcgtgaactacaccacctgctcatgtggtgcaaacatcacaggccacgtaaagaatgggtcaatgaagatcgtaggcccaaagatgtgcagcaatgtctggaataataggttccccatcaacgccatcacaactggccctagcgtgcccgtgccagagcccaattaccacaaagcattgtggagggtctctgcggaggactacgttgaggtcgtgcgcgttaatgaccaccactacatagtgggggccactgctgacaatctgaaatgtccatgccaggttcccgcaccagaattcttcactgaagtggatggcgtcaggctgcatagatttgcaccgccctgccgtccactcatgagggatgacataacattctcagtagggctctctacttacgtagtaggctctcagcttccctgcgaacctgagccggacgttgtgatactaacgtccatgcttactgatccagaccacattacagctgagaccgcggctcgacgcctcgcgcgagggtccccgccgtcgcttgccagttcatctgcaagccagctgtctgctccatccttgaaagccacgtgtacaacggctggcaaacaccccgatgcggagctgattgaagcgaacctgctgtggaggcaggaagtgggcggcaacataacacgggtcgagtctgagaataagatcatagtcctcgactcgtttgatcccctgatagccgagacggacgacagggagatatccgtgggtgccgaatgtttcaacccccctcggccaaagttcccgcccgcgctgccagtctgggcacggcccgattacaatccgcccttactgcagccgtggaaggctcccgactacgagcctcccctggtgcatgggtgcgctttgcctcccaagggcttgcccccagtgccaccccctcggaaaaaaagagtagtgcagctcgacgaggggtctgccaaacgggcactggctgaactagcacaaacatcattcccaccgagcacggcgaccctgagcgaagactcggggagggagacctctaccctgagctctgacatgacgcctcctcgcgaggaggctgacagggcttcagacgatggctcctacagctccatgccgcccttggaaggcgagcctggagaccccgacctcagctcgggatcgtggtccacggtcagcgaggaccatgatagtgtcgtttgctgctctatgtcatactcctggacgggggcgctcatcacaccatgcgctgccgaggaggaaaagttgcctattagtccattgagcaacgccctcattcgccaccacaacctggtgtactccaccacgtcgcgcagcgcgtccctccgccagaagaaagtgactttcgaccgcgtgcaggtggtcgaccaacactactatgatgttctcaaggagattaagaccaaggcttccggggttagcgcgaagctcctatctgttgaagaagcttgcgcgctgactccaccgcactcagcccgatctaagttcgggtatggggccaaggaggtccgaggtcttgccagcaaagccgtcaaccacatcaactccgtgtgggaggacttgctggaagacaattctacaccaatacctactaccatcatggccaagaacgaggttttctgcgtagacgctcaaaagggcggccggaaaccggcccgactcattgtgtatcctgacctaggggtgagggtatgcgaaaagagagccctttatgacgtcacgcagaaattacccatcgcagtgatgggagcagcatatggtttccaatactctcccaagcagcgagttgactaccttctcaagatgtggcgctcgaagaagacccctatggggttctcctacgacaccaggtgctttgattctacggtcaccgagcgcgacatccggactgaggaggacatctaccaatgctgccaattggatcctgttgcaaaaaaggccattacatcactcaccgagcggctgtactgtggcgggcctatgtacaactcaagaggccagtcatgcggctaccgcaggtgtcgtgctagcggcgtgctcactaccagtctgggcaacaccctaacatgctacctgaaggcgcaagcagcgtgcagagcagccaagctcaaagactttgacatgttggtctgcggagacgaccttgtggtcatttccgagagtatgggggtcgccgaggatgctagtgcactgagagctttcacggaagctatgaccaggtactcagcaccccccggtgacgacccgcagccggagtatgacctcgagctgataacatcatgctcgtcaaacgtctccgtagctcatgacggcgctgggcagagatattactacctcacacgagatccattgaccccattgtctcgggctgcctgggaaacagcccgacacactcccgttaactcatggctgggcaacatcataatgtacgcaccaaccatttgggtacgtatggtgttaatgactcatttctttgcaatactccaatcccaggaaatactccataaagcacttgacttcgacatgtacggagtcacatattccgtcactccacttgacttgccgtatatcatccagcgattgcacggcatggctgccttctcactccatggttactctccaggcgaacttaatagagtggcatcttgtctcaggaagcttggggcaccacccctaagagcctggaggcaccgagccagggcagtcagagctaagctcatcgcccaaggggggaaacacgctatatgcggtaagtacctcttcaattgggccgtgagaactaagctcaaactcactccactgcgcggcgcagccaaccttgacctgtcggggtggtttgtgtcgggcggtagcgggggggacatatttcacagcgtgtcccgggctcggccccgcaacttactcctgtgcctactcctactcaccgtaggggtaggcatctttttgctccctgctcggtaagcggggagcttaaagcaacactccattagttttttttttttttttt

SEQ ID NO: 783 - DNA, 9443 bp, Hepatitis C Virus
gccagcccctaatggggcgacactccaccatgatcactcccctgtgaggaactactgtcttcacgcagaaagcgtctagccatggcgttagtatgagtgtcgtgcagcctccaggactccccctcccgggagagccatagtagtctgcggaaccggtgagtacaccggaattgccaggatgaccgggtcctttcttggatcaacccgctcgatgcctggagatttgggcgtgcccccgcaagattgctagccgagtagtgttgggtcgcgaaaggccttgtggtactgcctgatagggtgcttgcgagtgccccgggaggtctcgtagaccgtgcaacatgagcacacttccaaaaccccaaagaaaaaccaaaagaaacactaaccgccgcccaatggacgtaaagttcccgggtggcggccagatcgttggtggagtctacttgttaccgcgcaggggccctagattgggtgtgcgcgcgacgaggaagacctccgaacggtcccaacccagaggtaggcgtcagcccataccaaaggcgcgccagtctcagggccggcactgggctcagcctggttatccctggcccctttatggtaacgagggctgcgggtgggcagggtggctcttgtctccccgtggctctcgtcccaactggggccccaatgacccccggcggaggtcacgtaacttgggtaaggtcatcgataccctaacctgtggcttcgccgacctcatggggtacattcccgtcgtgggggcgccgcttggcggtgtcgcggctgccttagcacacggtgtgagggcaatcgaggacgggatcaactacgcaacagggaatcttcctggttgctccttttctatcttcctcttggcacttctctcgtgcctcactacacctgcctcggcagtccattataggaacatctctggtatttaccatctcaccaatgactgccccaactctagcatcatctatgaggcggacaacatcatcatgcatacccccggatgcgtgccgtgtgtcaagactggcaataagtcgcagtgttgggtgccagtagcacccacccttgctgtcgcgaacgcctctgttcctataagagggttccgcagtcatgtggaccttctggttggttcagcggccgcttgctcagcactttacatcggagatttatgcggcggcgtgtttctggtgggacagctcttcactttccgacctcggcaacacactaccgtccaggagtgtaactgttccatctacaccgggcatattacggggcacaggatggcatgggacatgatgatgaactggtcccccaccgtgactttcatcacctcttcgctgctgagggtgccccagttgctccttgagattgcccttgaggggcattggggtgtcatcggtgccttgctgtactacagcatggttgcgaactgggccaaggtctttgccgtcttgctcctctttgccggggttgatgccactactcacattggtagtagtgcgtctgctacaacaaacagacttactagttttttcagccccgggtccaagcaaaatgtccagctgattaagactaatggtagttggcatatcaacaggacagcactcaattgtaatgactctctccacaccggctttatcgctggtttgctttatgctcataggttcaactcttccggttgtcctgagcgcttgagcagctgtcggccactccacgcattcgagcagggttggggtcctctcacatacgctaacatcagcggaccatccaacgataagccatattgttggcattacccgccccgaccctgtgacatcgttccagcacgatctgtctgtggcccggtatattgcttcacacccagccctgtagtagtcggtactacagaccggaaagggctccccacatacacctggggggcaaatgagtctgatgtgttcctgctgcggagcaccaggccccctcgtgggtcctggtttgggtgtacctggatgaactctacaggatttgtcaaaacttgcggtgcaccgccatgcaacaccaggccggtaggcagtggtaatgacaccttggtgtgtcctaccgactgtttccggaagcacccagaagccacatatgcgaggtgtgggtcaggcccttggctcactccccgatgtctagtgaactatccttatagattgtggcactatccttgcactgtaaactataccatccacaaggtgcggatgtttgtgggaggcattgagcatcggtttgaagctgcttgcaactggactcgtggggaacggtgcgagctggatgatagagacagggttgagatgagtccactgctgttttcaacgacacagttgtccatcctaccgtgctctttcacaaccatgcctgcgctgtcaaccggactgatccacctccaccagaacattgtagacgttcagtatctctatggagtctcttcggccgtagtgtcgtgggctgtgaagtgggaatacatcgtcttagcgttcttggtgttagctgttgcaagggtgtgcgcttgtctgtggttaatgttccttgtcggccaagcagaggcggcattagagaacctcatcgttctcaatgccacttccgccgctggtagtcagggatgggtttggggggtggtctttatctgtgccgcctggtacatccgcggcagagctgcccccataactacctatgccatattgcagttgtggcccctccttttgttagtattggctctgccccgcagggcttatgcttacaatggagaggaggcagcctcacttggaatgttggcaattgtcattatcaccatatttactcttactccagcatacaagaccctcctcataagcacgctctggtggattcaatattacatcgcacgtgcagaggccatgttatatgtttgggtgccttcgctgcaggttcgcggtggacgcgatgctgtcatactgcttacctgtttgttgcacccacaactggggtttgaggtcaccaaagccatcttagccttactaggtcctctttacatcttgcagtacagcctgcttaagacgccatatttcgtgcgagcgcacattctcctgcgcgtttgcatgttccttcgtggcgtcgcaggcggaaaatacgtccaggccgcgctattgcgcttaggtgcatggactggtacatacatctatgaccacctaactcccttatctgactgggcgtgtgacggcttacgagacctagccgtcgccgttgagcccgttgtcttctcccctatggagaagaaagtcatcacctggggtgccgacacggtcgcgtgcggcgatattatatctgggctcccagtatcagccaggagaggtaacttgattttccttggtcctgctgatgatatacgggacgggggatggcgtctccttgccccaatcacagcttatgctcagcagaccagaggcttagtgggaacaatcgtcaccagcctcacgggccgcgacaaaaatgaggtggagggggaaattcaggtcgtgtccactgccacgcaatctttccttgccactactgtcaatggagtcctctggacggtctatcatggtgccgggtcgaaaacgctggcaggtccgaaagggcccatatgccagatgtacaccaatgttgaccaggacctggtgggttggccagcgccacctggggcccgttcactcactccatgcacttgtggctcaagtgacctatatcttgtgacaaggaatgctgacgtcatccctgcaaggcgtaggggcgacacccgtgcagcacttcttagtccaagaccaataagcaccttgaaagggtcatctggaggtcctatgctgtgtccctcgggtcatgttgctgggatcttccgcgcagcagtgtgcactagaggtgtggcaaaatcccttgattttgtgccagtggagaacatgcagtccaccgcgcgttctccatccttctctgacaatacaaccccaccagcggtgccacagacataccaagtggggtacctccacgcgcctacgggcagcggtaaaagcactaaagtcccagcggcatatgctgctcagggctataaggttctagtgcttaacccctctgtagcggccacccttgggttcgggtcatacatgtctactgcccacggtatagaccctaacatccgtactggggttaggactatcaccacgggcggtgcaattacctactctacatatggcaagtttctcgcggatggcggctgctccggcggcgcttatgacatcattatctgcgatgagtgccattcaacagatcctaccacagtcttgggtataggcaccgtgttggatcaggcggagacggccggcgtcagactcacagtgctcgcaacggccactccccctggctcagtaacggtccctcatccaaacatcaccgaggtagccttgtcatctaccggtgaggtgcctttctacgggaaggcaatcccccttgagtatatcaaggggggtagacacctgattttctgccactctaaaaagaagtgcgacgagcttgccaagcagctcacatctcttggccttaatgctgtcgcattctacaggggcgttgacgtgtctgtgattccaacttcaggcgatgtcgtcgtgtgtgctaccgacgcccttatgactggctatacaggagactttgactcggtgattgactgtaatgtttctgtcactcaggttgttgatttcagccttgacccaacttttaccatagagaccaccactatgccccaggacgctgtttcgcgaagtcaaaggaggggcagaacaggtagggggaagcatggggtttataggtacgtctcgcagggcgaacggccgtcgggtatcttcgacaccgttgttctgtgcgaggcgtacgacacaggttgcgcatggtatgaactgactccatctgagacgactgtgagactacgtgcctacctgaatactccggggctccccgtctgtcaagatcatctggaattttgggagggcgtctttaccgggttaacccatatcgatgcccacctcctttcacagacgaagcaggggggagaaaatttcgcgtacctcgtagcctaccaggctactgtatgcgcgagagccaaagctccccccccctcctgggatacaatgtggaaatgtcttatccgcctcaagcccatgcttactgggcctactcccttgctgtataggctcggggcggtgcaaaatgagatcactacgacacacccgatcacaaagtacatcatgacctgcatgtctgcggacttggaagttataaccagtacctgggttctggtgggtggggtcctcgcggcattagcagcctactgcctgtcagtgggctgcgtggtggtgtgcggtaggatctccactactggaaagccagtgctcattcctgatcgggaagtgctctatcaacaattcgatgagatggaggagtgttccagacacatcccctacctcgtcgaaggtcaacaccttgcagagcagttcaaacaaaaagtccttggcctcatccagaccaccacccgacaagccgaggagatcgagcctgtcgtccactctgcttggcccaaacttgaacagttctggcagaagcatttgtggaactttgtgagtggcatacaatatttggctggcctatccacgctaccaggcaacccggcggtagcttcactgatgtcattctcagcctccttgactagcccactgtcaacatctacaaccctcctactgaatatcttaggggggtgggttgcttcgcaactagcaaaccccactgcttctactgcttttgtagtaagcggtttggcaggcgccacagtcggcagtattggccttgggagagtcctagtggacataattgccggctatggagcgggtgtgtcaggagcgctcgtcgcctttaaaatcatgagcggcgagaccccatctgctgaggatatggtcaacttgcttccagcgttgttatcgcctggcgcactggtggtgggtgtggtgtgtgcggctatattgagacgccacgccgggcccgctgagggggccacgcaatggatgaaccgactgatagcgtttgcctccagaggtaatcatgtgtcgcccactcactacgtgcctgagactgacacctctcggcaggtcatggccatactcagttcccttactgtgaccagcctcctacggaagttgcatgagtggatcaactctgattggtctactccatgctctgggtcatggttacgagacatctgggactgggtgtgtactgtcctctctgacttcaaagtctggctcaaatccaaacttgtgccagcactgcctggagtacctttcctctcttgccagcggggcttccgtggcgtatggagaggtgacggtatctgccgcaccacatgcccatgcggtgccgacatagttggccacgtcaagaatgggtccatgaggatttcggggtcgcggtggtgtagtaacatctggcatggcaccttccccatcaacgcgacaacgactggtcctagcgtgcccatcccagagcccaactacaagagggctctttggcgggtgtccgcggaggaatatgtcgaagtggcgagggtgggcgacagccattttgtagtgggtgccaccaaccaagacctcaaatgtccttgccaggtaccagccccagaattcttcactgaagtagacggcgtacggttgcaccgtttcgcacctgcctgcaagcctctcctgagagatgagatctccttcttagtaggcctcaactcctatgcaattgggtcccaattaccatgtgagcccgagccggacgtgacagtggttacatcaatgctagtcgacccatcgcacttaactgcagaggctgctgctcgccgccttgcgcgtgggtcccccccgtcctgtgctagctcattagcaagccagctctcggccccgtcgttgaaagcaacgtgtactacacactgtgcacatcctgatgcggacctgattgaagctaacttgctatggaggcaggaagtaggaggcaatatcacccgggtggagtctgagaacaaagtcatcgttctcgactcttttgaccctctggtgcctgaatatgatgacagagaaccatccgtgcctgcggagtgccataggccaaacaggcctaaatttccaccagcacttccgatttgggcgcggcctgactacaaccctcctctgcttgagacttggaagaaaccagactatgccccaccgctggttcacgggtgcgctttgccctctccagtgcaacctccagttccaccgccaaggaggaaaagcgtggtgcacctggatgattccaccgtagcgacagcgctggccgaattggccgagaagtccttcccgacgcagccggcctccacacctgactcggactcaggtcacccgaccaccagcaagagctcagaccaagcagatgagggggaagacaccccttctgaagcagggtcttacagctctatgccaccgcttgagggtgaaccaggtgacccggaccttagttcggggtcatggtctacagtcagtgaggaaggcgacagcgtcgtgtgttgttccatgtcttacagctggacaggagcccttgtcacaccatgcgcagccgaagaggagaagctgcctatcaatcctctaagcaattccctcattcgacaccacaatttggtgtactccactacaactcggagtgctgcgatgcggcaaaagaaggtcactttcgaccgattacagattctggaccaacactacaacaatgtagtgaaggaggtgaaactccgggcctcaggggtgacggccaaactcctctcagttgaggaagcatgtagcctcactcctccgcactcagctcgatcgaagtttgggtacggagcaaaggacgtccggagtcatactagcaaggccattaaccacatcaactccgtgtgggaggacttgttagaagacaaccaaacaccaattcctacaaccatcatggcgaaaaatgaagtgttttgcgctgacgtttcgaagggagggcgcaagcccgctcgcctgattgtatacccggacctcggggttcgggtgtgcgaaaagagagctctctacgacgtcacgcgcaaactaccaacagccatcatgggagatgcctacggctttcaatactcacccaaacaacgggtagaccaactgctcaagatgtggcgttccaagaagactccaatggggttctcctacgacaccaggtgctttgactcaacagttactgagcacgacatcaagactgagcgggatgtctatctatcctgtaagttggaccctgtggctaggaaagccatagagtctctcaccgagaggctctatattggcggccctatgtacaactctcggggccaactatgcgggacccgcaggtgccgcgcaagcggggtgctcaccaccagcttgggtaacaccatgacctgctttataaaagctgaggcagcctgccgagcggcaggccttaccaactatgacatgttggtctgcggagacgacttagtagtcattgctgagagcgccggagttcaggaggatgcgtctaacctgcgagctttcacggaagctatgaccaggtactcagctcctcctggcgatgaaccgcatccagcatatgacttggagctgataacatcttgttcctccaacgtctccgtggcccacgaccacactggacagagatattactacctcacacgtgacccaaccacaccactgtcacgagctgcgtgggagacagctcggcacactccagtaaattcctggttggggaacataatcatgtacgctcctgcaatctgggtacgtatggtgctcatgacccacttcttccaaatactccaagcgcaggagcaactagataaggtgctagacttcgatatgtacggagtcacatattcagttagtccactccaactcccagccatcattcaaagactccatggtatggccgcgttttcactccatgggtactctccaactgaactcaatcgggtgggagcatgcctcagaaagcttggggcccctccattgagagcgtggagacatcgagcccgcgcggtcagagctaagcttattgcccaagggggaggcgctgcaatttgcggcaagtacctcttcaactgggcagtaaagaccaagctcaaactcactccaatacctgatgcagccaggcttgacttgtcaggctggttcatatcaggcttcagcgggggggacatttatcacagcgtgtcccgggctcgaccccgcattttcctcctgtgcctactcctactctccgtaggggtaggcatctttttactacccgctcggtagacgggtagcttaacactccatttctgtttttttttttttttttttttttttttt

SEQ ID NO: 784 - DNA, 9431 bp, Hepatitis C Virus
gccagcccctaatggggcgacactccaccatgatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggatgaccgggtcctttcttggattaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcatcatgagcacacttccaaaaccccaaagaaaaaccaaaagaaacactaaccgtcgccctatggacgtcaagttcccgggcggcggccagatcgttggtggagtttacttgttgccgcgcaggggccctcgtttgggtgtgcgcgcgacgaggaagacttccgaacggtcccagcctagaggcaggcgccagcccataccaaaggcgcgccagccgataggccgtagctggggtcaacccggctacccttggcccctttatggcaacgagggctgcggatgggcgggatggctcctgtccccccgcggatctcggcctaattggggcccaaatgacccccggcgaaggtctcgcaacttgggtaaggtcatcgataccctcacgtgcggcctagccgatctcatggggtacatccctgtcctaggggggccgcttggcggcgttgcggctgccctggcgcatggcgttagggcaatcgaggacggggtcaattatgcaacagggaatcttcctggttgctctttttctatcttcctcttggcactgttatcgtgccttactacaccagcctcagcaattcaagtcaggaatgcctctgggatctaccaccttaccaatgactgctcgaacaatagcatcgtttttgaggcggagaccattatactgcatcttccaggctgtgttccatgtatcaaggtggggaatgggtcgcgttgttggctctctgtctcgcctaccttggccgtccccaactcatcagtaccaatccacgggtttcgccggcacgtagatctcctcgtcggggccgcggcattttgttcggccatgtacattggagatctttgtggtagcgtattcttggtagggcagctgtttactttcaggcctaagcaccatcaggtcacccaggattgtaactgctctatatatgctggccacatcacgggacacaggatggcatgggacatgatgctcaactggtcgcccacggtgagctatgtggtttctagtgccctgagagtaccccagttgctcttagaggtcatcacgggggcacattggggcgtcttgggggcgctgctctacttcagcatggtggcgaactgggcgaaggtcatcgcggtcctcttcctctttgcaggagctgatgccacgacctacacgggcagcgccgtgagtagcaccaccggggccttcgtcagtcttttctcccctggccccacccagaatctgcagcttgttaatagcaacggcagttggcacatcaaccgcacggcgctgaattgcaatgactctctgcagacgggctttattgcaggactgtttgcccgctacaagttcaattctacggggtgcccggaacggatgagtaaatgtagaccattgcactcgttcgagcagggctgggggcctatctcatatgtcaatatctcaggctcttctgaggataagccttactgttggcattacgcccccagaccatgtggcatcgttccagcgcggaacgtctgtgggcctgtctactgcttcacacctagccccgtggtagtgggaactaccgatcagagaggtatccccacttacacctggggagaaaatgtgtccgacgtgttcctactacacagcgccagacctcctctgggggcctggttcggttgcacgtggatgaactcgtcggggtttgtcaagacgtgtggggctccaccttgtagaataaagcccaccatcaacgagaccgacctggtgtgccccactgattgcttccggaagcatccagacgcctcatttgtgaagtgcgggtcgggtccctggctcactccccgctgcatggtagactacccctaccggctgtggcactatccttgcaccgtgaattttaccatccataaggtccgggtctttgtcggcggcgtcgagcataggttcaacgctgcttgcaactggacccgaggcgatcggtgcgagcttgatgacagagacaggttcgagatgagcccgctcttgttctccaccacccaactggccattttgccctgctccttcacaaccatgcctgctttatcaaccggcctgatccacctgcatcagaacattgtggacatacagtatctctatggagtatccacggcagttgtgtcgtgggcaatgaagtgggaatacgtagtccttgcatttctggtcctggccgatgctcgcgtttgtgcgtgcttatggttgatgttcctagttggccaggcggaagccgcgttggagaacgttattgtccttaacgcggcctccgcggccagctgtcaggggttgctatggggcctaatcttcatctgttgcgcttggcacgtgcggggccgggctgtccccgtgaccacctacgcgttactccagctttggccgctcttgttactaatactagccttaccccggagggcatatgcctttgattcagagcaggcggcatcagcagggctcttggtccttggcctaatcaccatctttactcttactccagcttataaacagcttctcataagcatgctctggtggatacagtatttcattgcactcactgaggcccaacttcatcagtgggtaccatccctgctggttaggggcggacgtgacgccgtcatcctattggcttgcctattccacccgcagttagggtttgaggtaactaagatcttactggccttgctcggcccactctacctactgcagtacagcctgcttaagactccatatttcgtccgcgcgcatatcctcttgcgtgcatgcatgttcttccgtggcatggctcgtggcaggtatgctcaagccatactgctgcgaattggagcatggactggaacatacatctatgaccatcttgccccccttagcgactgggcttgcgacggcttgcgagatctagctgtcgctgttgagcccgtcgtcttctccccaatggagaagaaggtcatcacatggggtgctgataccgctgcctgcggcgacatcatcgccggtcttcctgtcgctgctaggcgggggaatttattgttcctcggcccagccgatgatgtcaaggggaaggggtggagacttcttgctccgatcactgcatatgctcaacagactcggggcatagtgggcaccatcgtcactagcctcaccggccgagacaagaatgaagtggagggggagattcaagtcgtttccacggccacacaatctttcctcgccactgccgtcaacggggtcctgtggactgtatattatggtgctggctctaagacacttgctggccccaaaggacccgtgtgccaaatgtacactaatgttgaccaagatcttgtaggttggcccgcccctgcgggggcgcggtccctgacaccgtgctcctgtggctcaagtgacctctatctggtcacgagaaatgctgatgttatcccagcccgacgcaggggagataaccgcgctgctcttctcagcccacgacccataagcaccttaaaggggtcgtctggcggtcccatgctatgcccttcgggccacgtcgcggggattttccgcgcggctgtgtgcaccaggggcgtagccaaatcactggacttcgcgcctgtggagagcatgcaatcctcccagcggtcaccatctttctctgacaacacttctcctcctgccgtgccacaaacctatcaggtggggtacctccacgctcctacagggagcgggaagagcaccaaggtccccgctgcttacgcagctcaagggtacaaggtcctggtgctcaatccatcggtcgctgccaccctaggcttcggtagttacatgtctacatcacatggcatagatcccaacatccgtaccggggtaaggactatcaccaccggtggggcaatcacctactctacctatggtaagttcctcgctgacggcgggtgctctggcggagcctatgatgtcatcatctgtgatgagtgtcactcgaccgatcctaccacggtctcgggaatagggaccgttcttgaccaggcggaaactagcggagtgagactgacggtcctcgcgaccgccactccgcctggttcagtcacagtcccccatccaaacataacggagtcagcgttacctaccacgggtgagatccctttctacgggaaggcggttcccctcgaatacatcaaagggggcaggcacctcatattttgtcatcccaagaagaagtgtgacgagctcgccaaacagctcgtgtcattaggcctgaacgccgtggcattttatcgaggtgtggacgtgtcggtcattcccacctcgggcgatgtagtggtttgtgccaccgatgccctcatgaccggctacacaggtgactttgactccgtaatagactgtaatgttactgtcacacaggtcgtggactttagtctcgacccgacatttacaatagagaccaccactgtcccacaggatgctgtttcccgtagccagagaagaggaaggaccggtaggggaaagcatggggtgtacaggtacgtctcccagggagaacggccgtcgggtatgttcgacagtgtcatcctctgcgaggcgtacgacacagggtgcgcgtggtatgaactgacaccagcggagaccaccgttcggctgcgcgcctacctaaataccccagggcttccggtctgccaagaccatcttgagttttgggagggggtctttacaggcctgactcacattgatgctcatttcctctcacagacgaaacaggcagaggaaaacttcgcatatctcgtagcctatcaagctacggtctgtgccagagctaaggccccccccccctcctgggacacgatgtggaagtgcctaatcaggctcaagcctatgctcacgggtcccactcccttgttgtacaggcttgggccagtccaaaatgaggttgtcaccactcacccaatcactaaatacatcatgacttgcatgtctgcagaccttgaggtgatcacgagtacctgggtgttggtggggggggtcgtcgccgccctagcagcctattgcttgtccgtaggctgcgtagtgatatgcggcaggatctccaccagcggcaagccggtgctcattcctgacagggaagtgttatatcaacagttcgacgagatggaggagtgttctaggcacatcccctatctcgctgaaggtcatctcatcgctgagcagttcaaacaaaaagtccttggcctcatacaatccacaagcaaacaagcagaggaactaaagccggcagtccacgcggcctggccgaagcttgaacagttttggcaaaagcagttgtggaatttcgtcagcggcatccaatacctagcaggcctgtcaaccctgcccggcaacccggctattgcctctctcatgtctttctctgcctctctcactagcccgctgtcgacgcatcaaaccctcctattgaacatcttaggagggtgggtggcgtcacaactcgccaatcctacggcttccacagccttcgtggtcagcggcctcgcaggggctgctgtgggaagcattggcttaggacgggtgatcgtggacgtcttagccggatacggtgctggcgtgtccggggcacttgtcgcatttaaaatcatgtgcggcgagaccccgtccgcagaggacatggtcaacctcctcccagccctgttgtcgcctggagccctagtggtaggtgtggtatgcgctgcaatattgcggcgccatgctggacctagtgagggagcaactcagtggatgaacaggctcatagcctttgcctctagaggcaatcatgtgtctccaacacattacgtccctgagacagacacctctcgccaaatcatgactatactctcttccctgactgtaaccagccttctacgcaaattgcacgagtggatcaacactgattggtccacgccgtgctccagctcgtggttgcgcgacatttgggattgggtgtgtgaggtgctctctgatttcaagacctggcttaaagcaaagctcgttccagcgctacctggagtcccctttctctcgtgccaacgagggttccgcgggacgtggcggggggacggcatttgccataccacgtgcccatgcgggtcagagatcaccggacacgtcaaaaatgggaccatgaagatttccgggcctcgttggtgcagcaacgtctcgcaccggacctttcccatcaatgctaccacgacaggccctagcgtgcctatccccgagcccaactacaccagggctctttggagggtttctgctgaggagtatgtcgaggttaagagagtgggggatagccacttcgtggtaggtgccactacggacaatctaaagtgtccgtgccaggttcctgctcccgagtttttcactgaggtcgatggggtgagactacatcggtacgcgccccgctgcaaaccccttttgagggacgaggtttccttctctgtaggactatcgtcttacgcagttggatcacaactcccgtgcgaaccggaaccagacgtcacggttgtaacgtccatgctcatcgacccctcacatgtaactgctgaggctgcggcacgacgcttagctcgcgggtcgccgccctctcttgccagctcatcggcaagccagctctcagcgccctcattgaaggctacatgcactatgcatggagcccatcctgatgctgagctcattgaagctaacttgctatggaggcaggagatgggtggtaacatcacccgcgtggagtccgagaataaggtcgttattcttgattcctttgatcccctcgtcccagaattcgaggagagggaaatgtccgtgcccgctgaatgccatcggcctcgcaggcccaaattcccaccagcgctgcctatatgggctacgccaggttacaatccacctgtactcgagacttggaaatcgccgacctatgaaccaccagtggttcatggctgtgctttgcccccatctggtcctcctcctattcccccaccaaggaggaagaaagtggtacagctcgattcttccaacgtttcggccgcccttgcgcagttggctgcaaagacttttgagacgcccagttcccctactacagggtatgggtcggatcaacctgatcatagcactgagtcttcagaacacgacagggatgatggggttgcatctgaagctgaatcctacagctctatgccccccctcgagggcgaaccaggagatcccgatcttagttcaggatcctggtccacggtcagcgaggagggagacagtgtagtatgctgttcatactcatacagctggacaggggcgctagtcacaccatgcgccgctgaagaggaaaaactgcccatcaatcctctaagcaactccctcatccgtcaccataacttggtatattccacttcatctagaagcgcggcgacccggcagaagaaggtgacatttgaccgagtgcaacttctggaccagcactattatgatactgtaaaggagataaagctccgggcgtcccacgtgaaggcccaacttctttcaacggaagaggcctgtgacttaacaccaccccattctgcccgatccaaatttgggtacggggcaaaggacgttcggagccatgccagcaaggccattaaccacatcaactccgtgtgggcggacttgctggaggacactcaaacaccaataccaacaacaatcatggcaaaaaacgaggttttctgcgtagacgcatcgaagggcggacgtaagtcggctcggctaatcgtatacccggacctaggggtccgggtgtgtgagaagcgagcgctttttgatgtcactcgtaagctgcctacagctatcatgggagatgcttatggctttcaatactccccacagcaacgagtggaccgcctgctcaagatgtggcgctccaagaaaaccccaatggggttctcttatgacaccagatgctttgactcaacagtcacggagcgcgatatacgcacagaacaagacatttacttatcctgccagcttgacccagaggcccggaaagtcatagaatctctcactgagagactttacgtcgggggccctatgtacaactcaaagggccagctctgtggtcaacgccgatgccgggcaagcggggtactccccacaagcatgggtaacactgtcacatgcttcctgaaggcaaccgccgcttgtcgggcagccggcttcacagattatgacatgttggtctgcggagacgatttggttgtcgtaactgaaagtgctggagtgaacgaggatatcgctaacctgcgagccttcacggaggctatgaccaggtattcagcgacccccggagatgagcccagccctacatacgacctagagctgataacatcatgctcatccaatgtttccgtggcccacgatggagacggcaggagatattactacctcactcgtgaccctgtcaccccactggcgagggcggcgtgggagaccgctcgtcacactcctgtgaattcatggttagggaacatcattatgtatgctcccaccatttgggtacgtatggtactcatgacccatttctttcaaatactccaagcacaggagactttagatagggcacttgacttcgacatctacggagtcacgtattcaatcactccgcttgatctcccagtgatcattcaaagactccacggcatggccgcattctcactccatgggtactctcccgacgaactcaatcgggtggcatcatgcctcagaaaacttggggctcctcccttgagagcctggagacaccgagcccgagcggtcagggccaagcttattgcccaaggagggaaagccgcagtatgtggcaagtacctcttcaattgggcgataaagaccaaacttagactcactccattgcgtggtgcatccgctctcgacttgtcggggtggtttacatcaggctacggcgggggggacgtatatcacagcgcgtcccgggctcgaccccgctttttactcctgtgcctactcctactgtccgtaggggtaggcatcttcctgctcccagcccggtaggctgagagctaaacactacactccgtttttttttttttttttttt

SEQ ID NO: 785 - DNA, 9535 bp, Hepatitis C Virus
gccagcccccgattgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggattaacccgctcaatgcctggagatttgggcgtgcccccgcaagaccgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgttaagttcccgggcggtggtcagatcgttggtggagtttacctgttgccacgcaggggccccaggttgggtgtgcgcgcgactaggaagacttccgagcggtcgcaacctcgtggaaggcgacagcctatccccaaggctcgccggcccgagggcaggacctgggctcagcccgggtacccttggcccctctatggtaacgagggcatggggtgggcaggatggctcctgtcaccccgcggctctcggcctaattggggccctacagacccccggcgtaggtcgcgtaatttgggtaaggtcatcgataccctcacatgcggcttcgccgacctcatggggtacattccgctcgtcggcgcccctctaggaggcgttgccagggccctggcacatggtgtccgggttctggaggacggcgtgaactatgcaacagggaatttgcccggttgctctttctctatcttcctcttggctctgttgtcttgtttaaccaccccagcttccgcttatgaagtgcgcaacgtgtccgggatataccatgtcacgaacgactgctccaactcaagcattgtgtatgaggcagcggacatcatcatgcatacccccgggtgcgtgccctgcgttcgggagaagaacatctcccgttgctgggtagcgcttacccccacgctcgcagccaggaacatcagcgtccccactgcgacaatacgacgccacgtcgacttgctcgttgggacggctgccttttgctctgccatgtacgtgggggatctctgcggatctgttttcctcgtctcccagctgttcaccttctcacctcgctggcatgagactgtacaggactgcaattgctcactctatcctggccacgtatcaggtcatcgcatggcttgggatatgatgatgaactggtcgcctacagcagccctagtggtgtcacagttgctccggatcccacaagctgtcgtggacatggtggcgggggcccattggggagtcctggcgggccttgcctactattccatgatagggaactgggctaaggttttgattgtgatgctgctctttgccggcgctgacgggaccacccacgtgacagggggggtgcaagcccacggtgcctacgggcttgcatccctctttaacgttgggccccatcagaaaatccagcttgtaaatacaaatggcagctggcacatcaacaggactgccttaaactgcaatgacaccctccagaccggattccttgccgcgctgttctacaaacacaggttcaacgcgtccggatgcccagagcgtatggccagctgccgtcccattgacaagttcgctcagggatggggtcccatcacttatgctgagcctgacaggctggaccagaggccttattgctggcactacccaccccgaccgtgtggtatcgtacccgcgttggaggtgtgtggtccagtgtattgcttcaccccaagccctgttgtggtggggacgaccgatcgtttcggcgtccctacctatagctggggggagaatgagacggatgtgctactcctcaacaacacgcggcctccgcaaggcaattggttcggctgtacatggatgaatagcactgggtacaccaagacgtgtgggggccccccgtgtaacatcgggggggtcggcaacaacaccttgacctgccctacggattgcttccggaagcatcccgaggccacttacacaaaatgtggttcagggccttggttgacacctaggtgcttagttcactacccctataggctctggcactacccctgcactgttaactttaccatcttcaaggttaggatgtatgtggggggcatcgagcacaggctcgatgctgcatgcaattggactcgaggagagcgttgtgacttggaggacagggacagatcagaactcagcccgctgttgctgtctacaacagagtggcagatactgccctgttccttcaccaccctaccggccctgtccactggtttaatccatctccaccggaacatcgtggacgtgcaatatctgtacggcatagggtcagcggttgtctcctttgcaatcaaatgggaatatgtcctgttgcttttcctcctcctggcggacgcgcgcgtctgtgcctgcttgtggatgatgctgctgatagcccaggctgaggccgccttagagaacttggtggtcctcaatgcggcgtccgtggccggagcgcatggcattctgtccttccttgtgttcttttgtgccgcctggtgtattaagggcaggctggtccccggggcggcatacgctttctatggcgtatggccgctgctcctgctcctgttggcgttaccgccacgtgctttcgccatggaccgggagatggctgcatcatgtggaggcgcagtttttgtaggtctggcattgctgactttgtcgccacactacaaagtgttcctcgctaggctcatgtggcggttacaatatcttatcaccagggctgaggcgcacttgcagatatgggtcccccctctcaacatcaggggaggccgcgatgccatcatcctcctcatgtgcgcggtccacccagagctaatctttgacatcaccaaactcctgctcgccatactcggtccgctcatggtgctccaggctggcataactagagtgccgtactttgtgcgcgctcaagggctcattcgtgcatgcatgttagtgcggaaagtcgccgggggtcattatgtccaaatggccttcgtgaagctggccgcactgacaggcacgtacgtttatgaccatcttgccccactgcaacattgggcccacacgggcctacgagaccttgcggtggcagtagagcctgttgtcttctctgacatggaaaccaagatcatcacctggggggcagataccgcggcttgtggggacatcatcttgggtctgcccgtctccgcccggaggggaagggagatactcctgggaccagccgatagtcttgaggggcaggggtggcgactcctcgcgcccatcacggcttactcccaacagacacggggcctactcggttgcatcatcactagcctcacaggtcgggacaagaaccaggttgagggggaggttcaagtggtgtccaccgcaacacaatctttcctggcgacttgcatcaacggcgtgtgttggactgttttccacggtgctggctcaaaaaccctagccggccccaaaggtccaattacccaaatgtacaccaatgtagaccaggacctcgttggctggcaggccccccccggggcacgttctatgacgccatgcacctgcggcagctcggacctttacttggttacgagacatgctgatgtcatcccggtgcgccggcggggcgacagcagggggagccttctctccccccggcccgtctcctacttgaagggttcttcgggtggtccgctgccctgcccttcagggcatgccgtgggcatcttccgggccgctgtgtgcacccggggggttgcgaaggcagtggacttcatacccgtcgagtctatggaaaccaccatgcgggctccggtcttcacagacaactcatcccccccggccgtaccgcagacattccaagtggcccatctacacgcccccactggcagcggcaagagcaccaaggtgccggctgcatatgcagcccaagggtacaaggtactcgtcctgaacccatctgttgctgccaccctagggtttggggcgtatatgtctaaggcatatggcactgaccctaacatcagaactggggtgaggaccatcaccaccggcgctcccattacgtattccacctatggcaagttccttgccgacggtggttgctccgggggtgcctatgacatcataatgtgtgatgagtgccactcaactgactcgactaccatcttaggcatcggcacagccctggatcaagcggagacggctggagcgcggctcgtcgtgctcgccaccgctacgcctccgggatcggtcaccgtgccacaccccaatatcgaggaggtggccctgtccaacacgggagagatccccttctatggcaaagccatccccatcgaggtcatcaaggggggaaggcatctcattttctgccattccaagaagaagtgtgacgagctcgccgcaaagctgtcaaccctcggactcaacgctgtggcgtattaccgaggtcttgatgtgtccgtcataccgaccagcggagatgtcgttgtcgtggcaacggacgctctaatgacgggctttaccggcgatttcgactcagtgatcgactgtaacacatgtgtcactcagacagtcgacttcagcctggaccccaccttcaccattgaaacgacgaccgtgccccaagacgcggtatcgcgctcgcagcggcgaggtaggactggcaggggtaggggaggcatctacaggtttgtgactccaggggaacggccctcgggcatgttcgattcctcggtcctgtgtgagtgctatgacgcgggctgtgcgtggtacgagctcacgcccgccgagacctcggttaggttgcgggcgtacctaaatacaccagggttgcccgtctgccaggaccatctggagttctgggagagtgtcttcacaggcctcacccatatagatgcccatttcttgtcccagactaagcaggcaggagacaacttcccctacctggtggcataccaggctacagtgtgcgccagggctcaggcttcacctccatcgtgggatcaaatgtggaagtgtctcacacggctaaaacctacactgcacgggccaacacccttgctgtataggctaggagccgtccaaaatgaggtcaccctcacacaccccataaccaaatacatcatggcatgtatgtcggctgacctggaggtcgtcaccagcacttgggtgttggtaggcggagtccttgcagctctggccgcgtattgcctgacaacaggcagcgtggtcattgtgggcaggatcatcttgtccgggaagccggctgtcattcccgatagggaggtcctttaccgggagttcgatgagatggaagagtgcgcctcacacctcccttacatcgaacagggaatgcagctcgccgagcaattcaaacagaaagcgctcgggctgctgcaaacagccacgaaacaagcggaggctgctgctcccgtgatggagtccaagtggcgagccctggagaccttttgggcgaagcacatgtggaatttcatcagcgggatacaatacttggcaggcttatccactctgcctgggaaccccgcgatagcatcactgatggcattcacagcctccatcactagcccgctcaccacccaaagtaccctcctatttaacatcttggggggatgggtcgctgctcaactcgctccccccagcgctgcttcggcttttgtgggcgccggcattgtcggtgcggctgttggcagcataggccttgggaaggtgcttgtggacatcctggcgggctatggggcaggggtggctggcgcactcgtagcttttaagatcatgagcggcgagatgcccgccaccgaggacctagttaatttgctccctgccatcctctctcctggtgccctagttgtcggggtcgtgtgcgcagcaatactgcgccggcacgtgggcccgggagagggggctgtgcagtggatgaaccggctgatagcgttcgcctcgcggggtaaccacgtctcccccacgcactatgtgcctgagagcgacgctgcagcgcgtgtcactcagatcctttccagccttactatcactcagctgctgaaaaggcttcaccagtggattaatgaggactgctccacgccatgctccggctcgtggctgagggatatttgggactggatatgcacggtgttgactgactttaagacctggctcaagtccaagctcatgccgcggttaccgggagtccctttcttctcttgccagcgcggctacaggggagtttggcggggggacggcatcatgcacaccacctgcccatgtggagcacagatcaccggacatgtcaagaacggctccatgaggatcgttgggcctaaaacctgcagtaacacgtggcatgggacattccccatcaacgcatacaccacgggcccctgcacaccctccccggcgccaaactattccagggcgctgtggagagtggccgctgaggagtacgtggaggttacgcgggtgggggatttccactacgtgacaggcatgaccactgacaacgtgaagtgtccgtgccaggttccggcccccgaattctttacggaggtggatggagtgcagctgcacaggtacgctccggcgtgcaaacccctcctacgggatgaggttacattccaggtcgggctcaaccaatacctggttgggtcacagctcccatgcgagcccgaaccggatgtagcggtgctcacttccatgctcaccgacccctcccacatcacagcagaagcggccaagcgtaggctggccagggggtctcccccctccttggccagctcttcagctagccaactgtctgcgccttccttaaaggcgacatgcactacccaccacgactccccggatgctgacctcatcgaggccaacctcttgtggcggcaagagatgggcgggaacatcacccgcgtggagtcagagaacaaggtagtgattttggactctttcgacccgcttcatgcggaggaggatgagagggaggtatccgttgcggcggagatcctgcggaaatccaggaagttccccccagcgttgcccatatgggcacgcccggattacaaccctccactgctagagtcctggaaggacccggactacgtccctccggtggtacacgggtgcccattgccgcctaccaaggcccccccaataccacctccacggagaaagcggacggttgtcttgacagagtccaccgtgtcttctgccttggcggagctcgctactaagaccttcggcagctccggatcgtcggctgccgatagcggcacggcgactgcccctcctgaccaggcctccgacgacggcgacaagggatccgacgttgagtcatactcctccatgcccccccttgagggggagccgggggaccccgatctcagcgacgggtcttggtctaccgtgagcgaggaggctagtgaggacgtcgtctgctgctcaatgtcttacacatggacaggcgccctgatcacgccatgcgctgcagaagaaagcaagttgcccattaacccattgagcaactccttgctgcgtcaccataatatggtttacgccacaacatcccgtagcgcaggcctgcggcagaagaaggtcacctttgacaggctgcaagtcctggacgaccactaccgggacgtgcttaaggagatgaaggcgaaggcgtccacagttaaggctaaacttctatctatagaagaagcctgcaagctgacgcccccacattcggccaaatccaaatatggctatggggcaaaggacgtccggaacctatccagcagggccgtcaaccacatccgctccgtgtgggaggacctgctggaagacactgagacaccaattgacaccaccatcatggcaaaaagtgaggtattctgtgtccaaccagagaaaggaggccgcaagccagctcgccttatcgtattcccagacctgggagttcgtgtatgcgagaagatggccctctacgacgtggtctccaccctacctcaggccgtgatgggctcctcatacggattccagtactctcctaaacagcgggttgagttcctggtaaatacctggaaatcaaagaaatgccctatgggcttctcatatgacacccgctgttttgactcaacggtcactgagaatgacatccgtgttgaggagtcaatttaccaatgctgtgacttggcccccgaagccaaattggccataaggtcgctcacagagcggctctatatcgggggtcccctgactaattcaaaagggcagaactgcggttatcgccggtgccgcgcgagcggcgtgctgacgactagctgcggtaataccctcacatgttacttgaaagcctctgcggcctgtcgagctgcgaagctccaggactgcacgatgctcgtgaacggagacgaccttgtcgttatctgtgaaagcgcgggaacccaagaggatgcggcgagcctacgagtcttcacggaggctatgactagatactctgccccccccggggacccgcctcaaccagaatacgacttggagttgataacatcatgctcctccaatgtgtcggtcgcacacgatgcatctggtaaaagggtgtactacctcacccgtgaccccaccacccccatcgcgcgggctgcgtgggagacagctagacacactccagttaactcctggctaggcaatatcatcatgtatgcgcccaccttatgggcaaggatgattctgatgactcacttcttctccatccttctagctcaggagcagcttgaaaaagccctggattgtcagatctacggggcctgttactccattgagccacttgacctacctcagatcattgaacgactccatggtcttagcgcattttcactccatagttactctccaggtgagatcaatagggtggcttcatgcctcaggaaacttggggtcccacctttgcgagtctggagacatcgggccagaggtgtccgcgctaagctactgtcccagggggggagggccgccacttgtggcaagtacctcttcaactgggcagtaaggaccaagctcaaactcactccaatcccggctgcgtcccggttggacttgtccggctggttcgtcgctggttacagcgggggagacatatatcacagcctgtctcgtgcccgaccccgttggttcatgtggtgcctactcctactttccgtaggggtaggcatctacctgctccccaaccggtgaacggggagctaaacactccaggccaataggccattcttttttttttttttttctttcttctttggtggctccatcttagccctagtcacggctagctgtgaaaggtccgtgagccgcatgaccgcagagagtgctgatactggcctctctgcagatcatgt

SEQ ID NO: 786 - DNA, 9548 bp, Hepatitis C Virus
gccagccccctgatgggggcgacactccaccatagatcacccccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcatcatgagcacaaatcctaaaccccaaagaaaaaccaaacgtaacaccaaccgtcgcccacaggacgttaagttcccgggcggtggtcagatcgtcggtggagtttacttgttgccgcgcaggggccccaggttgggtgtgcgtgcgactaggaagacttccgagcggtcgcaacctcgtggaaggcgacaacctatccccaaggctcgccggcccgagggcaggacctgggctcagcctgggtatccttggcccctctatggcaatgagggcttggggtgggcaggatggctcctgtcaccccgcggctctcggcctagttggggccctaatgacccccggcgtaggtcgcgtaatttgggtaaggtcatcgatacccttacatgcggcttcgccgacctcatggggtacatcccgcttgtcggcgcccccttagggggcgctgccagggccctggcacatggtgtccgggttctggaggacggcgtgaactatgcaacagggaatttgcccggttgctctttctctatcttcctcttagctctgctgtcctgtttgaccatcccagcttccgcttatgaagtgcgcaacgtgtccgggatataccatgtcacaaacgactgctccaactcaagcattgtgtatgaggcggcggacgtgatcatgcatgcccccgggtgcgtgccctgcgttcgggagaacaattcctcccgttgctgggtagcgctcactcccacgctcgcggccaggaatgccagcgtccccactacgacattacgacgccacgtcgacttgctcgttgggacggctgctttctgctccgctatgtacgtgggggatctctgcggatctgttttcctcatctcccagctgttcaccttctcgcctcgccggcatgagacagtacaggactgcaactgctcaatctatcccggccacgtatcaggccatcgtatggcttgggatatgatgatgaactggtcgcccacggcagccttagtggtgtcgcagttactccggatcccacaagctgtcatggacatggtggcgggggcccactggggagtcctagcgggccttgcctactattccatggtggggaactgggctaaggttttgattgtgatgctactctttgccggcgttgacgggcatacccgcgtgacggggggggtgcaaggccatgtcacctctacactcacgtccctctttagacctggggcgtcccagaaaattcagcttgtaaacaccaatggcagttggcatatcaacaggactgccctgaactgcaatgactccctcaaaactgggtttcttgccgcgctgttctacacacacaagttcaacgcgtccggatgcccggagcgcatggccagctgtcgctccattgacaagttcgaccagggatggggtcccatcacctatgctcaacctgacaactcggaccagaggccgtattgctggcactacgcacctcgacagtgtggtatcgtacccgcgtcgcaggtgtgcggtccagtgtattgcttcaccccaagccctgttgtagtggggacgaccgatcgtttcggcgcccctacgtataactggggggacaatgagacggacgtgctgctcctaaacaacacgcggccgccgcatggcaactggttcggctgtacatggatgaatagcactgggttcaccaagacgtgcggaggccccccgtgtaacatcaggggggtcggcaacaacaccttgacctgccccacggactgcttccggaagcaccccgacgccacttacacaaaatgtggttcgggcccttggttgacacctaggtgcttggttgactacccatacaggctctggcactacccctgcactgtcaactttaccatcttcaaggttaggatgtatgtggggggcgtggagcacaggcttgatgctgcatgcaactggactcgaggagagcgttgcgacttggaggacagggatagagcagagctcagcccgctattgctgtctacaacagagtggcagatactgccctgttcctacaccaccctaccggctctgtccactggtttaatccacctccaccagaacatcgtggacatacaatacctgtacggtatagggtcggcggtcgtctccattgccatcaagtgggagtatgtcgtgctgctcttccttctcctggcggacgcgcgcgtctgtgcctgcttgtggatgatgctgctgatagcccaggccgaggctgccttagagaacttggtggtcctcaatgcggcgtccgtggtcggagcgcatggcatgctccccttctttatgttcttctgtgccgcctggtacatgaagggcaggctggtccctggagcggcatacgctttctacggtgtatggccgctgctcctgctcctgctagcattaccaccacgagcttacgccatggaccgggagatggttgcatcttgcggaggcggggtttttgtaggtctagcactcctgaccttgtcaccatactgtaaagtgttcctcgctaggctcatatggtggttacaatattttatcaccaaagccgaggcgcatttgcaagtgtcgctcccccccctcaacgttcgaggcggacgcgatgccatcatcctcctcatgtgcgcggtccacccagagctaatctttgacatcaccaaacttctgctctccatactcggtccgctcatggtgctccaagctagtttaatccgagtgccgtacttcgtgcgcgctcaagggctcattcgcgcatgcatgttggtgcggaaagctgccgggggccattatgtccaaatggccttcgtgaagctagctgcgctgacaggcacgtacgtttatgaccacctcactccactgcaggattgggcccatgtgggcctacgagaccttgcggtggcagtagagcccgttgtcttttctgccatggagaccaaggtcatcacctggggggcagacaccgcggcgtgtggggacattatctcaggtctacccgtctccgcccgaagggggaaggagatacttttgggaccggccgatagttttgaagggcaggggtggcgactccttgcgcccatcacggcctactcccaacagacgcggggcctacttggttgcattatcactagtctcacgggccgggacaagaaccaggttgagggggaggttcaagtggtctccaccgcaaaacaatctttcctggcgacctgtgtcaacggcgcgtgctggactgtctttcacggtgcgggctcaaagaccttagccgccgcaaaaggcccaatcacccaaatgtacaccaatgtagaccaggacctcgtcggctggccagcgccccccggggcgcgttccttaacaccgtgcacctgcggcagctcggacctttacctggtcacgagacatgctgatgtcatcccggtgcgccggcggggcgacagtagggggagcttgctctcccctagacccatctcctacttgaagggctcttcgggtggtccattgctctgcccctcggggcacgttgtgggcatcttccgggctgccgtgtgcacccggggggtcgcgaaggcggtggacttcatacccgttgaatccatggaaaccactatgcggtctccggtattcacagacaactcaacccccccggccgtaccgcagaccttccaagtggcccatctacacgcccccactggcagcggtaaaagcactaaggtgccggctgcatatgcagcccaagggtacatggtactcgtcctgaacccgtccgttgctgccaccctgggttttggggcgtatatgtctaaggcacatggcatcgaccccaacatcagaacaggggtaaggaccatcaccaccggcgcccctatcacatactccacctatggcaagtttcttgccgatggtggttgctctggaggcgcctatgacatcataatatgtgatgagtgccactcaactgactcgacttccatcctgggcatcggcactgttttggatcaagcggagacggttggagcgcggttcgtcgtgctcgccaccgctacgcctccaggatcaatcacttttccgcatcccaacatcgaggaggtgcccctggccaacacaggggaaatccccttctacgccaaaaccatccccattgaggtcatcagggggggaaggcacctcattttctgccactccaaaaagaagtgtgacgagctccccgcgaagctgtcagccctcgggctcaacgctgtagcatattaccgggggcttgacgtgtccgtcataccggccagcggagacgtcgttgtcgtggcaacagacgctctaatgacgggctttaccggtgactttgattcagtgatcgactgtaacacgtgtgtcacccagacagtcgattttagcttggatcccaccttcaccatcgagacgacgaccgtgccccaagatgcggtttcgcgtacgcagcggcgaggtaggactggtaggggcaggagaggcatctacaggtttgtgactccaggagaacggccctcggcgatgttcgattcttcggtcctgtgtgagtgttatgacgcgggctgtgcttggtatgagctcacgcccgctgagacctcggttaggttgcgggcttacctaaatacaccagggttgcccgtctgccaggaccatctggagttctgggagagcgtcttcacaggcctcacccacatagacgcccacttcttgtcccagactaagcaggcaggagacaacttcccctacctggtagcataccaagccacagtgtgcgccagggctaaggctccacctccatcgtgggatcaaatgtggaagtgtctcatacggctaaagcctacgctgcacgggccaacgcccctgctgtataggctaggagccgtccagaatgaggtcaccctcacacaccctataaccaaatacatcatggcatgcatgtcggctgacctagaggtcgtcactagcacttgggtgctggtaggcggggtcctcgcggctctggccgcgtactgcctgacaacgggcagcgtggtcattgtgggcaggatcatcttgtccgggaggccggccgttattcccgacagggaagttctctaccaagagttcgatgaaatggaagagtgcgcctcgcacctcccttacatcgaacaaggaatgcagctcgccgagcaattcaagcagaaggcgctcggtttgctgcaaacagccaccaagcaagcggaggctgctgctcccgtggtggagtccaagtggcgagcccttgagaccttctgggcgaagcacatgtggaatttcatcagcgggatacagtacttagcaggcttgtccactctgcctggaaaccccgcaatagcatcactgatggcattcacagcctctatcaccagcccgctcgccacccaatataccctcctgtttaacatcttggggggatgggtggccgcccaactcgccccccccagtgccgcttcagccttcgtgggcgccggtatagctggcgcggctgttggcagcataggcctcgggaaggtgcttgtggacattctggcgggttatggagcaggggtggcaggcgcgctcgtggcctttaaggtcatgagcggtgacatgccctccaccgaggacctggtcaacttactccccgccatcctctctcctggtgccctggtcgtcggggtcgtgtgcgcagcaatactgcgtcggcatgtgggcccaggggagggggctgtgcagtggatgaaccggctgatagcgtttgcttcgcggggcaaccatgtctcccccacgcactatgtgcctgaaagcgacgccgcagcgcgcgtcacccagatcctctccaaccttaccatcactcagctgttgaagaggcttcaccagtggattaatgaggactgctccacgccatgctccggctcgtggctcagggatgtttgggactggatatgcacggtattggctgatttcaagacctggctccagtccaagctcctgccgcggttaccgggggtcccttttttctcatgccagcgtgggtacaagggggtttggcggggagatggcatcatgtataccacctgcccatgtggagcacaaatcaccggacatgtcaaaaacggttctatgaggatcgttgggcctagaacctgtagcaacacgtggcacggaacatttcccatcaacgcgtacaccacaggcccctgcacaccctccccggcgccaaactattccagggcgttgtggcgggtggccgctgaggagtatgtggaggtcacgcgggtgggggatttccactacgtgacgggcatgaccactgacaacgtgaaatgcccatgccaggttccggcccccgaattcttcacagaattggatggggtgcggctgcacaggtacgctccggcgtgcaaacctctcctgcgggatgaggtcacattccaggtcgggctcaaccaatatacggttgggtcacagctcccatgtgagcccgaaccggatgtaacagtggtcacctccatgctcaccgacccctcccacattacagcagaggcggctaggcgtaggctggccagagggtctcccccttccttggccggttcttcagctagtcagttgtctgcgctttctttgaaggcgacatgcactacccatcatggcgccccagacactgacctcatcgaggccaacctcctgtggcggcaggagatgggcggaaacatcacccgcgtggagtcagagaacaagatagtaattctagactcttttgaaccgcttcgagcggaggaggatgagagggaagtgtccgctgcggcggagatcctgcggaagaccaggaaattccccgcagcgatgcccgtatgggcacgcccggactacaacccaccattactagagtcttggaagaacccggactacgtccctccagtggtacacgggtgcccattgccgcctaccaaggcccctccaataccacctccacggagaaagagaacggttgtcctgacagaatccaccgtgtcctctgccttggcggagcttgctacaaagacctttggcggttccggatcgtcggccgtcgacagcggcacggcgaccggccctcctgaccaggcctccgccgaaggagatgcaggatccgacgctgagtcgtactcctccatgcccccccttgagggagagccgggggaccccgatctcagcgacgggtcttggtctaccgtaagcgaggaggccagcgaggacgtcgtctgctgctcgatgtcctacacatggacaggcgccttaattacaccatgcgccgcggaggagagcaagctgcccattaatgcgctgagcaaccctttgctgcgccaccacaacatggtctattccacaacatcccgcagtgcaagcctgcggcagaagaaggtcacctttgacagaatgcaagtcctggacgatcattaccgggacgtgctcaaggagatgaaggcgaaggcgtccacagtgaaggctaaactgctatctgtagaggaggcatgcaagctgacgcccccacattcggccaaatccaaatttggctatggggcaaaggacgtccggagcctatccagcagggccgttaaccacatccgctccgtgtggaaggacttgctggaggacactgacacaccaattcagaccaccatcatggcaaaaaatgaggttttctgcgtccaaccagagaaaggaggccgcaaaccagctcgccttatcgtattcccagacctgggagttcgtgtgtgcgagaagatggccctttacgacgtggtttccactcttcctcaggccgtgatgggctcctcatacggattccagtactctcctaagcagcgggtcgagttcctggtgaatacctggaaagcaaagaagtgccctatgggcttttcatatgacacccgctgttttgactcaacggtcaccgagaatgacatccgtgttgaggagtcaatctaccaatgttgtgacttagcccccgaagctagacaggccataaggtcgctcacagagcggctctacatcgggggtcccatgactaactccaaagggcagaactgcggctatcgccggtgccgcgcgagcggtgtgctgacgactagctgcggcaataccctcacatgttacttgaaggccgctgcagcctgtcgagctgcaaagctccaggactgcacgatgcttgtgtgcggagacgaccttgtcgttatctgtgatagcgcgggaactcaggaggacgcggcgagcctacgagtcttcacggaggctatgactaggtactctgccccccccggggacccgccccaaccagaatacgacttggagctgataacatcatgctcctccaatgtgtcggtcgcgcacgacgcatcaggcaaacgggtgtactatctcacccgtgaccccaccacccccctagcgcgggctgcgtgggagacagctagacacactccagtcaactcctggctaggcaacatcatcatgtacgcgcccaccttatgggcaaggatgattctgatgacccacttcttctccatccttctagcccaggagcaacttgaaaaagccctagattgtcagatctacggggccacttactccattgagccacttgacctacctcagatcattcaacgactccacggtcttagcgcattttcactccatagttactctccaggtgagatcaatagggtggcttcatgcctcaggaaacttggggtaccgcccttgcgagtctggagacatcgggccagaagcgtccgcgctaagctactgtcccagggggggagggccgccacctgtggcaaatacctcttcaactgggcagtaaagaccaagctcaaactcactccaatcccagaagcgtcccagctggacttgtccggctggttcgttgctggttacagcgggggagacatatatcacagcctgtctcgtgcccgaccccgctggttcatgtggtgcctactcctactttccgtaggggtaggcatctacctgctccccaaccgatgaacggggagctaaacactccaggccaataggccatccccttcttttttttttttttttttttttccttttcttctttggtggctccatcttagccctagtcacggctagctgtgaaaggtccgtgagccgcatgactgcagagagtgctgatactggcctctctgcagatcatgt

SEQ ID NO: 787 - DNA, 9033 bp, Hepatitis C Virus
atgagcacaaatcctaaacctcaaagaaaaaccaaacgtaacaccaaccgccgcccacaggacgttaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggtaggacctgggctcagcccgggtacccttggcccctctatggcaacgagggtatggggtgggcaggatggctcctgtcaccccgtggctctcggcctagttggggccccacagacccccggcgtaggtcgcgtaatttgggtaaggtcatcgatacccttacatgcggcttcgccgacctcatggggtacattccgcttgtcggcgcccccctaggaggcgctgccagggccctggcgcatggcgtccgggttctggaggacggcgtgaactatgcaacagggaatctgcccggttgctctttctctatcttcctcttagctttgctgtcttgtttgaccatcccagcttccgcttacgaggtgcgcaacgtgtccgggatataccatgtcacgaacgactgctccaactcaagtattgtgtatgaggcagcggacatgatcatgcacacccccgggtgcgtgccctgcgtccgggagagtaatttctcccgttgctgggtagcgctcactcccacgctcgcggccaggaacagcagcatccccaccacgacaatacgacgccacgtcgatttgctcgttggggcggctgctctctgttccgctatgtacgttggggatctctgcggatccgtttttctcgtctcccagctgttcaccttctcacctcgccggtatgagacggtacaagattgcaattgctcaatctatcccggccacgtatcaggtcaccgcatggcttgggatatgatgatgaactggtcacctacaacggccctagtggtatcgcagctactccggatcccacaagccgtcgtggacatggtggcgggggcccactggggtgtcctagcgggccttgcctactattccatggtggggaactgggctaaggtcttgattgtgatgctactctttgctggcgttgacgggcacacccacgtgacagggggaagggtagcctccagcacccagagcctcgtgtcctggctctcacaagggccatctcagaaaatccaactcgtgaacaccaacggcagctggcacatcaacaggaccgctctgaattgcaatgactccctccaaactgggttcattgctgcgctgttctacgcacacaggttcaacgcgtccggatgtccagagcgcatggccagctgccgccccatcgacaagttcgctcaggggtggggtcccatcactcacgttgtgcctaacatctcggaccagaggccttattgctggcactatgcaccccaaccgtgcggtattgtacccgcgtcgcaggtgtgtggcccagtgtattgcttcaccccgagtcctgttgtggtggggacgaccgaccgttccggagtccccacgtatagctggggggagaatgagacagacgtgctcgtactcaacaacacgcggccgccgcaaggcaactggttcggctgtacatggatgaatagcaccgggttcaccaagacgtgcgggggccccccgtgtaacatcgggggggttggcaacaacaccttgatttgccccacggattgcttccgaaagcaccccgaggccacttacaccaaatgcggctcgggtccttggttgacacctaggtgtctagttgactacccatacagactttggcactacccctgcactatcaattttaccatcttcaaggtcaggatgtacgtggggggcgtggagcacaggctcaacgccgcgtgcaattggacccgaggagagcgctgtgacctggaggacagggatagatcagagcttagcccgctgctattgtctacaacggagtggcaggtactgccctgttcctttaccaccctaccggctctgtccactggattgatccacctccatcagaatatcgtggacgtgcaatacctgtacggtgtagggtcagtggttgtctccgtcgtaatcaaatgggagtatgttctgctgctcttccttctcctggcggacgcgcgcgtctgtgcctgcttgtggatgatgctgctgatagcccaggctgaggccaccttagagaacctggtggtcctcaatgcggcgtctgtggccggagcgcatggccttctctccttcctcgtgttcttctgcgccgcctggtacatcaaaggcaggctggtccctggggcggcatatgctctctatggcgtatggccgttgctcctgctcttgctggctttaccaccacgagcttatgccatggaccgagagatggctgcatcgtgcggaggcgcggtttttgtaggtctggtactcttgaccttgtcaccatactataaggtgttcctcgctaggctcatatggtggttacaatattttatcaccagggccgaggcgcacttgcaagtgtgggtcccccctcttaatgttcggggaggccgcgatgccatcatcctccttacatgcgcggtccatccagagctaatctttgacatcaccaaactcctgctcgccatactcggaccgctcatggtgctccaggctggcatgactagagtgccgtactttgtacgcgctcaggggctcatccgtgcatgcatgttagtgcggaaggtcgctggaggccactatgtccaaatggccttcatgaagctggccgcgctgacaggtacgtacgtatatgaccatcttactccactgcgggattgggcccacgcgggcctacgagaccttgcggtggcagtagagcccgtcgtcttctctgacatggagactaagatcatcacctggggggcagacaccgcggcgtgtggggacatcatctcgggtctaccagtctccgcccgaagggggaaggagatacttctaggaccggccgatagttttggagagcaggggtggcggctccttgcgcctatcacggcctattcccaacaaacgcggggcctgcttggctgtatcatcactagcctcacaggtcgggacaagaaccaggtcgatggggaggttcaggtgctctccaccgcaacgcaatctttcctggcgacctgcgtcaatggcgtgtgttggaccgtctaccatggtgccggctcgaagaccctggccggcccgaagggtccaatcacccaaatgtacaccaatgtagaccaggacctcgtcggctggccggcgccccccggggcgcgctccatgacaccgtgcacctgcggcagctcggacctttacttggtcacgaggcatgccgatgtcattccggtgcgccggcgaggcgacagcagggggagtctactctcccctaggcccgtctcctacctgaagggctcctcgggtggaccactgctttgcccttcggggcacgttgtaggcatcttccgggctgctgtgtgcacccggggggttgcgaaggcggtggacttcatacccgttgagtctatggaaactaccatgcggtctccggtcttcacagacaactcatcccctccggccgtaccgcaaacattccaagtggcacatttacacgctcccactggcagcggcaagagcaccaaagtgccggctgcatatgcagcccaagggtacaaggtgcgcgtcctaaacccgtccgttgctgccacattgggctttggagcgtatatgtccaaggcacatggcatcgagcctaacatcagaactggggtaaggaccatcaccacgggcggccccatcacgtactccacctatggcaagttccttgccgacggtggatgctccgggggcgcctatgacatcataatatgtgacgaatgccactcaactgactggacaaccatcttgggcatcggcacagtcctggatcaggcagagacggctggagcgcggctcgtcgtgctcgccaccgccacgcctccgggatcgatcaccgtgccacaccccaacatcgaggaagtggccctgtccaacactggggagattcccttctatggcaaagccatccccattgaggccatcaaggggggaaggcatctcatcttctgccattccaagaagaagtgtgacgagctcgccgcaaagctgacaggcctcggactcaatgctgtagcgtattacaggggtctcgatgtgtccgtcataccgactagcggagacgtcgttgtcgtggcaacagacgctctaatgacgggctttaccggcgactttgactcagtgatcgactgcaacacatgtgtcacccagacagtcgatttcagcttggatcccaccttcaccattgagacgacaaccgtgccccaagacgcggtgtcgcgctcgcagcggcgaggtaggactggcaggggcaggagtggcatctacaggtttgtgactccaggagaacggccctcaggcatgttcgactcctcggtcctgtgtgagtgctatgacgcaggctgcgcttggtatgagctcacgcccgctgagactacagtcaggttgcgggcttacctgaatacaccagggttgcccgtctgccaggaccatctggagttctgggaaagcgtcttcacaggcctcacccacatagatgcccacttcctgtcccaaaccaagcaggcaggagacaacttcccctacctggtggcataccaagccacggtgtgcgccagggctcaggctccacctccatcgtgggatcaaatgtggaagtgtctcatacggcttaaacctacgctgcacgggccaacacccctgctgtataggctaggagccgttcaaaatgagatcaccctcacacatcccataaccaaattcgtcatggcatgcatgtcggccgacctggaggtcgtcactagcacctgggtgctggtaggcggagtccttgcagctctggccgcatattgcctgacaaccggtagtgtggtcattgtgggtaggatcattttgtccgggaggccggctgttgttcccgacagggaagtcctctaccgggagttcgatgaaatggaagagtgcgcctcacacctcccttacatcgagcaaggaatgcagctcgccgagcagttcaagcagaaggcactcgggttgctgcaaacagccaccaagcaagcggaggccgctgctcccgtggtggagtccaggtggcgggcccttgaggccttctgggcaaagcacatgtggaacttcatcagcgggatacagtacttagcaggcttatccactctgcctgggaaccccgcgatagcatcactgatggcattcacagcctctatcaccagtccgctcaccacccagaataccctcctattcaacatcttagggggatgggtggctgctcaactcgctcctcccagtgctgcttcggccttcgtgggtgccggcattgccggtgcggccattggcagcataggccttgggaaggtgcttgtggacattctggcgggctatggagcgggggtggccggtgcactcgtggcttttaaggtcatgagcggcgaggcgccctccgccgaggacctggttaacttgctccctgccatcctctcccccggcgccttggtcgtcgggatcgtgtgtgcagcaatcctgcgtcggcacgtgggcccgggagagggggctgtgcagtggatgaaccggctgatagcgttcgcttcgcggggtaaccacgtttcccccacgcactacgtgcctgagagcgacgccgcagcacgtgtaactcagatcctctccagcctcaccatcactcagctgctgaagaggcttcaccagtggattaatgaggactgctccacgccatgctccggctcgtggctaagggatgtttgggactggatatgcacggtgttgactgacttcaagacctggctccagtccaagctcctgccgaaattgccgggagtccctttcttctcatgccaacgcgggtacaagggagtctggcggggggacggcatcatgcaaaccacctgcccatgtggagcacaaattaccggacatgtcaaaaacggttccatgaggatcgttgggcctaaaacctgcagcaacacgtggcacggaacgttccccatcaacgcgtacaccacaggcccctgcacaccctccccggcgccgaactattccagggcgctgtggcgggtggctgctgaagagtacgtggagattacgcgggtgggggacttccactacgtgacgggtatgaccaccgacaacgtaaaatgcccgtgccaggtcccggcccccgaattcttcactgaattggacggggtgcggttgcacaggtacgctccggcgtgcagacctctcctacgggtggatgtcacattccaggtcgggctcaaccaatacctggttgggtcacagctcccatgcgagcctgagccggatgtggcagtgctcacttccatgctcaccgacccctcccacattacagcagagacggctaaacgtaggccggccagggggtctcccccctccttggccagctcttcagctagccaattgtctgcgccttccttgaaggcaacatgcactacccaccatgactccccggacgctgacctcatcgaggccaacctcctgtggcggcaggagatgggcggaaacatcacccgtgtggagtcagagaataaggtggtaattttggactctttcgacccgcttcgagcggaagaggatgagagggaggtatccgttgcagcagagatcctgcgaaaatccaagaagttcccccccgcgttgcccatatgggcacgcccggattacaaccctccactgttagagtcctggaaaagtccggactacgtccctccggcggtgcatgggtgcccattgccgcctaccacgggccctccaataccgcctccacggaaaaagaggacggttgttctgacagagtccaccgtgtcttctgccttggcggagctggctactaagactttcggcagctccggatcgtcggccgttgacagcggcacggcgaccgcccctcccgatcagacctctgacgacggtgacaaagaatctgacattgagtcgtactcctccatgcccccccttgagggggagccgggggaccctgatctcagcgacgggtcttggtctaccgtgagcggggaggccggcgacgacatcgtctgctgctcaatgtcctacacatggacaggtgccttgatcacgccatgcgctgcggaggagagcaagttgcccatcaatccgttgagcaactctttgctgcgtcaccacagtatggtctactccacaacatctcgcagcgcaagtctgcggcagaagaaggtcacctttgacagactgcaagtcctggacgaccactaccgggacgtgctcaaggagatgaaggcgaaggcgtccacagttaaggctaggcttctatctatagaggaggcctgcaaactgacgcccccacattcggccaaatccaaatttggctacggggcgaaggacgtccggagcctatccagcagggccgtcaaccacatccgctccgtgtgggaggacttgctggaagacactgaaacaccaattgataccaccatcatggcaaaaaatgaggttttctgcgtccaaccagagaaaggaggccgcaagccagctcgccttatcgtattcccagacctgggggtacgtgtatgcgagaagatggccctttacgacgtggtctccacccttcctcaggccgtgatgggcccctcatacggattccagtactctcctgggcagcgggtcgagttcctggtgaatacctggaaatcaaagaaatgccctatgggcttctcatatgacacccgctgctttgactcaacggtcactgagaatgacatccgtactgaggagtcaatctaccaatgttgtgacttggcccccgaagccagacaggccataaagtcgctcacagagcggctctacatcgggggtcccctgactaattcaaaagggcagaactgcggttatcgccggtgccgcgcgagcggtgtgctgacgactagctgcggcaataccctcacatgctacttgaaagccactgcggcctgtcgagctgcaaagctccaggactgcacgatgctcgtgaacggagacgaccttgtcgttatctgcgaaagcgcgggaacccaggaggatgcggcgagcctacgagtcttcacggaggctatgactaggtactctgccccccccggggacccgccccaaccagaatacgacttggagctgataacgtcatgctcctccaatgtgtcggtcgcgcacgatgcatccggcaaaagggtgtactacctcacccgtgaccccaccacccccctcgcacgggctgcgtgggagacagttagacacactccagtcaactcctggctaggcaatatcatcatgtatgcgcccaccctatgggcgaggatgattctgatgactcatttcttctctatccttctagctcaggagcaacttgaaaaagccctggattgtcagatctacggggcctgctactccattgagccacttgacctacctcagatcatcgaacgactccatggtcttagcgcattttcactccatagttactctccaggtgagatcaatagggtggcttcatgcctcaggaaacttggggtaccacccttgcgagtctggagacatcgggccagaagtgtccgcgctaagttgctgtcccagggggggagggccgccacttgcggcaaatacctcttcaactgggcagtaaggaccaagcttaaactcactccaatcccggctgcgtcccagctagacttgtccggctggttcgttgctggttacaacgggggagacatatatcacagcctgtctcgtgcccgaccccgttggttcatgttgtgcctactcctactttctgtaggggtaggcatctacctgctccccaaccgctga

SEQ ID NO: 788 - DNA, 9413 bp, Hepatitis C Virus
ttgggggcgacactccaccatagatcactcccctgtgaggaactactgtcttcacgcagaaagcgtctagccatggcgttagtatgagtgttgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcatcatgagcacaaatcctaaacctcaaagaaaaaccaaacgtaacaccaaccgccgcccacaggacgttaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccggcccgagggtaggacctgggctcagcccgggtacccttggcccctctatggcaacgagggtatggggtgggcaggatggctcctgtcaccccgtggctctcggcctagttggggccccacagacccccggcgtaggtcgcgtaatttgggtaaggtcatcgatacccttacatgcggcttcgccgacctcatggggtacattccgcttgtcggcgcccccctagggggcgctgccagggccctggcacatggtgtccgggttctggaggacggcgtgaactatgcaacagggaatctgcccggttgctctttctctatcttcctcttagctttgctgtcttgtttgaccatcccagcttccgcttacgaggtgcgcaacgtgtccgggatataccatgtcacgaacgactgctccaactcaagtattgtgtatgaggcagcggacatgatcatgcacacccccgggtgcgtgccctgcgtccgggagagtaatttctcccgttgctgggtagcgctcactcccacgctcgcggccaggaacagcagcatccccaccacgacaatacgacgccacgtcgatttgctcgttggggcggctgctctctgttccgctatgtacgttggggatctctgcggatccgtttttctcgtctcccagctgttcaccttctcacctcgccggtatgagacggtacaagattgcaattgctcaatctatcccggccacgtatcaggtcaccgcatggcttgggatatgatgatgaactggtcacctacaacggccctagtggtatcgcagctactccggatcccacaagccgtcgtggacatggtggcgggggcccactggggtgtcctagcgggccttgcctactattccatggtggggaactgggctaaggtcttgattgtgatgctactctttgctggcgttgacgggcacacccacgtgacagggggaagggtagcctccagcacccagagcctcgtgtcctggctctcacaaggcccatctcagaaaatccaactcgtgaacaccaacggcagctggcacatcaacaggaccgctctgaattgcaatgactccctccaaactgggttcattgctgcgctgttctacgcacacaggttcaacgcgtccgggtgcccagagcgcatggctagctgccgccccatcgatgagttcgctcaggggtggggtcccatcactcatgatatgcctgagagctcggaccagaggccatattgctggcactacgcgcctcgaccgtgcgggatcgtgcctgcgtcgcaggtgtgtggtccagtgtattgcttcactccgagccctgttgtagtggggacgaccgatcgtttcggcgctcctacgtatagctggggggagaatgagacagacgtgctgctacttagcaacacgcggccgcctcaaggcaactggtttgggtgcacgtggatgaacagcactgggttcaccaagacgtgcgggggccctccgtgcaacatcgggggggtcggcaacaacaccttggtctgccccacggattgcttccggaagcaccccgaggccacttacacaaagtgtggctcggggccctggttgacacccaggtgcatggttgactacccatacaggctctggcactacccctgcactgttaactttaccgtctttaaggtcaggatgtatgtggggggcgtggagcacaggctcaatgctgcatgcaattggactcgaggagagcgctgtgacttggaggacagggataggtcagaactcagcccgctgctgctgtctacaacagagtggcagatactgccctgttccttcaccaccctaccggccctgtccactggcttgatccatcttcaccggaacatcgtggacgtgcaatacctgtacggtatagggtcggcagttgtctcctttgcaatcaaatgggagtatatcctgttgcttttccttcttctggcggacgcgcgcgtctgtgcctgcttgtggatgatgctgctgatagcccaggctgaggccaccttagagaacctggtggtcctcaatgcggcgtctgtggccggagcgcatggccttctctccttcctcgtgttcttctgcgccgcctggtacatcaaaggcaggctggtccctggggcggcatatgctctctatggcgtatggccgttgctcctgctcttgctggccttaccaccacgagcttatgccatggaccgagagatggctgcatcgtgcggaggcgcggtttttgtaggtctggtactcttgaccttgtcaccatactataaggtgttcctcgctaggctcatatggtggttacaatattttatcaccagagccgaggcgcacttgcaagtgtgggtcccccctctcaatgttcggggaggccgcgatgccatcatcctccttacatgcgcggtccatccagagctaatctttgacatcaccaaactcctgctcgccatactcggtccgctcatggtgctccaggctggcataactagagtgccgtactttgtacgcgctcaggggctcatccgtgcatgcatgttagtgcggaaggtcgctggaggccactatgtccaaatggccttcatgaagctggccgcgctgacaggtacgtacgtatatgaccatcttactccactgcgggattgggcccacgcgggcctacgagaccttgcggtggcagtagagcccgtcgtcttctctgacatggagactaaactcatcacctggggggcagacaccgcggcgtgtggggacatcatctcgggtctaccagtctccgcccgaagggggaaggagatacttctaggaccggccgatagttttggagagcaggggtggcggctccttgcgcctatcacggcctattcccaacaaacgcggggcctgcttggctgtatcatcactagcctcacaggtcgggacaagaaccaggtcgatggggaggttcaggtgctctccaccgcaacgcaatctttcctggcgacctgcgtcaatggcgtgtgttggaccgtctaccatggtgccggctcgaagaccctggccggcccgaagggtccaatcacccaaatgtacaccaatgtagaccaggacctcgtcggctggccggcgccccccggggcgcgctccatgacaccgtgcacctgcggcagctcggacctttacttggtcacgaggcatgctgatgtcgttccggtgcgccggcggggcgacagcagggggagcctgctttcccccaggcccatctcctacctgaagggctcctcgggtggaccactgctttgcccttcggggcacgttgtaggcatcttccgggctgctgtgtgcacccggggggttgcgaaggcggtggacttcatacccgttgagtctatggaaactaccatgcggtctccggtcttcacagacaactcatcccctccggccgtaccgcaaacattccaagtggcacatttacacgctcccactggcagcggcaagagcaccaaagtgccggctgcatatgcagcccaagggtacaaggtgctcgtcctaaacccgtccgttgccgccacattgggctttggagcgtatatgtccaaggcacatggcatcgagcctaacatcagaactggggtaaggaccatcaccacgggcggccccatcacgtactccacctattgcaagttccttgccgacggtggatgctccgggggcgcctatgacatcataatatgtgatgaatgccactcaactgactcgactaccatcttgggcatcggcacagtcctggatcaggcagagacggctggagcgcggctcgtcgtgctcgccaccgccacgcctccgggatcgatcaccgtgccacaccccaacatcgaggaagtggccctgtccaacactggagagattcccttctatggcaaagccatccccattgaggccatcaaggggggaaggcatctcatcttctgccattccaagaagaagtgtgacgagctcgccgcaaagctgacaggcctcggactcaatgctgtagcgtattaccggggtctcgatgtgtccgtcataccgactagcggagacgtcgttgtcgtggcaacagacgctctaatgacgggttttaccggcgactttgactcagtgatcgactgcaacacatgtgtcacccagacagtcgatttcagcttggatcccaccttcaccattgagacgacaacgctgccccaagacgcggtgtcgcgtgcgcagcggcgaggtaggactggcaggggcaggagtggcatctacaggtttgtgactccaggagaacggccctcaggcatgttcgactcctcggtcctgtgtgagtgctatgacgcaggctgcgcttggtatgagctcacgcccgctgagacctcggttaggttgcgggcttacctaaatacaccagggttgcccgtctgccaggaccacctagagttctgggagagcgtcttcacaggcctcacccacatagatgcccacttcttgtcccagaccaaacaggcaggagacaacctcccctacctggtagcataccaagccacagtgtgcgccagggctcaggctccacctccatcgtgggaccaaatgtggaagtgtctcatacggctaaagcccacactgcatgggccaacgcccctgctgtacaggctaggagccgttcaaaatgaggtcactctcacacaccccataaccaaatacatcatggcatgcatgtcggctgacctggaggtcgtcactagcacctgggtgctagtaggcggagtccttgcggctctggccgcgtactgcctgacgacaggcagcgtggtcattgtgggcaggatcatcttgtccgggaggccagctgttattcccgacagggaagtcctctaccaggagttcgatgagatggaagagtgtgcttcacacctcccttacatcgagcaaggaatgcagctcgccgagcaattcaaacagaaggcgctcggattgctgcaaacagccaccaagcaagcggaggctgctgctcccgtggtggagtccaagtggcgagcccttgaggtcttctgggcgaaacacatgtggaacttcatcagcgggatacagtacttggcaggcctatccactctgcctggaaaccccgcgatagcatcattgatggcttttacagcctctatcaccagcccgctcaccacccaaaataccctcctgtttaacatcttggggggatgggtggctgcccaactcgctccccccagcgctgcttcggctttcgtgggcgccggcattgccggtgcggccgttggcagcataggtctcgggaaggtacttgtggacattctggcgggctatggggcgggggtggctggcgcactcgtggcctttaaggtcatgagcggcgagatgccctccactgaggatctggttaatttactccctgccatcctttctcctggcgccctggttgtcggggtcgtgtgcgcagcaatactgcgtcggcacgtgggcccgggagagggggctgtgcagtggatgaaccggctgatagcgttcgcttcgcggggtaaccacgtctcccccacgcactatgtgcccgagagcgacgccgcggcgcgtgttactcagatcctctccagccttaccatcactcagttgctgaagaggcttcatcagtggattaatgaggactgctccacgccttgttccggctcgtggctaaaggatgtttgggactggatatgcacggtgttgagtgacttcaagacttggctccagtccaagctcctgccgcggttaccgggactccctttcctgtcatgccaacgcgggtacaagggagtctggcggggggatggcatcatgcaaaccacctgcccatgtggagcacagatcaccggacatgtcaaaaatggctccatgaggattgttgggccaaaaacctgcagcaacacgtggcatggaacattccccatcaacgcatacaccacgggcccctgcacgccctccccagcgccgaactattccagggcgctgtggcgggtggctgctgaggagtacgtggaggttacgcgggtgggggatttccactacgtgacgggcatgaccactgacaacgtgaaatgcccatgccaggttccagcccctgaatttttcacggaggtggatggagtacggttgcacaggtatgctccagtgtgcaaacctctcctacgagaggaggtcgtattccaggtcgggctcaaccagtacctggtcgggtcacagctcccatgtgagcccgaaccggatgtggcagtgctcacttccatgctcaccgacccctctcatattacagcagagacggccaagcgtaggctggccagggggtctcccccctccttggccagctcttcagctagccagttgtctgcgccttctttgaaggcgacatgtactacccatcatgactccccggacgctgacctcatcgaggccaacctcctgtggcggcaggagatgggcgggaacatcacccgtgtggagtcagaaaataaggtggtaatcctggactctttcgatccgattcgggcggtggaggatgagagggaaatatccgtcccggcggagatcctgcgaaaacccaggaagttccccccagcgttgcccatatgggcacgcccggattacaaccctccactgctagagtcctggaaggacccggactacgtccccccggtggtacacgggtgccctttgccatctaccaaggcccccccaataccacctccacggaggaagaggacggttgtcctgacagagtccaccgtgtcttctgccttggcggagctcgctactaagacctttggcagctccgggtcgtcggccgttgacagcggcacggcgactggccctcccgatcaggcctccgacgacggcgacaaaggatccgacgttgagtcgtactcctccatgccccccctcgagggagagccaggggaccccgacctcagcgacgggtcttggtctaccgtgagcggggaagctggtgaggacgtcgtctgctgctcaatgtcctatacatggacaggtgccttgatcacgccatgcgctgcggaggagagcaagttgcccatcaatccgttgagcaactctttgctgcgtcaccacagtatggtctactccacaacatctcgcagcgcaagtctgcggcagaagaaggtcacctttgacagactgcaagtcctggacgaccactaccgggacgtgctcaaggagatgaaggcgaaggcgtccacagttaaggctaggcttctatctatagaggaggcctgcaaactgacgcccccacattcggccaaatccaaatttggctacggggcgaaggacgtccggagcctatccagcagggccgtcaaccacatccgctccgtgtgggaggacttgctggaagacactgaaacaccaattgataccaccatcatggcaaaaaatgaggttttctgcgtccaaccagagaaaggaggccgcaagccagctcgccttatcgtattcccagacctgggggtacgtgtatgcgagaagatggccctttacgacgtggtctccacccttcctcaggccgtgatgggcccctcatacggattccagtactctcctgggcagcgggtcgagttcctggtgaatacctggaaatcaaagaaatgccctatgggcttctcatatgacacccgctgctttgactcaacggtcactgagaatgacatccgtactgaggaatcaatttaccaatgttgtgacttggcccccgaagccaggcaggccataaggtcgctcacagagcggctttatgtcgggggtcccctgactaattcgaaggggcagaactgcggttatcgccggtgccgcgcaagtggcgtgctgacgactagctgcggcaacaccctcacatgttacttgaaggccactgcggcctgtcgagctgcaaagctccaggactgcacgatgctcgtgaacggagacgaccttgtcgttatctgtgagagtgcgggaacccaggaggatgcggcggccctacgagccttcacggaggctatgactaggtattccgccccccccggggacccgccccaaccagaatacgacttggagctgataacgtcatgctcctccaatgtgtcggtcgcgcacgatgcatccggcaaaagggtgtactacctcacccgtgaccccaccacccccctcgcacgggctgcgtgggagacagttagacacactccagtcaactcctggctaggcaatatcatcatgtatgcgcccaccctatgggcgaggatgattctgatgactcatttcttctctatccttctagctcaggagcaacttgaaaaagccctggattgtcagatctacggggcctgttactccattgagccacttgacctacctcagatcattgaacgactccatggtcttagcgcattttcactccacagttactctccaggtgagatcaatagggtggcttcatgcctcaggaaacttggggtaccgcctttgcgagtctggagacatcgggccagaagtgtccgcgctaagctactgtcccagggggggagggctgccacttgcggcaagtacctcttcaactgggcagtaaagaccaagcttaaactcactccaatcccggctgcgtcccagctagacttgtccggctggttcgttgctggttacaacgggggagacatatatcacagcctgtctcgtgcccgaccccgttggttcatgttgtgcctactcctactttctgtaggggtaggcatctacctgctccccaaccggtgaacggggagctaaccactccaggccaataggccattcccttttttttttttc

SEQ ID NO: 789 - DNA, 9360 bp, Hepatitis C Virus
gcgacactccaccatagatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagaccgctagccgagtagcgttgggttgcgaaaggccttgtggtactgcctgatagggtgcttgcgagtgccccgggaggtctcgtagaccgtgcatcatgagcacaaatcctaaacctcaaagaaaaaccaaaagaaacaccaaccgccgcccacaggacgttaagtttccgggcggcggccagatcgttggcggagtatacttgttgccgcgcaggggccccaggttgggtgtgcgcgcgacgaggaaaacttccgaacggtcccagccacgtgggaggcgccagcccatcccgaaagatcggcgcgccactggcaagtcctggggacgtccaggatatccctggcccctgtatgggaacgagggcctcggttgggcagggtggctcctgtccccccggggctcacgtccctcatggggccccacagacccccggcataggtcgcgtaatttgggtaaagtcatcgataccctcacgtgcggctttgctgacctcatggggtacattcccgttgtcggcgccccagtgggtggcgttgccagagcccttgcgcatggcgtgagagtcctggaggacgggataaactatgcaacagggaaccttcccggttgctctttctctatcttcttgttagctcttttgtcctgcatcaccgtgccagtttccgccgcggaagtcagagacaccggcgacggatacatggtaaccaacgactgttcaaacagcagcattacctggcagcttcagaatgctgtgctgcacgttcctggatgcatcccctgtgagcgaggggacgacaacaggtcccggtgttggataccagttacacccaacgtagctgtgagccgacctggtgccctaaccgagggcttgcgagcgcacattgataccgttgtagcgtcagcaacattttgttctgccctctacataggggatttatgtggcgcaataatgatagctgctcaagttgtcgttgtctcgccacaacaccatcactttgttcaggactgcaactgttccatctacccgggccacatatctggacaccgtatggcatgggacatgatgatgaactggtcgccaacaatcactatggctctgggttacctgatgcgcgtgcccgaagtagccctggagatcatcgccggcggccactggggggtgctgttcggccttgcctatttctccatgcaaggagcgtgggcaaaggtcgtcgtcatcctcctcctgtcagccggggtggacgcggccactcggaccgtcgggagcctagcaggctcccaggccgccagcctcagcgggctcttcacttcgggggccaggcagaatatccagcttatcaacagcaatggcagctggcacattaaccgcacagccctcaactgtaatgactccctgaacaccgggtttcttgcatctttgttttacacccacaagtttaatgcatcgggctgccccgcgcgcctggcttcctgccgtaacatcgagtcctttcggattgggcgaggcgctctggactatgaggaagatgtcaccaatggggaggacatgaggccctactgctggcactatccgcctaagccatgcggtctggtctctgccctgtccgtgtgtggcccagtctactgtttcaccccctccccggtggtagtgggcacgaccgacaaattcggcgtccccacatacacttggggggggaatgtgacggacttcttcctcctgaacagcactcggccccctaggggagcctggtttgggtgtacatggatgaacgctaccggattcaccaaaacatgtggcgcaccaccgtgccgcattcggcaggaccccggagcaaagaatagtagcgacctgctatgccccacagattgcttcaggaagcaccctgatgcaacctacaataaatgcggggccggaccctggctgacacccaggtgcctagtcgattacccctataggctgtggcactacccgtgcactgtcaactattccatctttaagataaggatgtttgtagggggaattgaacacaggctccaagcggcgtgcaacttcactcgcggagaccgctgcaacctcgaggacagggataggagccagctcagcccgctcttacattccaccactgagtgggccatcttgccctgcactttttcagatctgccagccctttccacgggacttatccacctccaccagaacatcgttgacgttcagtacttgtacggcctgacaccggccatcacaaaatacatcgtcaagtgggagtgggtagtactcctcttcctgctgctggcggatgccagagtctgtgcctgtctatggatgcttatcctgctgggccaggccgaagcagcactggaaaggctggttgttctgcacgctgccagtgcagccagttccaacggcttactatgcttcattctcttcttcgtagcggcctggtacatcaagggtcgggcagtcccgctggccacctactccctcattggcctatggcccttcgtcctgcttcttttggtgttgccccaacaggcctacgcctttgacgcggccgagcagggccagcttggccttgtgctgctggtgattatatctatcttcacactcaccccggcatataagatgcttctcggtcggtgcctgtggtggctatgctacatgttggttctggcagagacccagatccagcagtgggtgccacccttggaggcccgtggcggtcgcgatggcatcatatgggccgttaccatgttctgcccgggtatagtgtttgacataaccaagtggctcctggcgatcctcgggcctggttacctcttgaggggggttctgactagagtaccgtacttcgtcagagcgcatgccttattgcggatatgctccatggtaaaacacatcataggaggcaagtatgttcagatggcattgctggcccttggtagatggtttggtacatacatctatgaccacctcacccctatgtcagactgggctgctagcgggcttcgggacctagcggtcgctgtggagcccgtcattttcagcccgatggagaagagagtcatcacttggggggcagagacagcagcgtgcggagacattatacatggattgcctgtttcagctcggctgggccgcgaggtcctgctgggtcccgctgacggctacacctccaaagggtggaagcttctcgctcccatcacggcctatcaccaacagactcgcggcctacttgggacaattgtcaccagtctcacaggtcgcgacaaaaatgaggtcgagggcgagatacaagtggtctccacggccactcagactttcctggctacagctgtaaatggggtcctctggacagtctatcacggggccggctccaagaccttagccggccccaaaggccctgtttgccaaatgtacaccaatgtggaccaggacatggtgggatggccagcacctccaggtgctagatcactaactccctgcacctgtggctccagtgatgtctatctagtcaccaggaatgcggacgtgatccccgcaaggcgcaggggggacacccgcgctggactcctgagccctaggcccttaagcacccttaagggatcatctggaggcccaatcctatgcccgtcgggtcacgccgttggcctctttcgtgcggcagtctgcacaagaggagttgctaaggcgatagacttcgtgcccgtcgagaacatggagactaccatgcggtctccggtcttcaccgacaattcctctccacccgcagtcccaagtacctaccaggtggggtacttacatgccccaacaggcagcgggaagagcacaaaggtaccggcagcgtacgctagccagggttacaaggtgctggtgctcaatccatctgtagcagccaccctagcttttggctcttacatgagtaaggcccatggtgtggacccgaacatcaggacaggggtgcgaactattacaacgggaggtcccatcacctactccacctatggcaaattcttggctgatggaggttgttccggcggggcgtatgacatcatcatatgtgacgaatgccattccactgaccctaccacaatcttggggattggcaccgtcttggaccaggcagagacggccggagtgcgtctcacggtcctagcaaccgccactcctcccggatcagtcacggtgccgcatccaaacatctcggaggtcgccttacccaccacgggggaggtccccttctatgggaggggaatccccctagagtacatcaaaggcggcaggcaccttattttctgtcactcaaagaagaaatgcgacgagctggccaagcaattaagatcacttggccttaatgccgtcgctttctataggggtgtggatgtgtcagtgatccctacatcgggggatgttgtcgtctgcgccactgacgccctcatgaccggctatacgggtgatttcgactccgttatagactgcaatgttgcggtcacacaggtagttgatttcagcctagaccccaccttcacgattgagaccaccaccgttccacaggatgccgtggccaggagtcagcggcgtggccgcacgggcagggggaagccaggggtgtacaggtatgtctcgcagggtgaacgaccgtcaggcacatttgacaccgtcgtcctttgcgaagcctacgatgttggctgtgcgtggtatgagctaacaccctcagaaaccaccgttaggctacgcgcgtaccttaacacgcctgggctgcccgtgtgccaagatcatcttgaattctgggagggagtgttcacggggctcacgcacatcgacgcccacttcctctcacagaccaaacaaggtggggagaacttcgcgtacctagtagcttatcaggccacggtgtgtgcgcgcgccaaagccccccccccgtcatgggacaacatgtggaaatgtcttctgcggctaaagcctatgcttgtggggcccacacccctattgtacaggctgggtgccgtacagaatgaggtcactaccactcatccaattactaaatacatcatgacttgcatgtcagccgacctcgaggtgatcactagcgcctgggtgctcacggggggaattcttgctgcattggctgcgtactgtctgacgacgggcagcgctgtcatatgtggcaggattataacctcaggtaagcccgctgttatgcctgaccgcgaggtcctataccagcagttcgatgagatggaggagtgctcacaccggatcccctacttagtcgagggccaacaaattgccgagcaattcaagcaaaaggtcttaggcctcttgcagaatacggccaaacaggcagaagagctgaaaccggcggttcagtctgcgtggcccaagctcgagcagttctggcagaaacatctgtggaattttgttagcgggatacaatatttggctggcctgtcaacactgcctggcaacccggctgtggcctccttaatgtccttctccgcagctctgacaagccctttaagcacgtccacaaccctcctcctcaacatcttaggaggttgggtggcgtcccagttagcgccgccatcagcatctacagctttcgtcgtgagcggcctcgctggcgctgccgtaggcagtatcggactaggccgcgtcatcgtcgacatcttggcgggctatggggcaggagtatccggtgctcttgttgcttttaagatcatgagtggtgagccacctgctatggaggacatggtcaaccttctacctgctcttttgtcacctggcgctctggtcgtaggcgtagtgtgcgctgctgtgctgcgtcgccacgtcggtccctctgaaggggcgacccagtggatgaacaggcttatagcatttgcctcaagaggcaatcacgtatcaccaacacactacgtacctgagacagacgcctcccgagcagtaatgactatactcagttctctgaccatcaccagtctgctacgcagacttcatgagtggattaacaatgactggacgacaccatgctccacgacctggttaagagacatctgggactgggtttgcaccgtgctgtcagacttcaagacctggcttaaggccaagcttgtgccgtccctgccgggcatcccctttctctcctgtcaacgggggttcaggggggtatggcgaggcgaaggcatcaaccatacgacatgcccctgcggggctatgatcacaggccatgtaaagaatgggtccatgaagatctcggggcccaaaacgtgcagcaatgtctggcatggcaggtttccaatcaatgccaccaccacgggacccagcgtacccatcccagatccaaactacaaaagagcattgtggagggtctccgcggaggactacgttgaggtcgtgaggatacatgactgccattatgtggtgggagccactgccgacaacctgaagtgcccctgccaggtgccagcaccggagtttttcaccgaagtggacgggatcaggctgcacagatacgcgcctacgtgtcggccacttctccgcgatgagctgacattctcagtagggctcaatagctatgccatggggtcacagctcccgtgcgagcccgagcctgatgtgatgatactcacgtctatgctctctgacccgagccatatcaccgcggagacagcagctcggcgcctcgcacgggggtcccctccatctttggccagctcctcggcaagtcaactctctgcgccatctttgaaggccacgtgtaccaccgcccgtgatcatccggatgctgagctagtggaggccaacctcttgtggcgacaggagatgggaggtaacatcactcgagttgagtccgagaacaaggttgtagtactcgactcctttgaccctcttgtcgccgagccggatgacagggagatatcagtggctgctgagtgtcttagaccatcaagaccaaaatttccgcctgcattgcctatctgggctcgacccgattataacccacctttgttggaatcatggaaggctccagactacagtccaccaacagtctcgggctgtgctctccctccgaagggtataccacccgtgccaccacctaggaggaagaaagttgtacagctcgatgagtcttctgtttcacaggcgttggcggagcttgcccaaaagtcgttcccgtcccccccagcttcatcgcagggggattcgggagcggggccctccgttcccacctccattgaggcacagtcctccgacggtgtggagacggcgtcagacgccggttcatacagctctatgccaccgttggagggggaacccggggacccagatctcagctcggggtcctggtcgacggtcagcgaggaaggggatagtgtggtgtgctgctctatgtcgtactcctggactggggccctcgtgactccttgcgccgcagaggaggagaagttgcccattagtccactgagcaactccctcattcgccaccataacctggtatactccacaacatcacggagtgcctctctccgccaaaagaaagtgaccttcgatcgggtccaggtgctggaccaacactacaatgacattcttaaggagattaaggctcgagcttctggagtgaaggccaggctcctctccacggaggaagcatgcaccctcacccctccacattcggctcgctctaagttcggatatggagcaaaagaagttcgcagccattctagtaaagccgttaaccacatcaactccgtgtgggaggacttgctagaggacaacacaacacctattccgacaaccattatggcaaagaatgaagtgttctgtgtagaccctcaaaaaggcggccgtaagccggcgcgcttgatcgtataccctgatcttggggtaagggtgtgcgagaagagggctctgtacgatcttgcccagaaactgcccgaggcaataatgggatccgcttacggtttccagtattcaccaaagcaacgggtagattacctgcttaagatctggcgctcgaagaaaactcccatgggattctcttacgacaccagatgctttgactcctctgtcacggaacgtgacatccgcactgaacaagacatctatctgtgctgccaattagatccggtagcacggaaagtcatcacatctctcacagaacggctgtactgcggtggccccatgtataactctcgaggccaatcatgtgggtaccgtaggtgccgtgctagcggtgtcttcaccacaagcttaggcaacaccatgacatgctacctgaaggcccaggcggcttgtagggcagcgaagctcaaaaactttgacatgttggtctgtggggacgatttagtcgttgtcgctgagagcgaaggggtctctgaggacgccggagccctgcgagtcttcacggaggctatgaccaggtattcggcccccccaggagatgaaccacgcccagagtacgacctggagctgataacatcatgctcatcgaatgtctccgtggcccacgatggttctggacagagatactactacctcacccgagacccagccataccattgacacgtgctgcctgggaaacagcgcgccatactccagtgaactcatggttgggcaacatcatcatgttcgcgcccacaatttgggtgcgcatggtgttgatgacacatttctttggaatactccagtcccaagaaacactccacagggtgcttgacttcgacatgtacggagtcacctactctatcactccattggacttgccgcagattatccagcggttacatggtatggccgccttttcactccatggttactctccaggcgaactcaacagggtggcagcctgcctcaggaagcttggggcaccaccgttgagagcttggcgacatcgggccagggcggtcagagctaaactcatagcccagggggggaaagccgctatatgcggccggtacctgtttaactgggctgtgaagacaaagctcaaactcactccactccgcgatgcagctaacctggacctgtctgggtggtttgtcgtgggcggacgcgggggggacatatttcacagcgtgtcccgggcccgaccccgcactttactcctgtgcctactcctacttaccgtag

SEQ ID NO: 790 - DNA, 9370 bp, Hepatitis C Virus
accatagatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagaccgctagccgagtagcgttgggttgcgaaaggccttgtggtactgcctgatagggtgcttgcgagtgccccgggaggtctcgtagaccgtgcatcatgagcacaaatcctaaacctcaaagaataaccaaaagaaacactaaccgccgcccacaggacgttaagttcccgggcggtggccggatcgttggcggagtatacttgttgccgcgcaggggccccaggttgggtgtgcgcgcgacgaggaaaacttctgaacggtcccagccacgtgggaggcgccagcccatcccaaaagatcggcgcaccactggcaagtcctggggacgtccaggatacccttggcccctgtatgggaatgagggcctcggttgggcagggtggctcctgtccccccggggctcacgcccgtcatggggccccacagacccccggcacaggtcgcgcaacttgggtaaggtcatcgataccctcacgtgcggctttgccgacctcatggggtacattcccgtcgtcggcgccccagtgggcggcgttgccagagctcttgcgcacggcgtgagagtcctggaggacgggataaattatgcgacggggaaccttcccggttgctctttctctatcttcttgttagctcttttgtcctgcttcaccgtgccagtttctgctgtggaggtcaaaaacaccagtcacatatatatggtgaccaatgactgttcaaacagcagtatcacctggcagcttcaggacgcagtgcttcaccttcctggatgcgtcccctgtgaacgggtgaacaacgagtcccggtgttggaccccggtcacgcctaacgtagccgtgggccgtcctggtgctctaaccgagggcttgcgatcgcacatcgacatcatcgtggcgtccgcaacggtttgctctgccctctacataggggatttgtgtggctcgatcatgatagctgctcaagttgtcatcgcctcgccgaaacaccacaatttcgtccaggactgcaactgttccatctacccgggccatgtatctggacaccgcatggcatgggacatgatgatgaactggtcgccaacggctaccatgattctcggttacctgctgcgcgtgcccgaagtggccctggagatcatcgccggtggccactggggggtggtgttcggcctagcctatttctccatgcaaggagcgtgggcaaaggtcgtcgtcatcctcctgctgtcagctggggtggacgcgtccacgtactccactggggctcaagctggcagggctgcgtccggcttcgccggcctctttacccgtggggccaggcagaacatccagctcatcaacaccaatggcagctggcacataaaccgtactgccctcaactgcaatgactccctgcagaccggcttcatcgcatccttgttctacgccaacagtttcaactcatcgggctgccccgagcgcatggctcattgccgcagtatcgagcatttccggattgggtggggcgctcttgaatatgaggaaaatgtcatcaacgaggaagacatgaggccctactgttggcattacccacctaagccgtgtggtgtggttcctgccaagtctgtgtgtggcccagtctactgtttcaccccctccccagtggtggtgggcacgaccgacaaacgaggcgtccccacgtacaactggggggacaatgagacagacgtcttccttctaaacagcacccggcctcccaagggagcctggtttggatgcacatggatgaatggcaccggatttaccaaaacgtgcggtgcgccaccgtgccgcatcaggcgggatttcaatgccagcgaggacctgctgtgccccacagactgcttcagaaagcaccctgaggcaacgtatagtaaatgcggggccgggccctggctgacacccaggtgcctgatcgactacccctacaggctgtggcattacccatgcaccttcaactataccatctttaagataaggatgtttgtggggggaattgaacacaggctccaagctgcatgcaatttcactcgcggggatcgctgtaaccttgatgacagagataggagccagctgagcccgctcctgcattccaccaccgagtgggccatcttgccctgttcctttacagacctaccagccctctccacaggactcatccacctccaccagaacatcgtcgacgtccagtacctgtatggcctgacacctgccatcacaaagtacgtcgtcaagtgggagtgggtagtgctcctttttctgctgttggcagacgccagggtctgtgcctgcctatggatgcttatcctgttgggtcaggctgaagcggcactggaaaagctggttgtcctgcacgctgccagcgcagctagttcccatggcttactatacttcatcctcttctttgtagcagcttggtacatcaagggtcgggcagttccactggccacctattctcttcttggccaatggcccttcttcttgctactcttggcgttgcctcagcaggcttacgcccttgacgcagctgaacagggccagctcggtctcgcgctgctggtgatcataactgctttcacactcaccccggcatataagatccttctcacccggtgcctatggtggctgtgctacatgttggtcctggcagaagcccagatccagcagtgggtgccacctttggaggcccgtggcggtcgtgatggcatcatatgggccgcaaccatgttctgcccgggtgtagtgtttgacataacaaagtggctcctggcgatcctggggcctggctacctcttgagggaggtcttgacaggtgtgccgtacttcgtcagagcgcatgctttactacggctatgctccatggtaaaacacatcatgggaggcaagtatgtgcagatggcactgcttgcccttggtaggtggctcggcatatacatctacgaccacctcacccccatgtcggactgggctgctagaggacttcgggacctagcggtcgctgtagagcccattgtcttcagcccgatggagaagaaagtcatcacttggggggcagagacggcggcatgcggtgacatcatacatggattgcctgtctcagcccggttgggccgggaagtcttgctaggtcccgctgacggctacacctccaaagggtggagactcctcgctcccattaccgcttacgcccagcagacacgtggcctgctgggcgccatagtggtaagtctaactgggcgcgacaagacggagcaagctggcgaagtccaggttttgtccaccatcacccagtccttccttggcaccacaatctcgggggttctctggaccgtgttccacggcgccggcaacaagacgttggctggatctcgcggtccagtcacgcagatgtataccagcgcagaaggagacctcgtggggtggcccagccccccaggaactaagtccctggagccatgcacgtgtggagctgtcgacctgtacctcgtcacccggaacgctgatgtcattccagctcggagacagggagaccgacgagcggcactgctatccccgcggcccctctcaacattgaaggggtcctcaggaggacctgtcctctgttccagggctcatgccgtcgggatcttccgcgcagctgtgtgctctaggggagtggcaaagtcaattgacttcatcccagtcgaatcgcttgacattgtcgcccggtcccccagcttcactgacaatggcacgcccccagcagtgcctcagacctaccaggtagggtacctgcatgctcctaccggaagcgggaagagtaccaaggttcctgcggcgtatgctgctcaggggtataaagtactagtactaaacccctcagtagccgccaccttagggtttggggcatacatgtccaaggcacatggaatcaatcccaacgtcagaaccggaatccgaactgtgacgaccggagagtctatcacctactccacatatggcaaattcctcgcagatggaggctgcgcaggcggagcctatgacatcataatatgcgacgaatgccactccatagactcaacaaccatccttggcattgggactgtccttgaccaagccgagacggcgggagttaggttgacggttctggcgacggcaacgccgcctgggtccgttacaacgcctcaccccaacattgaggaggtagccctaggccacgagggcgagatccccttctatgggaaagccatcccccttgccaacataaggggagggaggcacctaatcttctgccactcaaagaagaagtgcgacgagctcgcagcggctcttcggggcatgggcttgaacgcagtggcttattacagagggcttgacgtctcggtgataccaacacagggagacgtggtggtcgtggccaccgacgccctcatgaccgggtacactggggacttcgactctgtggtcgactgcaatgttgcggtcacccaagtcgtagacttcagtttggaccccactttcactataaacacccagaccgttccccaggatgctgtctcgcgtagccagcgtcggggtaggaccggtcgagggagacatggcatatacaggtatgtttcctccggtgaacgaccttccggaatgtttgactctgtggtgctctgcgagtgttacgacgctggcgccgcttggtacgagctcacaccggcagagaccactgtcaggctacgggcatattttaacacaccagggttgcccgtgtgccaagaccatctggaattctgggaggcggtttttactggcctcacccacattgatgcccatttcctctctcaaacaaagcaagcgggggaaaattttccgtacctagtggcttatcaggccacggtatgtgccagggcaaaagcccctcccccgtcctgggatactatgtggaagtgtcttatccggcttaagcctacactaacaggcccaacacctttgctatatcgcttgggcgcggtcagcaatgaagtcaccctcacccaccccgtgaccaagtacatctccacatgcatgcaggcggatcttgagatcatgaccagcacgtgggtgttagcggggggagtcctggctgccgtggcagcctactccttggcaactggctgtgtctccaccattggccggatacacatcaaccaacgtgcaatcattgcccctgacaaagaggtcctttacgaggcttttgacgagatggaggagtgcgcttccaaggccgccctcatcgcagaggggcagcggatagctgagatgttcaaatccaaaattcaaggcctgctgcagcaagctacgcagcaggctcagaatgtgcagcctgccgtccaggctacttggcccaagctggagcagttctgggccaagcacatgtggaacttcatcagcggtatccaatatcttgctggactctccacactgccgggaaatcctgccgtggcggcgatgatggcattcagcgccgctctcaccagtccgttggctaccagcaccaccatcctcctcaacatcatgggaggttggctagcctcacagatctctcctccagcaagtgccactggcttcgttgtcagtggcctggtgggggctgctgtaggtagtataggtctaggcaagatactggtggacgtcctggccgggtacggtgcaggtatctcgggagccctcgtcgcctttaagatcatgtctggcgagaagccctctgtggaggacgtggtcaacttgctgcccgccatcctttctcctggtgccctggtggtaggggtcatctgcgcggccattctgcgccgacacgtgggacaaggggaaggcgcggtccaatggatgaataggctcattgcctttgcgtccagaggtaaccatgtcgccccgacacattacgtgacggagtcagacgcgtccaaacgggtcacagaactcctcagttccctcaccataaccagtctgctcaggaggctccatcagtggatcagcgaagactaccccgtcccttgcgccgggtcatggctctgggacgtgtgggattggatctgctccatcctaacggacttcaaaaattggttgtcctccaagctgttcccgaaaatgcctggccttccctttgtttcctgtcaaaagggctacaagggggtgtgggccggtaccggcatcatgaccacacgatgcccgtgcggtgctaacgtctctggcaatgtccgcttgggttcgatgaggataacagggccaaaaacttgcatgaacacttggcagggaaccttccccatcaactgttacacagagggccagtgtgtgccaaaaccggcgcctaacttcaagaccgccatctggagggtggcggccacggagtatgcggaggtgacgcgacacgggtcctacgcgtatgtgacaggactgacaactgacaacttgaaggtcccctgccaaataccatctcctgaattcttctcctgggtggacggtgtgcaaatccacagatttgctcctaccccaaaaccgttcatcagggatgaggtgtcctttagcgtgggcctcactccttccgttggatctcagcttcctgtgatccgagccgacgtgaaggtactggcgtccatgctacagacccatctcatatcacggctgaggcggcagcagggcgattggcgcggggttcgcccccatcggaggccagctcttccgcaagtcagctatcagcgccttcgctgcgggccacctgcaccactcatgccaggaacatggcacattgacatggtagatgctaatctcttcatggggggcgaagtcactcggatagagtccgagtccaaggtgatcatgttggactccctcgactcaatgaccgagggggaggacgagcgcgagccttccgttccatcagagtacttgctccccacaagggaaaaattcccatcagcgctgccagtgtgggcacggcccgactacaacccgccggtcgtggagacctggaaaagaccagactatcaaccaccaacggtagcgggatgtgcactcccccccccaggacaaaccccggtgcccccccccaggaggcgacgcaccgtggcactagaccagagcaccgtgggggaagctcttagagagctggccattaaagcctttggccaacctcccccaagcggtgactcgggccattccacaggggtggatactaccaattccgctaaccagacaacttccaatgagtcagctgattcggaaacgggttccatgagctccatgccccccctcgagggggaacctggagacccagacttggagccaggaccggtcgagcaggagccttcccccccggggggggaggctgctcccggctctgattccgggtcgtggtccacgtgttccgatgagggtgattccgtcatctgctgctctatgtcatactcctggactggggccttgataaccccttgcagcccggaggaaggaaagttgcctatcaatccactcagcaactccttgttgcggtaccacaacaaggtatactgtaccacatcaaagagcgcctcactgcgggcgaaaaaggtgacttttgacagagtgcagctacttgactcacactatgatgcagttctgaaggacgtcaagcttgctgcctctaaggttagtgccaggcttctctcactagaagaggcatgcgcattgaccccgccccattctgcacgatccaagtacggatttggggcgaaggaggttcgcagcttgtccaggagagccgtcgaccacatcaagtccgtgtggaaggacctcctggaagacccgcaaacaccaatccaaactaccatcatggccaaaaatgaggtgttctgtgtcgaccccgccaagggcgggaagaaggcagctcgcctcatcgtataccctgatctcggcgtcagggtctgcgaaaagatggccctctatgacattgcacagaaactcccccgggcggtaatggggcagtcttatggatttcaatactccccagcagagcgggtcgatttcctcctgcgagcatggaaggaaaaacgggaccccatggggttctcatatgacactcgctgctttgactcaacggtcactgaaagagacatcagagttgaggagtccatttatctgtcctgttcgcttcccgaggaggcccggactgcaatacactcactaactgagaggctatacgtggggggtcccatgcaaaacagcaaggggcaatcctgcggatacaggcgctgccgcgccagcggggtgctcaccactagcatgggaaacactctcacatgctacgtgaaagcccaagcggcctgtaaggccgcgggcattgttgcaccaacgatgctggtgtgtggcgacgacctggtcgtcatctcagagagtcaggggactgagagggacgagaacaacctgagagccttcacggaggctatgaccaggaattccgcccctcccggcgaccccccaaaacctgaatatgacttggagctgataacatcatgctcttccaatgtatctgtggctttggacccccagggtcgccgtaggtactatctaaccagagatcctaccactcctctcgccagggctgcctgggagaccgcaagacactcccctgtcaattcatggctgggaaacatcatccagtacgctccaacactgtgggtccgcatggtcctgatgacccattttttctccgtcctcatggcccaggacaccctgggtcaagacctcaattttgagatgtacggagcagtgtactcagtttcccctctggacctcccagccataattgaaagactccatgggcttgacgtcttctctctgcacacatactctccccacgaactcacgcgggtggcatctgctctcagaaagcttggagcgccccctcttagagcgtggaagagtcgggctcgtgcagtcagagcgtcccttctcgcccgggggggtaaggcggccatatgcggccgctacctcttcaactgggcggtgaagacaaagctcaaactcactccattgcctgcggcgcgccttctggatctttccagctggttctccgtcagtgcaggcgggggcgacatatatcacagcgtgtcgcgagcccaccccgcatcttactcttggctatcctactta

SEQ ID NO: 791 - DNA, 9400 bp, Hepatitis C Virus
attgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccgacccgagggcaggacctgggctcagcccgggtatccttggcccctctatggcaatgagggctttgggtgggcaggatggctcctgtcaccccgcggctcccggcctagttggggccccacggacccccggcgtaggtcgcgtaatttgggtaaggtcatcgataccctcacatgcggcttcgccgacctcatggggtacattccgctcgtcggcgcccccttggggggcgctgccagggccctggcacatggtgtccgggttctggaggacggcgtgaactatgcaacagggaatttgcccggttgctctttctctatcttccttttagccttgctatcctgtttgaccaccccagcttccgcttacgaagtgcgtaacgtgtccgggatataccatgtcacgaacgactgctccaactcaagcattgtgtatgaggcagcggacctgatcatgcatacccctgggtgcgtgccctgcgttcgggaaggcaactcctcccgttgctgggtagcgctcactcccacgctcgcggccaggaacgccacgatccccactgcgacagtacgacggcatgtcgatctgctcgttggggcggctgctttctcttccgccatgtacgtgggggatctctgcggatctgttttccttgtctctcagctgttcaccttctcgcctcgccggtatgagacaatacaggactgcaattgctcaatctatcccggccacgtaacaggtcaccgcatggcttgggatatgatgatgaactggtcgcctacaacagctctagtggtgtcgcagttactccggatccctcaagccgtcatggacatggtggtgggggcccactggggagtcctggcgggccttgcctactatgccatggtggggaattgggctaaggttttgattgtgatgctactcttcgccggcgttgatggggatacctacgcgtctgggggggcgcagggccgctccaccctcgggttcacgtccctctttacacctggggcctctcagaagatccagcttataaataccaatggtagctggcatatcaacaggactgccctgaactgcaatgactccctcaatactgggtttcttgccgcgctgttctatacacacaggttcaacgcgtccggatgcgcagagcgcatggccagctgccgccccattgatacattcgatcagggctggggccccatcacttatactgagcctgatagctcggaccagaggccttattgctggcactacgcgcctcgaaagtgcggcatcgtacctgcgtcggaggtgtgcggtccagtgtattgtttcaccccaagccctgtcgtcgtggggacgaccgatcgtttcggtgtccccacatatagctggggggagaatgagacagacgtgctgctcctcaacaacacgcggccgccgcaaggcaactggtttggctgtacatggatgaatggcactgggttcaccaagacgtgcggggggcctccgtgtaacatcgggggggtcggcaacaacactttgacttgccccacggattgctttcggaagcaccccgaggctacgtatacaaggtgtggttcggggccttggctgacacctaggtgcttagttgactacccatacaggctctggcactacccctgcactgtcaactttgccatcttcaaagttaggatgtatgtggggggcgtggagcacaggctcgatgctgcatgcaactggactcgaggagagcgctgtaacttggaggacagggatagatcagaactcagcccgctgctactgtctacaacagagtggcagatactaccctgcgccttcaccaccctaccggctctgtccactggtttaatccatctccatcagaacatcgtggacgtgcaatacctgtacggtatagggtcagcggttgcctcctttgcaattaaatgggagtatgtcttgttgcttttccttctactagcagacgcgcgcgtatgtgcctgcttgtggatgatgctgctgatagcccaggccgaggccgccttagagaacctggtggtcctcaatgcggcgtccgtggccgacgcgcatggcatcctctccttccttgtgttcttttgtgccgcctggtacattaagggcaggctggtccccggggcagcatacgctttctacggcgtgtggccgctgctcctgctcctgctgacattaccaccacgagcttacgccatggaccgggagatggctgcatcgtgcggaggcgcggtttttgtaggtctggtattcctgactttgtcaccatactacaaggtgttcctcgctaggctcatatggtggttgcaatacttcctcaccatagccgaggcgcacctgcaagtgtggatcccccctctcaacattcgagggggccgcgatgccatcatcctcctcacgtgtgcaatccacccagagtcaatctttgacatcaccaaactcctgctcgccacgctcggtccgctcctggtgcttcaggctggcataactagagtgccgtactttgtgcgcgctcatgggctcattcgcgcgtgcatgctattgcggaaagttgctgggggtcattatgtccaaatggccttcatgaagctgggcgcactgacaggtacgtacgtctataaccatcttactccgctgcagtattggccacgcgcgggtttacgagaactcgcggtggcagtagagcccgtcatcttctctgacatggagaccaagattatcacctggggggcagacactgcagcgtgtggagacatcatcttgggtttacccgtctccgcccgaaggggaaaggagatactcctggggccggccgatagtcttgaagggcaggggtggcgactccttgcgcccatcacggcctactcccaacagacgcggggcttacttggttgcatcatcactagcctcacaggccgagacaagaaccaggtcgagggggaggttcaagtggtctccaccgcaacacaatctttcctggcgacctgcatcaacggtgtgtgttggactgtctatcatggcgccggctcaaaaaccttagccggcccaaagggcccaatcacccaaatgtacaccaatgtagaccaggacctcgtcggctggcaccggccccccggggcgcgttccctaacaccatgcacctgcggcagctcggacctttacttggtcacgagacatgctgatgtcattccggtgcgccgtcgaggcgacagtagggggagtttactctcccccaggcctgtctcctacctgaagggctcgtcggggggcccactgctctgccccttcgggcacgttgcaggcatcttccgggctgctgtgtgcacccggggggttgcgaaggcggtggattttatacccgttgagaccatggaaactaccatgcggtccccggtcttcacggacaactcatcccctcctgccgtaccgcagacattccaagtggcccatctacacgctcccactggcagcggcaaaagcaccaaggtgccggctgcatatgcagcccaagggtacaaggtacttgtcttgaacccgtctgttgccgccactttaggttttggggcgtatatgtctaaggcacatggtgtcgaccccaacattagaaccggggtaaggaccatcaccacgggcgcccccatcacatactctacctatggcaagttccttgctgatggtggttgctctgggggtgcctatgacattataatatgtgatgagtgccattcaactgactcgactaccatcttgggcatcggcacggtcctggaccaagcggagacggctggagcgcggcttgtcgtgctcgccaccgctacgcctccgggatcggtcaccgtgccacatccaaacatcgaggaggtggccctgtccaatactggagagatccccttctatggtaaagccatccccatcgaagccatcagggggggaaggcatctcattttctgccactccaagaagaagtgtgacgagcttgctgcaaagctatcatcgctcgggctcaacgctgtggcgtactaccgggggcttgatgtgtccgtcataccatctagcggagacgtcgttgtcgtggcaacggacgctctaatgacgggctttacgggcgactttgactcagtgatcgactgtaacacatgtgttacccaaacagtcgatttcagcttggaccccaccttcaccatcgagacaacgaccgtgccccaagacgcggtgtcgcgctcgcagcggcgaggtaggactggcaggggtagggaaggcatctacaggtttgttactccaggagaacggccctcgggcatgttcgactcctcagtcctgtgtgagtgctatgacgcgggctgtgcttggtacgagctcacgccggctgagaccacggttaggttgcgggcttacctaaatacaccagggttgcccgtctgccaggaccatctggagttctgggagggcgtcttcacaggtctcacccatatagacgctcactttctgtcccagaccaagcaagcaggagacaacttcccctacctggtagcataccaagctacagtgtgtgccaaggctcaggccccacctccatcgtgggatcaaatgtggaagtgcctcacacggctaaagcctacgctgcagggaccaacacccctgctgtataggctaggagccgtccaaaatgaggtcaccctcacacaccccataactaaatacatcatgacatgcatgtcggctgacctggaggtcgtcaccagcacctgggtgctggtgggcggagtccttgcagctctggccgcgtattgcctgacaacgggcagcgtggtcattgtgggtaggattgtcttgtccggaagtccggctattgttcctgacagggaagttctttaccaagacttcgacgagatggaagagtgtgcctcacacctcccttacatcgaacagggaatgcagctcgccgagcagttcaagcagaaggcgctcgggttgctgcaaacagccaccaagcaagcggaggctgctgctcccgtggtggagtccaagtggcgagccctcgagacattttgggaaaaacacatgtggaatttcatcagcgggatacagtacttagcaggcttatccactctgcctgggaaccccgcaatggcatcactgatggcattcacagcttctatcaccagcccgctcactacccaacacaccctcctgtttaacatcttgggtggatgggtggctgcccaactcgctccccccagcgccgcttcggcctttgtgggcgccggcattgccggtgcggctgttggcagcataggccttgggaaggtgcttgtggacatcctggcgggttatggggcgggggtggctggcgcactcgtggcctttaaggtcatgagtggcgaaatgccctccactgaggacctggttaatttactccctgccatcctctctcctggtgccctagtcgtcggggtcgtgtgcgcagcaatactgcgccgacacgtgggcccgggagagggggctgtgcagtggatgaaccggctgatagcgttcgcttcgcggggtaaccatgtctcccccacgcactatgtgcctgaaagtgacgccgcagcgcgtgttacccagatcctctccagccttaccatcactcagctgctgaaaagacttcaccagtggattaatgaggactgttccacaccatgctccggctcgtggctaagggatgtttgggattggatatgcacggtgttgaccgatttcaagacctggctccagtccaagctcctgccgcggttgcccggagtccctttcctctcatgccaacgcgggtacaagggagtctggcggggggacggtattatgcaaaccacctgtccatgtggagcacagattactggacatgtcaaaaacggttccatgagaatcgttgggcctaagacttgtagcaacacgtggcatggaacattccccatcaacgcgtacaccacgggcccctgcacaccctccccggcgccgaactattccagggcgctgtggcgggtggctcctgaggagtacgtggaggttacgcgggtgggggatttccactacgtgacgggcatgaccaccgacaacgtgaaatgcccatgccaagtcccggcccctgaattcttcacggaggtggatggagtacggctgcacaggtacgctccggcgtgcaaacctctcctacgggaggaggtcgtgttccaggtcgggctcaaccaatacctggttggatcacagctcccatgcgagcccgagccggacgtaacagtgctcacttccatgcttaccgacccctcccacatcacagcagagacggccaagcgtaggctggccagggggtctcccccctccttggccagctcttcagctagccaattgtctgcgccttctttgaaggcgacatgtactacccatcatgactccccggacgccgacctcattgaggccaacctcctgtggcggcaggagatgggcggaaacatcacccgtgtggagtcagaaaataaggtagtgatcctggactctttcgacccgcttcgggcggaggaggacgagagggaagtatccgttgcggcggagatcctgcggaaatccaggaagttcccctcagcgctgcccatatgggcacgcccagactacaaccctccactgctagagtcctggaaggacccagattatgtccctccggtggtacacgggtgcccgttgccgcctaccacggcccctccagtaccacctccacggagaaaaaggacggtcgtcctaacagagtcatccgtgtcttctgccttggcggagctcgctactaagaccttcggcagctctgaatcgtcggccgtcgacagcggcacggcgactgcccctcctgacgaggcctccggcggcggcgacaaaggatccgacgttgagtcgtactcctccatgcccccccttgagggagagccgggggaccccgacctcagcgacgggtcctggtctaccgtgagtgaggaggccagtgaggacgtcgtctgctgctcaatgtcctatacatggacaggcgccttgatcacgccatgtgctgcggaggagagcaagctgcccatcaacccgctgagcaactccttgctgcgtcaccacaacatggtctatgctacaacatcccgcagtgcaagcctacggcagaagaaggtcgcttttgacagaatgcaagtcctggacgaccactaccgggacgtgctcaaggagatgaaggcgaaggcgtccacagttaaggctaaactcctatccatagaagaggcctgcaagctgacgcccccacattcagccaaatccaaatttggctatggggcaaaagacgtccggaacctatccagcaaggccgttaaccacatccgctccgtgtggaaggacttgttggaagacaatgagacaccaatcaataccaccatcatggcaaaaaatgaggttttctgcgtccaaccagagaaaggaggccgtaagccagctcgccttatcgtattcccagacttgggagtccgtgtgtgcgagaagatggccctttatgacgtggtctccacccttcctcagcccgtgatgggctcctcatacggattccagtactctcctgggcagcgggtcgaattcctgctaaatgcctggaaatcaaaggaaaaccctatgggcttctcatatgacacccgctgttttgactcaacggtcactcagaacgacatccgtgttgaggagtcaatttaccaatgttgtgacttggcccccgaggccagacgggccataaagtcgctcacagagcggctctatatcgggggtcccctgactaattcaaaagggcagaactgcggttatcgccggtgccgcgcaagtggcgtgctgacgaccagctgcggtaatacccttacatgttacttgaaggcctctgcggcctgtcgagctgcgaagctgcaggactgcacgatgctcgtgaacggagacgaccttgtcgttatctgtgaaagcgcgggaactcaagaggatgcggcgagcctacgagtcttcacggaggctatgactaggtactctgccccccctggggacctgccccaaccagaatacgacttggagctaataacatcatgctcctccaatgtgtcagtcgcccacgatgcatctggcaaaagggtgtactacctcacccgtgaccccaccatccccctcgcgcgggctgcgtgggagacagctagacacactccagtcaactcctggctaggcaacatcatcatgtatgcgcccactctatgggcaaggatgattctgatgactcacttcttctccatccttctagctcaggagcaacttgagaaagccctggattgccaaatctacggggcctactactccattgagccacttgacctacctcagatcattgaacgactccatggccttagcgcattttcactccatagttactctccaggtgagatcaatagggtggcgtcatgtctcaggaaacttggggtaccacccttgcgagtctggagacatcgggccagaagcgtccgcgctaagctactgtcccagggggggagggccgccacttgtggcaagtacctcttcaactgggcagtaaagaccaagcttaaactcactccaatcccggctgcgtcccggttggacttgtccggctggttcgttgctggttacagcgggggagacatatatcacagcctgtctcgtgcccgaccccgttggttcatgttgtgcctactcctactttctgtaggggtaggcatctacctgctccccaaccgatgaacggggagataaacactccaggccaataggccatccc

SEQ ID NO: 792 - DNA, 7310 bp, Hepatitis C Virus
caggctgtcctgagaggctagccagctgccgaccccttaccgattttgaccagggctggggccctatcagttatgccaacggaagcggccccgaccagcgcccctactgctggcactaccccccaaaaccttgcggtattgtgcccgcgaagagtgtgtgtggtccggtatattgcttcactcccagccccgtggtggtgggaacgaccgacaggtcgggcgcgcccacctacagctggggtgaaaatgatacggacgtcttcgtccttaacaataccaggccaccgctgggcaattggttcggttgtacctggatgaactcaactggattcaccaaagtgtgcggagcgcctccttgtgtcatcggaggggcgggcaacaacaccctgcactgccccactgattgcttccgcaagcatccggacgccacatactctcggtgcggctccggtccctggatcacacccaggtgcctggtcgactacccgtataggctttggcattatccttgtaccatcaactacaccatatttaaaatcaggatgtacgtgggaggggtcgaacacaggctggaagctgcctgcaactggacgcggggcgaacgttgcgatctggaagacagggacaggtccgagctcagcccgttactgctgaccactacacagtggcaggtcctcccgtgttccttcacaaccctaccagccttgtccaccggcctcatccacctccaccagaacattgtggacgtgcagtacttgtacggggtggggtcaagcatcgcgtcctgggccattaagtgggagtacgtcgttctcctgttccttctgcttgcagacgcgcgcgtctgctcctgcttgtggatgatgctactcatatcccaagcggaggcggctttggagaacctcgtaatacttaatgcagcatccctggccgggacgcacggtcttgtatccttcctcgtgttcttctgctttgcatggtatttgaagggtaagtgggtgcccggagcggtctacaccttctacgggatgtggcctctcctcctgctcctgttggcgttgccccagcgggcgtacgcgctggacacggaggtggccgcgtcgtgtggcggtgttgttctcgtcgggttgatggcgctgactctgtcaccatattacaagcgctatatcagctggtgcttgtggtggcttcagtattttctgaccagagtggaagcgcaactgcacgtgtggattccccccctcaacgtccgaggggggcgcgacgccgtcatcttactcatgtgtgctgtacacccgactctggtatttgacatcaccaaattgctgctggccgtcttcggacccctttggattcttcaagccagtttgcttaaagtaccctactttgtgcgcgtccaaggccttctccggttctgcgcgttagcgcggaagatgatcggaggccattacgtgcaaatggtcatcattaagttaggggcgcttactggcacctatgtttataaccatctcactcctcttcgggactgggcgcacaacggcttgcgagatctggccgtggctgtagagccagtcgtcttctcccaaatggagaccaagctcatcacgtggggggcagataccgccgcgtgcggtgacatcatcaacggcttgcctgtttccgcccgcaggggccgggagatactgctcgggccagccgatggaatggtctccaaggggtggaggttgctggcgcccatcacggcgtacgcccagcagacaaggggcctcctagggtgcataatcaccagcctaactggccgggacaaaaaccaagtggagggtgaggtccagattgtgtcaactgctgcccaaaccttcctggcaacgtgcatcaatggggtgtgctggactgtctaccacggggccggaacgaggaccatcgcgtcacccaagggtcctgtcatccagatgtataccaatgtagaccaagaccttgtgggctggcccgctccgcaaggtagccgctcattgacaccctgcacttgcggctcctcggacctttacctggtcacgaggcacgccgatgtcattcccgtgcgccggcggggtgatagcaggggcagcctgctgtcgccccggcccatttcctacttgaaaggctcctcggggggtccgctgttgtgccccgcggggcacgccgtgggcatatttagggccgcggtgtgcacccgtggagtggctaaggcggtggactttatccctgtggagaacctagagacaaccatgaggtccccggtgttcacggataactcctctccaccagtagtgccccagagcttccaggtggctcacctccatgctcccacaggcagcggcaaaagcaccaaggtcccggctgcatatgcagctcagggctataaggtgctagtactcaacccctctgttgctgcaacactgggctttggtgcttacatgtccaaggctcatgggatcgatcctaacatcaggaccggggtgagaacaattaccactggcagccccatcacgtactccacctacggcaagttccttgccgacggcgggtgctcggggggcgcttatgacataataatttgtgacgagtgccactccacggatgccacatccatcttgggcatcggcactgtccttgaccaagcagagactgcgggggcgagactggttgtgctcgccaccgccacccctccgggctccgtcactgtgccccatcccaacatcgaggaggttgctctgtccaccaccggagagatccctttttacggcaaggctatccccctcgaagtaatcaagggggggagacatctcatcttctgtcattcaaagaagaagtgcgacgaactcgccgcaaagctggtcgcattgggcatcaatgccgtggcctactaccgcggtcttgacgtgtccgtcatcccgaccagcggcgatgttgtcgtcgtggcaaccgatgccctcatgaccggctataccggcgacttcgactcggtgatagactgcaatacgtgtgtcacccagacagtcgatttcagccttgaccctaccttcaccattgagacaatcacgctcccccaggatgctgtctcccgcactcaacgtcggggcaggactggcagggggaagccaggcatctacagatttgtggcaccgggggagcgcccctccggcatgttcgactcgtccgtcctctgtgagtgctatgacgcaggctgtgcttggtatgagctcacgcccgccgagactacagttaggctacgagcgtacatgaacaccccggggcttcccgtgtgccaggaccatcttgaattttgggagggcgtctttacaggcctcactcatatagatgcccactttctatcccagacaaagcagagtggggagaaccttccttacctggtagcgtaccaagccaccgtgtgcgctagggctcaagcccctcccccatcgtgggaccagatgtggaagtgtttgattcgcctcaagcccaccctccatgggccaacacccctgctatacagactgggcgctgttcagaatgaaatcaccctgacgcacccagtcaccaaatacatcatgacatgcatgtcggccgacctggaggtcgtcacgagcacctgggtgctcgttggcggcgtcctggctgctttggccgcgtattgcctgtcaacaggctgcgtggtcatagtgggcagggtcgtcttgtccgggaagccggcaatcatacctgacagggaagtcctctaccgagagttcgatgagatggaagagtgctctcagcacttaccgtacatcgagcaagggatgatgctcgccgagcagttcaagcagaaggccctcggcctcctgcagaccgcgtcccgtcaggcagaggttatcgcccctgctgtccagaccaactggcaaaaactcgagaccttctgggcgaagcatatgtggaacttcatcagtgggatacaatacttggcgggcttgtcaacgctgcctggtaaccccgccattgcttcattgatggcttttacagctgctgtcaccagcccactaaccactagccaaaccctcctcttcaacatattgggggggtgggtggctgcccagctcgccgcccccggtgccgctactgcctttgtgggcgctggcttagctggcgccgccatcggcagtgttggactggggaaggtcctcatagacatccttgcagggtatggcgcgggcgtggcgggagctcttgtggcattcaagatcatgagcggtgaggtcccctccacggaggacctggtcaatctactgcccgccatcctctcgcccggagccctcgtagtcggcgtggtctgtgcagcaatactgcgccggcacgttggcccgggcgagggggcagtgcagtggatgaaccggctgatagccttcgcctcccgggggaaccatgtttcccccacgcactacgtgccggagagcgatgcagctgcccgcgtcactgccatactcagcagcctcactgtaacccagctcctgaggcgactgcaccagtggataagctcggagtgtaccactccatgctccggttcctggctaagggacatctgggactggatatgcgaggtgttgagcgactttaagacctggctaaaagctaagctcatgccacagctgcctgggatcccctttgtgtcctgccagcgcgggtataagggggtctggcgagtggacggcatcatgcacactcgctgccactgtggagctgagatcactggacatgtcaaaaacgggacgatgaggatcgtcggtcctaggacctgcaggaacatgtggagtgggaccttccccattaatgcctacaccacgggcccctgtaccccccttcctgcgccgaactacacgttcgcgctatggagggtgtctgcagaggaatatgtggagataaggcaggtgggggacttccactacgtgacgggtatgactactgacaatctcaaatgcccgtgccaggtcccatcgcccgaatttttcacagaattggacggggtgcgcctacataggtttgcgcccccctgcaagcccttgctgcgggaggaggtatcattcagagtaggactccacgaatacccggtagggtcgcaattaccttgcgagcccgaaccggacgtggccgtgttgacgtccatgctcactgatccctcccatataacagcagaggcggccgggcgaaggttggcgaggggatcacccccctctgtggccagctcctcggctagccagctatccgctccatctctcaaggcaacttgcaccgctaaccatgactcccctgatgctgagctcatagaggccaacctcctatggaggcaggagatgggcggcaacatcaccagggttgagtcagaaaacaaagtggtgattctggactccttcgatccgcttgtggcggaggaggacgagcgggagatctccgtacccgcagaaatcctgcggaagtctcggagattcgcccaggccctgcccgtttgggcgcggccggactataaccccccgctagtggagacgtggaaaaagcccgactacgaaccacctgtggtccatggctgtccgcttccacctccaaagtcccctcctgtgcctccgcctcggaagaagcggacggtggtcctcactgaatcaaccctatctactgccttggccgagctcgccaccagaagctttggcagctcctcaacttccggcattacgggcgacaatacgacaacatcctctgagcccgccccttctggctgcccccccgactccgacgctgagtcctattcctccatgccccccctggagggggagcctggggatccggatcttagcgacgggtcatggtcaacggtcagtagtgaggccaacgcggaggatgtcgtgtgctgctcaatgtcttactcttggacaggcgcactcgtcaccccgtgcgccgcggaagaacagaaactgcccatcaatgcactaagcaactcgttgctacgtcaccacaatttggtgtattccaccacctcacgcagtgcttgccaaaggcagaagaaagtcacatttgacagactgcaagttctggacagccattaccaggacgtactcaaggaggttaaagcagcggcgtcaaaagtgaaggctaacttgctatccgtagaggaagcttgcagcctgacgcccccacactcagccaaatccaagtttggttatggggcaaaagacgtccgttgccatgccagaaaggccgtaacccacatcaactccgtgtggaaagaccttctggaagacaatgtaacaccaatagacactaccatcatggctaagaacgaggttttctgcgttcagcctgagaaggggggtcgtaagccagctcgtctcatcgtgttccccgatctgggcgtgcgcgtgtgcgaaaagatggctttgtacgacgtggttacaaagctccccttggccgtgatgggaagctcctacggattccaatactcaccaggacagcgggttgaattcctcgtgcaagcgtggaagtccaagaaaaccccaatggggttctcgtatgatacccgctgctttgactccacagtcactgagagcgacatccgtacggaggaggcaatctaccaatgttgtgacctcgacccccaagcccgcgtggccatcaagtccctcaccgagaggctttatgttgggggccctcttaccaattcaaggggggagaactgcggctatcgcaggtgccgcgcgagcggcgtactgacaactagctgtggtaacaccctcacttgctacatcaaggcccgggcagcctgtcgagccgcagggctccaggactgcaccatgctcgtgtgtggcgacgacttagtcgttatctgtgaaagcgcgggggtccaggaggacgcggcgagcctgagagccttcacggaggctatgaccaggtactccgccccccctggggaccccccacaaccagaatacgacttggagctcataacatcatgctcctccaacgtgtcagtcgcccacgacggcgctggaaagagggtctactacctcacccgtgaccctacaacccccctcgcgagagctgcgtgggagacagcaagacacactccagtcaattcctggctaggcaacataatcatgtttgcccccacactgtgggcgaggatgatactgatgacccatttctttagcgtccttatagccagggaccagcttgaacaggccctcgattgcgagatctacggggcctgctactccatagaaccacttgatctacctccaatcattcaaagactc

SEQ ID NO: 793 - DNA, 9416 bp, Hepatitis C Virus
cgattgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgcccaggaagacttccgagcggtcgcaacctcgtggaaggcgacaacctatccccaaggctcgccggcccgagggcaggacctgggctcagcccgggtacccttggcctctctatggcaatgagggcttagggtgggcaggatggctcctgtcaccccgcggctcccggcctagttggggccccacggacccccggcgtaggtcgcgtaatttgggtaaggtcatcgataccctcacatgcggcttcgccgatctcatggggtacattccgctcgtcggcgcccccctggggggcgctgccagggccctggcacatggtgtccgggttctggaggacggcgtgaactatgcaacagggaatctgcccggttgctctttttctatcttcctcttggctctgctgtcctgcctgaccaccccagcttccgcttacgaagtgcacaacgtgtccgggatatatcatgtcacgaacgactgctccaacgcaagcattgtgtatgaggcagcggacttgatcatgcatactcctgggtgcgtgccctgcgttcgggaaggcaactcctcccgctgctgggtagcgctcactcccacgctcgcagccaggaacgtcaccatccccaccacgacgatacgacgccacgtcgatctgctcgttggggcggctgctttctgttccgctatgtacgtgggggacctctgcggatctgttttcctcgtctctcagctgttcaccttctcgcctcgccggcatgtgacattacaggactgtaactgctcaatttatcccggccatgtgtcgggtcaccgtatggcttgggacatgatgatgaactggtcgcccacaacagccctagtggtgtcgcagttactccggatcccacaagccgtcgtggacatggtggcgggggcccactggggagtcctggcgggccttgcctactattccatggcggggaactgggctaaggttctgattgtgatgctactttttgctggcgttgacggggatacccacgtgacagggggggcgcaagccaaaaccaccaacaggctcgtgtccatgttcgcaagtgggccgtctcagaaaatccagcttataaacaccaatgggagttggcacatcaacaggactgccctgaactgcaatgactctctccagactgggtttcttgccgcgctgttctacacacatagtttcaactcgtccgggtgcccagagcgcatggcccagtgccgcaccattgacaagttcgaccagggatggggtcccattacttatgctgagtctagcagatcagaccagaggccatattgctggcactacccacctccacaatgtaccatcgtacctgcgtcggaggtgtgcggcccagtgtactgcttcaccccaagccctgtcgtcgtggggacgaccgatcgtttcggtgtccctacgtatagatggggggagaacgagactgacgtgctgctgctcaacaacacgcggccgccgcaaggcaactggttcggctgcacatggatgaatagcaccgggttcaccaagacatgtggggggcccccgtgtaacatcgggggggtcggcaacaacaccctgacctgccccacggactgcttccggaagcaccccgaggctacctacacaaaatgtggttcggggccttggctgacacctaggtgcatggttgactatccatacaggctctggcattacccctgcactgttaactttaccatcttcaaggttaggatgtatgtggggggggtggagcacaggctcaatgctgcatgcaattggacccgaggagagcgttgtgacttggaggacagggataggccggagctcagcccgctgctgctgtctacaacagagtggcaggtactgccctgttccttcaccaccctaccagctctgtccactggcttgattcacctccatcagaacatcgtggacgtgcaatacctatacggtatagggtcagcggttgtctcctttgcaatcaaatgggagtatgtcctgttgcttttccttctcctagcggacgcacgtgtctgtgcctgcttgtggatgatgctgctgatagcccaggccgaggccgccttggagaacctggtggtcctcaattcggcgtctgtggccggcgcacatggcatcctctccttccttgtgttcttctgtgccgcctggtacatcaaaggcaggctggtccctggggcgacatatgctctttatggcgtgtggccgctgctcctgctcttgctggcattaccaccgcgagcttacgccatggaccgggagatggctgcatcgtgcggaggcgcggtttttgtgggtctggtactcctgactttgtcaccatactacaaggtgttcctcgctaggctcatatggtggttacaatattttaccaccagagccgaggcggacttacatgtgtggatcccccccctcaacgctcggggaggccgcgatgccatcatcctcctcatgtgcgcagtccatccagagctaatctttgacatcaccaaacttctaattgccatactcggtccgctcatggtgctccaagctggcataaccagagtgccgtacttcgtgcgcgctcaagggctcattcatgcatgcatgttagtgcggaaggtcgctgggggtcattatgtccaaatggccttcatgaagctgggcgcgctgacaggcacgtacatttacaaccatcttaccccgctacgggattggccacgcgcgggcctacgagaccttgcggtggcagtggagcccgtcgtcttctccgacatggagaccaagatcatcacctggggagcagacaccgcggcgtgtggggacatcatcttgggtctgcccgtctccgcccgaaggggaaaggagatactcctgggcccggccgatagtcttgaagggcgggggttgcgactcctcgcgcccatcacggcctactcccaacagacgcggggcctacttggttgcatcatcactagccttacaggccgggacaagaaccaggtcgagggagaggttcaggtggtttccaccgcaacacaatccttcctggcgacctgcgtcaacggcgtgtgttggaccgtttaccatggtgctggctcaaagaccttagccgcgccaaaggggccaatcacccagatgtacactaatgtggaccaggacctcgtcggctggcccaagccccccggggcgcgttccttgacaccatgcacctgtggcagctcagacctttacttggtcacgagacatgctgacgtcattccggtgcgccggcggggcgacagtagggggagcctgctctcccccaggcctgtctcctacttgaagggctcttcgggtggtccactgctctgccccttcgggcacgctgtgggcatcttccgggctgccgtatgcacccggggggttgcgaaggcggtggactttgtgcccgtagagtccatggaaactactatgcggtctccggtcttcacggacaactcatcccccccggccgtaccgcagtcatttcaagtggcccacctacacgctcccactggcagcggcaagagtactaaagtgccggctgcatatgcagcccaagggtacaaggtgctcgtcctcaatccgtccgttgccgctaccttagggtttggggcgtatatgtctaaggcacacggtattgaccccaacatcagaactggggtaaggaccattaccacaggcgcccccgtcacatactctacctatggcaagtttcttgccgatggtggttgctctgggggcgcttatgacatcataatatgtgatgagtgccattcaactgactcgactacaatcttgggcatcggcacagtcctggaccaagcggagacggctggagcgcggcttgtcgtgctcgccaccgctacgcctccgggatcggtcaccgtgccacacccaaacatcgaggaggtggccctgtctaatactggagagatccccttctatggcaaagccatccccattgaagccatcagggggggaaggcatctcattttctgtcattccaagaagaagtgcgacgagctcgccgcaaagctgtcaggcctcggaatcaacgctgtggcgtattaccgggggctcgatgtgtccgtcataccaactatcggagacgtcgttgtcgtggcaacagacgctctgatgacgggctatacgggcgactttgactcagtgatcgactgtaacacatgtgtcacccagacagtcgacttcagcttggatcccaccttcaccattgagacgacgaccgtgcctcaagacgcagtgtcgcgctcgcagcggcggggtaggactggcaggggtaggagaggcatctacaggtttgtgactccgggagaacggccctcgggcatgttcgattcctcggtcctgtgtgagtgctatgacgcgggctgtgcttggtacgagctcaccccggccgagacctcggttaggttgcgggcctacctgaacacaccagggttgcccgtttgccaggaccacctggagttctgggagagtgtcttcacaggcctcacccatatagatgcacacttcttgtcccagaccaagcaggcaggagacaacttcccctacctggtagcataccaagccacggtgtgcgccagggctcaggccccacctccatcatgggatcaaatgtggaagtgtctcatacggctgaaacctacgctgcacgggccaacacccttgctgtacaggctgggagccgtccagaatgaggtcaccctcacccaccccataaccaaatacatcatggcatgcatgtcggctgacctggaggtcgtcactagcacctgggtgctggtgggcggagtccttgcagctctggccgcgtattgcctgacaacaggcagtgtggtcattgtgggtaggattatcttgtccgggaggccggccattgttcccgacagggagcttctctaccaggagttcgatgaaatggaagagtgcgcctcgcacctcccttacatcgagcagggaatgcagctcgccgagcaattcaagcagaaagcgctcgggttactgcaaacagccaccaaacaagcggaggctgctgctcccgtggtggagtccaagtggcgagcccttgagacattctgggcgaagcacatgtggaatttcatcagcgggatacagtacttagcaggcttatccactctgcctgggaaccccgcaatagcatcattgatggcattcacagcctctatcaccagcccgctcaccacccaaagtaccctcctgtttaacatcttgggggggtgggtggctgcccaactcgccccccccagcgccgcttcggctttcgtgggcgccggcatcgccggtgcggctgttggcagcataggccttgggaaggtgcttgtggacattctggcgggttatggagcaggagtggccggcgcgctcgtggcctttaaggtcatgagcggcgagatgccctccaccgaggacctggtcaatctacttcctgccatcctctctcctggcgccctggtcgtcggggtcgtgtgtgcagcaatactgcgtcgacacgtgggtccgggagagggggctgtgcagtggatgaaccggctgatagcgttcgcctcgcggggtaatcatgtttcccccacgcactatgtgcctgagagcgacgccgcagcgcgtgttactcagatcctctccagccttaccatcactcagctgctgaaaaggctccaccagtggattaatgaagactgctccacaccgtgttccggctcgtggctaagggatgtttgggactggatatgcacggtgttgactgacttcaagacctggctccagtccaagctcctgccgcagctacctggagtcccttttttctcgtgccaacgcgggtacaagggagtctggcggggagacggcatcatgcaaaccacctgcccatgtggagcacagatcaccggacatgtcaaaaacggttccatgaggatcgtcgggcctaagacctgcagcaacacgtggcatggaacattccccatcaacgcatacaccacgggcccctgcacaccctctccagcgccaaactattctagggcgctgtggcgggtggccgctgaggagtacgtggaggtcacgcgggtgggggatttccactacgtgacgggcatgaccactgacaacgtaaagtgcccatgccaggttccggctcctgaattcttctcggaggtggacggagtgcggttgcacaggtacgctccggcgtgcaggcctctcctacgggaggaggttacattccaggtcgggctcaaccaatacctggttgggtcacagctaccatgcgagcccgaaccggatgtagcagtgctcacttccatgctcaccgacccctcccacatcacagcagaaacggctaagcgtaggttggccagggggtctcccccctccttggccagctcttcagctagccagttgtctgcgccttccttgaaggcgacatgcactacccaccatgtctctccggacgctgacctcatcgaggccaacctcctgtggcggcaggagatgggcgggaacatcacccgcgtggagtcggagaacaaggtggtagtcctggactctttcgacccgcttcgagcggaggaggatgagagggaagtatccgttccggcggagatcctgcggaaatccaagaagttccccgcagcgatgcccatctgggcgcgcccggattacaaccctccactgttagagtcctggaaggacccggactacgtccctccggtggtgcacgggtgcccgttgccacctatcaaggcccctccaataccacctccacggagaaagaggacggttgtcctaacagagtcctccgtgtcttctgccttagcggagctcgctactaagaccttcggcagctccgaatcatcggccgtcgacagcggcacggcgaccgcccttcctgaccaggcctccgacgacggtgacaaaggatccgacgttgagtcgtactcctccatgcccccccttgagggggaaccgggggaccccgatctcagtgacgggtcttggtctaccgtgagcgaggaagctagtgaggatgtcgtctgctgctcaatgtcctacacatggacaggcgccttgatcacgccatgcgctgcggaggaaagcaagctgcccatcaacgcgttgagcaactctttgctgcgccaccataacatggtttatgccacaacatctcgcagcgcaggcctgcggcagaagaaggtcacctttgacagactgcaagtcctggacgaccactaccgggacgtgctcaaggagatgaaggcgaaggcgtccacagttaaggctaaactcctatccgtagaggaagcctgcaagctgacgcccccacattcggccaaatccaagtttggctatggggcaaaggacgtccggaacctatccagcaaggccgttaaccacatccactccgtgtggaaggacttgctggaagacactgtgacaccaattgacaccaccatcatggcaaaaaatgaggttttctgtgtccaaccagagaaaggaggccgtaagccagcccgccttatcgtattcccagatctgggagtccgtgtatgcgagaagatggccctctatgatgtggtctccacccttcctcaggtcgtgatgggctcctcatacggattccagtactctcctgggcagcgagtcgagttcctggtgaatacctggaaatcaaagaaaaaccccatgggcttttcatatgacactcgctgtttcgactcaacggtcaccgagaacgacatccgtgttgaggagtcaatttaccaatgttgtgacttggcccccgaagccagacaggccataaaatcgctcacagagcggctttatatcgggggtcctctgactaattcaaaagggcagaactgcggttatcgccggtgccgcgcgagcggcgtgctgacgactagctgcggtaacaccctcacatgttacttgaaggcctctgcagcctgtcgagctgcgaagctccaggactgcacgatgctcgtgaacggagacgacctcgtcgttatctgtgaaagcgcgggaacccaagaggacgcggcgagcctacgagtcttcacggaggctatgactaggtactccgccccccccggggacccgccccaaccagaatacgacttggagctgataacatcatgttcctccaatgtgtcggtcgcccacgatgcatcaggcaaaagggtgtactacctcacccgtgatcccaccacccccctagcacgggctgcgtgggagacagctagacacactccagttaactcctggctaggcaacattattatgtatgcgcccactttgtgggcaaggatgattctgatgactcacttcttctccatccttctagcgcaggagcaacttgaaaaagccctggactgccagatctacggggcctgttactccattgagccacttgacctacctcagatcattgaacgactccatggccttagcgcattttcactccatagttactctccaggtgagatcaatagggtggcttcatgcctcaggaaacttggggtaccacccttgcgagtctggagacatcgggccaggagcgtccgcgctaggctactgtcccagggagggagggccgccacttgtggcaaatacctcttcaactgggcagtaaaaaccaaacttaaactcactccaatcccggctgcgtcccggctggacttgtccggctggttcgttgctggttacagcgggggagacatatatcacagcctgtctcgtgcccgaccccgttggttcatgctgtgcctactcctactttctgtaggggtaggcatctacctgctccccaaccgatgaacggggagataaacactccaggccaataggccatccccctttttttttttt

SEQ ID NO: 794 - DNA, 9401 bp, Hepatitis C Virus
gccagccccctgatgggggcgacactccaccatgaatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaaaaaaaaacaaacgtaacaccaaccgtcgcccacaggacgtcaagttcccgggtggcggtcagatcgttggtggagtttacttgttgccgcgcaggggccctagattgggtgtgcgcgcgacgagaaagacttccgagcggtcgcaacctcgaggtagacgtcagcctatccccaaggctcgtcggcccgagggcaggacctgggctcagcccgggtacccttggcccctctatggcaatgagggctgcgggtgggcgggatggctcctgtctccccgtggctctcggcctagctggggccccacagacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttctggaagacggcgtgaactatgcaacagggaaccttcctggttgctctttctctatcttccttctggccctgctctcttgcttgactgtgcccgcttcggcctaccaagtgcgcaactccacggggctttaccacgtcaccaatgattgccctaactcgagtattgtgtacgaggcggccgatgccatcctgcacactccggggtgcgtcccttgcgttcgtgagggcaacgcctcgaggtgttgggtggcgatgacccctacggtggccaccagggatggcaaactccccgcgacgcagcttcgacgtcacatcgatctgcttgtcgggagcgccaccctctgttcggccctctacgtgggggacctatgcgggtctgtctttcttgtcggccaactgttcaccttctctcccaggcgccactggacgacgcaaggttgcaattgctctatctatcccggccatataacgggtcaccgcatggcatgggatatgatgatgaactggtcccctacgacggcgttggtaatggctcagctgctccggatcccacaagccatcttggacatgatcgctggtgctcactggggagtcctggcgggcatagcgtatttctccatggtggggaactgggcgaaggtcctggtagtgctgctgctatttgccggcgtcgacgcggaaacccacgtcaccgggggaagtgccggccacactgtgtctggatttgttagcctcctcgcaccaggcgccaagcagaacgtccagctgatcaacaccaacggcagttggcacctcaatagcacggccctgaactgcaatgatagcctcaacaccggctggttggcagggcttttctatcaccacaagttcaactcttcaggctgtcctgagaggctagccagctgccgaccccttaccgattttgaccagggctggggccctatcagttatgccaacggaagcggccccgaccagcgcccctactgctggcactaccccccaaaaccttgcggtattgtgcccgcgaagagtgtgtgtggtccggtatattgcttcactcccagccccgtggtggtgggaacgaccgacaggtcgggcgcgcccacctacagctggggtgaaaatgatacggacgtcttcgtccttaacaataccaggccaccgctgggcaattggttcggttgtacctggatgaactcaactggattcaccaaagtgtgcggagcgcctccttgtgtcatcggaggggcgggcaacaacaccctgcactgccccactgattgcttccgcaagcatccggacgccacatactctcggtgcggctccggtccctggatcacacccaggtgcctggtcgactacccgtataggctttggcattatccttgtaccatcaactacaccatatttaaaatcaggatgtacgtgggaggggtcgaacacaggctggaagctgcctgcaactggacgcggggcgaacgttgcgatctggaagacagggacaggtccgagctcagcccgttactgctgaccactacacagtggcaggtcctcccgtgttccttcacaaccctaccagccttgtccaccggcctcatccacctccaccagaacattgtggacgtgcagtacttgtacggggtggggtcaagcatcgcgtcctgggccattaagtgggagtacgtcgttctcctgttccttctgcttgcagacgcgcgcgtctgctcctgcttgtggatgatgctactcatatcccaagcggaggcggctttggagaacctcgtaatacttaatgcagcatccctggccgggacgcacggtcttgtatccttcctcgtgttcttctgctttgcatggtatttgaagggtaagtgggtgcccggagcggtctacaccttctacgggatgtggcctctcctcctgctcctgttggcgttgccccagcgggcgtacgcgctggacacggaggtggccgcgtcgtgtggcggtgttgttctcgtcgggttgatggcgctgactctgtcaccatattacaagcgctatatcagctggtgcttgtggtggcttcagtattttctgaccagagtggaagcgcaactgcacgtgtggattccccccctcaacgtccgaggggggcgcgacgccgtcatcttactcatgtgtgctgtacacccgactctggtatttgacatcaccaaattgctgctggccgtcttcggacccctttggattcttcaagccagtttgcttaaagtaccctactttgtgcgcgtccaaggccttctccggttctgcgcgttagcgcggaagatgatcggaggccattacgtgcaaatggtcatcattaagttaggggcgcttactggcacctatgtttataaccatctcactcctcttcgggactgggcgcacaacggcttgcgagatctggccgtggctgtagagccagtcgtcttctcccaaatggagaccaagctcatcacgtggggggcagataccgccgcgtgcggtgacatcatcaacggcttgcctgtttccgcccgcaggggccgggagatactgctcgggccagccgatggaatggtctccaaggggtggaggttgctggcgcccatcacggcgtacgcccagcagacaaggggcctcctagggtgcataatcaccagcctaactggccgggacaaaaaccaagtggagggtgaggtccagattgtgtcaactgctgcccaaaccttcctggcaacgtgcatcaatggggtgtgctggactgtctaccacggggccggaacgaggaccatcgcgtcacccaagggtcctgtcatccagatgtataccaatgtagaccaagaccttgtgggctggcccgctccgcaaggtagccgctcattgacaccctgcacttgcggctcctcggacctttacctggtcacgaggcacgccgatgtcattcccgtgcgccggcggggtgatagcaggggcagcctgctgtcgccccggcccatttcctacttgaaaggctcctcggggggtccgctgttgtgccccgcggggcacgccgtgggcatatttagggccgcggtgtgcacccgtggagtggctaaggcggtggactttatccctgtggagaacctagagacaaccatgaggtccccggtgttcacggataactcctctccaccagtagtgccccagagcttccaggtggctcacctccatgctcccacaggcagcggcaaaagcaccaaggtcccggctgcatatgcagctcagggctataaggtgctagtactcaacccctctgttgctgcaacactgggctttggtgcttacatgtccaaggctcatgggatcgatcctaacatcaggaccggggtgagaacaattaccactggcagccccatcacgtactccacctacggcaagttccttgccgacggcgggtgctcggggggcgcttatgacataataatttgtgacgagtgccactccacggatgccacatccatcttgggcatcggcactgtccttgaccaagcagagactgcgggggcgagactggttgtgctcgccaccgccacccctccgggctccgtcactgtgccccatcccaacatcgaggaggttgctctgtccaccaccggagagatccctttttacggcaaggctatccccctcgaagtaatcaagggggggagacatctcatcttctgtcattcaaagaagaagtgcgacgaactcgccgcaaagctggtcgcattgggcatcaatgccgtggcctactaccgcggtcttgacgtgtccgtcatcccgaccagcggcgatgttgtcgtcgtggcaaccgatgccctcatgaccggctataccggcgacttcgactcggtgatagactgcaatacgtgtgtcacccagacagtcgatttcagccttgaccctaccttcaccattgagacaatcacgctcccccaggatgctgtctcccgcactcaacgtcggggcaggactggcagggggaagccaggcatctacagatttgtggcaccgggggagcgcccctccggcatgttcgactcgtccgtcctctgtgagtgctatgacgcaggctgtgcttggtatgagctcacgcccgccgagactacagttaggctacgagcgtacatgaacaccccggggcttcccgtgtgccaggaccatcttgaattttgggagggcgtctttacaggcctcactcatatagatgcccactttctatcccagacaaagcagagtggggagaaccttccttacctggtagcgtaccaagccaccgtgtgcgctagggctcaagcccctcccccatcgtgggaccagatgtggaagtgtttgattcgcctcaagcccaccctccatgggccaacacccctgctatacagactgggcgctgttcagaatgaaatcaccctgacgcacccagtcaccaaatacatcatgacatgcatgtcggccgacctggaggtcgtcacgagcacctgggtgctcgttggcggcgtcctggctgctttggccgcgtattgcctgtcaacaggctgcgtggtcatagtgggcagggtcgtcttgtccgggaagccggcaatcatacctgacagggaagtcctctaccgagagttcgatgagatggaagagtgctctcagcacttaccgtacatcgagcaagggatgatgctcgccgagcagttcaagcagaaggccctcggcctcctgcagaccgcgtcccgtcaggcagaggttatcgcccctgctgtccagaccaactggcaaaaactcgagaccttctgggcgaagcatatgtggaacttcatcagtgggatacaatacttggcgggcttgtcaacgctgcctggtaaccccgccattgcttcattgatggcttttacagctgctgtcaccagcccactaaccactagccaaaccctcctcttcaacatattgggggggtgggtggctgcccagctcgccgcccccggtgccgctactgcctttgtgggcgctggcttagctggcgccgccatcggcagtgttggactggggaaggtcctcatagacatccttgcagggtatggcgcgggcgtggcgggagctcttgtggcattcaagatcatgagcggtgaggtcccctccacggaggacctggtcaatctactgcccgccatcctctcgcccggagccctcgtagtcggcgtggtctgtgcagcaatactgcgccggcacgttggcccgggcgagggggcagtgcagtggatgaaccggctgatagccttcgcctcccgggggaaccatgtttcccccacgcactacgtgccggagagcgatgcagctgcccgcgtcactgccatactcagcagcctcactgtaacccagctcctgaggcgactgcaccagtggataagctcggagtgtaccactccatgctccggttcctggctaagggacatctgggactggatatgcgaggtgttgagcgactttaagacctggctaaaagctaagctcatgccacagctgcctgggatcccctttgtgtcctgccagcgcgggtataagggggtctggcgagtggacggcatcatgcacactcgctgccactgtggagctgagatcactggacatgtcaaaaacgggacgatgaggatcgtcggtcctaggacctgcaggaacatgtggagtgggaccttccccattaatgcctacaccacgggcccctgtaccccccttcctgcgccgaactacacgttcgcgctatggagggtgtctgcagaggaatatgtggagataaggcaggtgggggacttccactacgtgacgggtatgactactgacaatctcaaatgcccgtgccaggtcccatcgcccgaatttttcacagaattggacggggtgcgcctacataggtttgcgcccccctgcaagcccttgctgcgggaggaggtatcattcagagtaggactccacgaatacccggtagggtcgcaattaccttgcgagcccgaaccggacgtggccgtgttgacgtccatgctcactgatccctcccatataacagcagaggcggccgggcgaaggttggcgaggggatcacccccctctgtggccagctcctcggctagccagctatccgctccatctctcaaggcaacttgcaccgctaaccatgactcccctgatgctgagctcatagaggccaacctcctatggaggcaggagatgggcggcaacatcaccagggttgagtcagaaaacaaagtggtgattctggactccttcgatccgcttgtggcggaggaggacgagcgggagatctccgtacccgcagaaatcctgcggaagtctcggagattcgcccaggccctgcccgtttgggcgcggccggactataaccccccgctagtggagacgtggaaaaagcccgactacgaaccacctgtggtccatggctgtccgcttccacctccaaagtcccctcctgtgcctccgcctcggaagaagcggacggtggtcctcactgaatcaaccctatctactgccttggccgagctcgccaccagaagctttggcagctcctcaacttccggcattacgggcgacaatacgacaacatcctctgagcccgccccttctggctgcccccccgactccgacgctgagtcctattcctccatgccccccctggagggggagcctggggatccggatcttagcgacgggtcatggtcaacggtcagtagtgaggccaacgcggaggatgtcgtgtgctgctcaatgtcttactcttggacaggcgcactcgtcaccccgtgcgccgcggaagaacagaaactgcccatcaatgcactaagcaactcgttgctacgtcaccacaatttggtgtattccaccacctcacgcagtgcttgccaaaggcagaagaaagtcacatttgacagactgcaagttctggacagccattaccaggacgtactcaaggaggttaaagcagcggcgtcaaaagtgaaggctaacttgctatccgtagaggaagcttgcagcctgacgcccccacactcagccaaatccaagtttggttatggggcaaaagacgtccgttgccatgccagaaaggccgtaacccacatcaactccgtgtggaaagaccttctggaagacaatgtaacaccaatagacactaccatcatggctaagaacgaggttttctgcgttcagcctgagaaggggggtcgtaagccagctcgtctcatcgtgttccccgatctgggcgtgcgcgtgtgcgaaaagatggctttgtacgacgtggttacaaagctccccttggccgtgatgggaagctcctacggattccaatactcaccaggacagcgggttgaattcctcgtgcaagcgtggaagtccaagaaaaccccaatggggttctcgtatgatacccgctgctttgactccacagtcactgagagcgacatccgtacggaggaggcaatctaccaatgttgtgacctcgacccccaagcccgcgtggccatcaagtccctcaccgagaggctttatgttgggggccctcttaccaattcaaggggggagaactgcggctatcgcaggtgccgcgcgagcggcgtactgacaactagctgtggtaacaccctcacttgctacatcaaggcccgggcagcctgtcgagccgcagggctccaggactgcaccatgctcgtgtgtggcgacgacttagtcgttatctgtgaaagcgcgggggtccaggaggacgcggcgagcctgagagccttcacggaggctatgaccaggtactccgccccccctggggaccccccacaaccagaatacgacttggagctcataacatcatgctcctccaacgtgtcagtcgcccacgacggcgctggaaagagggtctactacctcacccgtgaccctacaacccccctcgcgagagctgcgtgggagacagcaagacacactccagtcaattcctggctaggcaacataatcatgtttgcccccacactgtgggcgaggatgatactgatgacccatttctttagcgtccttatagccagggaccagcttgaacaggccctcgattgcgagatctacggggcctgctactccatagaaccacttgatctacctccaatcattcaaagactccatggcctcagcgcattttcactccacagttactctccaggtgaaattaatagggtggccgcatgcctcagaaaacttggggtaccgcccttgcgagcttggagacaccgggcccggagcgtccgcgctaggcttctggccagaggaggcagggctgccatatgtggcaagtacctcttcaactgggcagtaagaacaaagctcaaactcactccaatagcggccgctggccagctggacttgtccggctggttcacggctggctacagcgggggagacatttatcacagcgtgtctcatgcccggccccgctggatctggttttgcctactcctgcttgctgcaggggtaggcatctacctcctccccaaccgatgaaggttggggtaaacactccggcct

SEQ ID NO: 795 - DNA, 9416 bp, Hepatitis C Virus
gccagccccctgatgggggcgacactccaccatgaatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggataaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgtcgcccacaggacgtcaagttcccgggtggcggtcagatcgttggtggagtttacttgttgccgcgcaggggccctagattgggtgtgcgcgcgacgaggaagacttccgagcggtcgcaacctcgaggtagacgtcagcctatccccaaggcacgtcggcccgagggcaggacctgggctcagcccgggtacccttggcccctctatggcaatgagggttgcgggtgggcgggatggctcctgtctccccgtggctctcggcctagctggggccccacagacccccggcgtaggtcgcgcaatttgggtaaggtcatcgatacccttacgtgcggcttcgccgacctcatggggtacataccgctcgtcggcgcccctcttggaggcgctgccagggccctggcgcatggcgtccgggttctggaagacggcgtgaactatgcaacagggaaccttcctggttgctctttctctatcttccttctggccctgctctcttgcctgactgtgcccgcttcagcctaccaagtgcgcaattcctcggggctttaccatgtcaccaatgattgccctaactcgagtgttgtgtacgaggcggccgatgccatcctgcacactccggggtgtgtcccttgcgttcgcgagggtaacgcctcgaggtgttgggtggcggtgacccccacggtggccaccagggacggcaaactccccacaacgcagcttcgacgtcatatcgatctgcttgtcgggagcgccaccctctgctcggccctctacgtgggggacctgtgcgggtctgtctttcttgttggtcaactgtttaccttctctcccaggcaccactggacgacgcaagactgcaattgttctatctatcccggccatataacgggtcatcgcatggcatggaatatgatgatgaactggtcccctacggcagcgttggtggtagctcagctgctccgaatcccacaagccatcatggacatgatcgctggcgcccactggggagtcctggcgggcataaagtatttctccatggtggggaactgggcgaaggtcctggtagtgctgctgctatttgccggcgtcgacgcggaaacccacgtcaccgggggaaatgccggccgcaccacggctgggcttgttggtctccttacaccaggcgccaagcagaacatccaactgatcaacaccaacggcagttggcacatcaatagcacggccttgaactgcaatgaaagccttaacaccggctggttagcagggctcttctatcagcacaaattcaactcttcaggctgtcctgagaggttggccagctgccgacgccttaccgattttgcccagggctggggtcctatcagttatgccaacggaagcggcctcgacgaacgcccctactgctggcactaccctccaagaccttgtggcattgtgcccgcaaagagcgtgtgtggcccggtatattgcttcactcccagccccgtggtggtgggaacgaccgacaggtcgggcgcgcctacctacagctggggtgcaaatgatacggatgtcttcgtccttaacaacaccaggccaccgctgggcaattggttcggttgtacctggatgaactcaactggattcaccaaagtgtgcggagcgcccccttgtgtcatcggaggggtgggcaacaacaccttgctctgccccactgattgcttccgcaaatatccggaagccacatactctcggtgcggctccggtcccaggattacacccaggtgcatggtcgactacccgtataggctttggcactatccttgtaccatcaattacaccatattcaaagtcaggatgtacgtgggaggggtcgagcacaggctggaagcggcctgcaactggacgcggggcgaacgctgtgatctggaagacagggacaggtccgagctcagcccgttgctgctgtccaccacacagtggcaggtccttccgtgttctttcacgaccctgccagccttgtccaccggcctcatccacctccaccagaacattgtggacgtgcagtacttgtacggggtagggtcaagcatcgcgtcctgggccattaagtgggagtacgtcgttctcctgttccttctgcttgcagacgcgcgcgtctgttcctgcttgtggatgatgttactcatatcccaagcggaggcggctttggagaacctcgtaatactcaatgcagcatccctggccgggacgcatggtcttgtgtccttcctcgtgttcttctgctttgcgtggtatctgaagggtaggtgggtgcccggagcggtctacgccctctacgggatgtggcctctcctcctgctcctgctggcgttgcctcagcgggcatacgcactggacacggaggtggccgcgtcgtgtggcggcgttgttcttgtcgggttaatggcgctgactctgtcgccatattacaagcgctatatcagctggtgcatgtggtggcttcagtattttctgaccagagtagaagcgcaactgcacgtgtgggttccccccctcaacgtccggggggggcgcgatgccgtcatcttactcacgtgtgtagtacacccggccctggtatttgacatcaccaaactactcctggccatcttcggacccctttggattcttcaagccagtttgcttaaagtcccctacttcgtgcgcgttcaaggccttctccggatctgcgcgctagcgcggaagatagccggaggtcattacgtgcaaatggccatcatcaagttaggggcgcttactggcacctgtgtgtataaccatctcgctcctcttcgagactgggcgcacaacggcctgcgagatctggccgtggctgtggaaccagtcgtcttctcccgaatggagaccaagctcatcacgtggggggcagataccgccgcgtgcggtgacatcatcaacggcttgcccgtctctgcccgtaggggccaggagatactgcttgggccagccgacggaatggtctccaaggggtggaggttgctggcgcccatcacggcgtacgcccagcagacgagaggcctcctagggtgtataatcaccagcctgactggccgggacaaaaaccaagtggagggtgaggtccagatcgtgtcaactgctacccagaccttcctggcaacgtgcatcaatggggtatgctggactgtctaccacggggccggaacgaggaccatcgcatcacccaagggtcctgtcatccagacgtataccaatgtggatcaagacctcgtgggctggcccgctcctcaaggttcccgctcattgacaccctgcacctgcggctcctcggacctttacctggtcacgaggcacgccgatgtcattcccgtgcgccggcgaggtgatagcaggggtagcctgctttcgccccggcccatttcctacttgaaaggctcctcggggggtccgctgttgtgccccacgggacacgccgtgggcctattcagggccgcggtgtgcacccgtggagtggctaaggcggtggactttatccctgtggagaacctagagacaaccatgagatccccggtgttcacggacaactcctctccaccagcagtgccccagagcttccaggtggcccacctgcatgctcccaccggcagcggtaagagcaccaaggtcccggctgcgtacgcagccaagggctacaaggtgttggtgctcaacccctctgttgctgcaacactgggctttggtgcttacatgtccaaggcccatggggttgatcctaatatcaggaccggggtgagaacaattaccactggcagccccatcacgtactccacctacggcaagttccttgccgacgccgggtgctcaggaggtgcttatgacataataatttgtgacgagtgccactccacggatgccacatccatctcgggcatcggcactgtccttgaccaagcagagactgcgggggcgagactggttgtgctcgccactgctacccctccgggctccgtcactgtgtcccatcctaacatcgaggaggttgctctgtccaccaccggagagatccccttttacggcaaggctatccccctcgaggtgatcaaggggggaagacatctcatcttctgccactcaaagaagaagtgcgacgagctcgccgcgaagctggtcgcattgggcatcaatgccgtggcctactaccgcggtcttgacgtgtctgtcatcccgaccagcggcgatgttgtcgtcgtgtcgaccgatgctctcatgactggctttaccggcgacttcgactctgtgatagactgcaacacgtgtgtcactcagacagtcgattttagccttgaccctacctttaccattgagacaaccacgctcccccaggatgctgtctccaggactcaacgccggggcaggactggcagggggaagccaggcatctatagatttgtggcaccgggggagcgcccctccggcatgttcgactcgtccgtcctctgtgagtgctatgacgcgggctgtgcttggtatgagctcacgcccgccgagactacagttaggctacgagcgtacatgaacaccccggggcttcccgtgtgccaggaccatcttggattttgggagggcgtctttacgggcctcactcatatagatgcccactttctatcccagacaaagcagagtggggagaactttccttacctggtagcgtaccaagccaccgtgtgcgctagggctcaagcccctcccccatcgtgggaccagatgcggaagtgtttgatccgccttaaacccaccctccatgggccaacacccctgctatacagactgggcgctgttcagaatgaagtcaccctgacgcacccaatcaccaaatacatcatgacatgcatgtcggccgacctggaggtcgtcacgagcacctgggtgctcgttggcggcgtcctggctgctctggccgcgtattgcctgtcaacaggctgcgtggtcatagtgggcaggatcgtcttgtccgggaagccggcaattatacctgacagggaggttctctaccaggagttcgatgagatggaagagtgctctcagcacttaccgtacatcgagcaagggatgatgctcgctgagcagttcaagcagaaggccctcggcctcctgcagaccgcgtcccgccatgcagaggttatcacccctgctgtccagaccaactggcagaaactcgaggtcttttgggcgaagcacatgtggaatttcatcagtgggatacaatacttggcgggcctgtcaacgctgcctggtaaccccgccattgcttcattgatggcttttacagctgccgtcaccagcccactaaccactggccaaaccctcctcttcaacatattgggggggtgggtggctgcccagctcgccgcccccggtgccgctaccgcctttgtgggcgctggcttagctggcgccgcactcgacagcgttggactggggaaggtcctcgtggacattcttgcaggctatggcgcgggcgtggcgggagctcttgtggcattcaagatcatgagcggtgaggtcccctccacggaggacctggtcaatctgctgcccgccatcctctcacctggagcccttgcagtcggtgtggtctttgcatcaatactgcgccggcgtgttggcccgggcgagggggcagtgcaatggatgaaccggctaatagccttcgcctcccgggggaaccatgtttcccccacacactacgtgccggagagcgatgcagccgcccgcgtcactgccatactcagcagcctcactgtaacccagctcctgaggcgactgcatcagtggataagctcggagtgtaccactccatgctccggttcctggctaagggacatctgggactggatatgcgaggtgctgagcgactttaagacctggctgaaagccaagctcatgccacaactgcctgggattccctttgtgtcctgccagcgcgggtataggggggtctggcgaggagacggcattatgcacactcgctgccactgtggagctgagatcactggacatgtcaaaaacgggacgatgaggatcgtcggtcctaggacctgcaagaacatgtggagtgggacgttcttcattaatgcctacaccacgggcccctgtactccccttcctgcgccgaactataagttcgcgctgtggagggtgtctgcagaggaatacgtggagataaggcgggtgggggacttccactacgtatcgggcatgactactgacaatctcaaatgcccgtgccagatcccatcgcccgaatttttcacagaattggacggggtgcgcctacataggtttgcgcccccttgcaagcccttgctgcgggaggaggtatcattcagagtaggactccacgagtacccggtggggtcgcaattaccttgcgagcccgaaccggacgtagccgtgttgacgtccatgctcactgatccctcccatataacagcagaggcggccgggagaaggttggcgagagggtcacccccttctatggccagctcctcggctagccagctgtccgctccatctctcaaggcaacttgcaccgccaaccatgactcccctgacgccgagctcatagaggctaacctcctgtggaggcaggagatgggcggcaacatcaccagggttgagtcagagaacaaagtggtgattctggactccttcgatccgcttgtggcagaggaggatgagcgggaggtctccgtacccgcagaaattctgcggaagtctcggagattcgccccagccctgcccgtctgggcgcggccggactacaaccccctgctagtagagacgtggaaaaagcctgactacgaaccacctgtggtccatggctgcccgctaccacctccacggtcccctcctgtgcctccgcctcggaaaaagcgtacggtggtcctcaccgaatcaaccctacctactgccttggccgagcttgccaccaaaagttttggcagctcctcaacttccggcattacgggcgacaatacgacaacatcctctgagcccgccccttctggctgcccccccgactccgacgttgagtcctattcttccatgccccccctggagggggagcctggggatccggatctcagcgacgggtcatggtcgacggtcagtagtggggccgacacggaagatgtcgtgtgctgctcaatgtcttattcctggacaggcgcactcgtcaccccgtgcgctgcggaggaacaaaaactgcccatcaacgcactgagcaactcgttgctacgccatcacaatctggtgtattccaccacttcacgcagtgcttgccaaaggaagaagaaagtcacatttgacagactgcaagttctggacagccattaccaggacgtgctcaaggaggtcaaagcagcggcgtcaaaagtgaaggctaacttgctatccgtagaggaagcttgcagcctggcgcccccacattcagccaaatccaagtttggctatggggcaaaagacgtccgttgccatgccagaaaggccgtagcccacatcaactccgtgtggaaagaccttctggaagacagtgtaacaccaatagacactaccatcatggccaagaacgaggttttctgcgttcagcctgagaaggggggtcgtaagccagctcgtctcatcgtgttccccgacctgggcgtgcgcgtgtgcgagaagatggccctgtacgacgtggttagcaagctccccttggccgtgatgggaagctcctacggattccaatactcaccaggacagcgggttgaattcctcgtgcaagcgtggaagtccaagaagaccccgatggggctctcgtatgatacccgctgttttgactccacagtcactgagagcgacatccgtacggaggaggcaatttaccaatgttgtgacctggacccccaagcccgcgtggccatcaagtccctcactgagaggctttatgttgggggccctcttactaattcaaggggggaaaactgcggctaccgcaggtgccgcgcgagcagagtactgacaactagctgtggtaacaccctcactcgctacatcaaggcccgggcagcctgtcgagccgcagggctccaggactgcaccatgctcgtgtgtggcgacgacttagtcgttatctgtgaaagtgcgggggtccaggaggacgcggcgagcctgagagccttcacggaggctatgaccaggtactccgccccccccggggaccccccacaaccagaatacgacttggagcttataacatcatgctcctccaacgtgtcagtcgcccacgacggcgctggaaagagggtctactaccttacccgtgaccctacaacccccctcgcgagagccgcgtgggagacagcaagacacactccagtcaattcctggctaggcaacataatcatgtttgcccccacactgtgggcgaggatgatactgatgacccacttctttagcgtcctcatagccagggatcagcttgaacaggctctcaactgcgagatctacggagcctgctactccatagaaccactggatctacctccaatcattcaaagactccatggcctcagcgcattttcactccacagttactctccaggtgaaattaatagggtggccgcatgcctcagaaaacttggggtcccgcccttgcgagcttggagacaccgggcctggagcgtccgcgctaggcttctggccagaggaggcaaggctgccatatgtggcaagtacctcttcaactgggcagtaagaacaaagctcaaactcactccgataacggccgctggccggctggacttgtccggctggttcacggctggctacagcgggggagacatttatcacagcgtgtctcatgcccggccccgctggttctggttttgcctactcctgcttgctgcaggggtaggcatctacctcctccccaaccgatgaagattgggctaaccactccaggccaataggccattccct

SEQ ID NO: 796 - DNA, 9425 bp, Hepatitis C Virus
gccagcccccgattgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatggtaaacctcaaagaaaaaccaaacgtaacaccaaccgccgcccacaggacgtcaagttcccgggcggtggtcagatcgttggtggagtttacctgttgccgcgcaggggcccaaggttgggtgtgcgcgcgactaggaagacttgggagcggtcgcaacctcgtggaaggcgacaacctatccccaaggctcgccagcccgagggcagggcctgggctcagcccgggtacccttggcccctttatggcaatgagggcttggggtgggcaggatggctggtgtcaccccgcggctctcggcctaattggggccccacggacccccggcgtaggtcgcgtaatttgggtaaagtcatcgacaccctcacatgcggcttcgccgacctcatggggtacatcccgctcgtcggcgcccccttggggggcgtagccagagccctggcacatggtgtccgggttctggaggacggcgtgaactatgcaacagggaatctgcccggttgctctttctctatcttcctcttggctctgctgtcctgtttgaccatcccagcttccgcttatgaagtgcacaacgtgtccgggatataccatgtcacgaacgactgctccaactcaagcattgtgtatgaggcagcggacatgatcatgcatacccccgggtgcgtgccctgcgtgcgggaaaacaactcctcccgttgctgggtagcgctcacccccacgctcgcggccaggaacaacagcgtccccactgcgacaatacgacgccatgtcgacttgctcgttggggcggctgctttctgttccgctatgtacgtgggggatctctgcggatctgtttttctcgtctcccagctgttcaccttctcgcctcgccggtatgagacagtacaggactgcaattgctcaatctatcccggccacgtaacaggccaccgcatggcttgggacatgatgatgaactggtcgcctacgacagccttagtggtgtcgcagttgctccggatccctcaagctgtcgtggatatggtggggggggcccactggggagtcctggcgggccttgcctactattccatggtggggaactgggctaaggttctaattgtgatgctactttttgccggcgttgacgggagtaccatcgtgtcaggagggacagtggcccgcaccacccacagtctcgcgtctctctttacacaaggggcgtcccagaaaatccagcttataaacaccaatggcagctggcacatcaacaggactgccttaaactgcaacgactccctccagactgggtttcttgcctcgctgttctacgcgcacaggttcaacgcgtccgggtgcccagagcgcatggccagctgccgttccattgacaagttcgatcagggatggggtcccatcacctatactgaggctgacatccaggaccagaggccttattgctggcactacgcaccccggccgtgtggtatcgtacccgcgtcgcaggtgtgtggtccggtgtattgcttcaccccaagccccgttgtggtggggacgaccgaccgtttcggtgcccctacgtatagctggggggagaatgagacggacgtgctgatccttaacaacacacggccgccgcaaggcaactggttcggctgtacatggatgaatagcactgggttcaccaagacgtgcgggggccccccgtgtaacatcggggggggcggcaacaacaccttggtctgccccacggattgcttccggaagcaccccgaggccacttatacaaaatgtggttcggggccctggttaacacctaggtgcatggttgactacccatacaggctctggcactacccctgtactgttaactttaccatcttcaaagttaggatgtatgtggggggcgtagagcacaggctcaacgctgcatgcaattggacccgaggagagcgttgtgatttggaggacagggataggtcagagctcagccctctgttgttatctacgacggagtggcagatactgccctgttccttcaccggcctaccggctctgtccactggcttgatccatctccatcagaatgtcgtggacgtgcaatacctgtatggtatagggtcagcggttgtctccttcgcaatcaaatgggagtatatcctgttgcttttcctcctcctggcggacgcgcgcgtctgtgcctgcttgtggatgatgctgctaatagcccaggctgaggccgctttagagaacttagtggtcttcaatgcagcgtccgtggccggaatgcatggcaccctctccttccttgtatttttctgtgctgcctggtacatcaagggcaggttggtccctggggcggcatacgctctctatggtgtatggccgctgctcctgctcctgctagcgctaccgcctcgagcgtacgctatggaccgggagatggctgcatcgtgcggaggcgcggtttttgtaggtctggtgcttctgaccttgtcaccacactataaaatgttcctcgccaggctcatatggtggttgcaatattttatcaccagggccgaggcgcacttgcaagtgtggattcccccccttaacgttcgggggggtcgcgatgccatcatcctcctcacgtgtgcggcctacccagagctaatctttgacatcaccaaaatcttgctcgccatactcggtccgcttatggtgcttcaggctggcctaaccagaataccgtactttgtacgcgctcaggggctcattcgtgcatgtatgttggtgcggaaagccgccgggggtcattatgtccaaatggctctcatgaagctggccgcgctaacaggcacgtacgtttatgaccatctcaccccactgcaggactgggcccacacgggcctacgggatcttgcggtggcggtcgagcctgtcgtcttctctgacatggagaccaagatcattacctggggggcagacaccgcggcgtgtggggatatcatcttgggtctacccgtctccgctcgaagggggcgggagatacttttggggccggccgatagccttgaagggcgggggtggcgactccttgcgcccatcactgcctacgctcaacagacgcggggtctgtttggttgcatcatcactagcctcacaggccgggacaagaaccaggtcgagggggaggttcaagtggtttccaccgcaacgcaatctttcctggcgacctgtatcaacggcgtgtgctggactgtctaccatggtgccggctcaaagaccctagccggcccaaagggtccaatcacccaaatgtacaccaatgtagaccaagacctcgtcggctggcatgcgcctcagggggcgcgttccctgacaccatgcacctgtggcagctcagacctttatttggtcacgagacatgctgacgtcattccggtgcgtcggcggggtgacagcaggggaagcctactctcccccaggcccatctcctacctgaagggttcttcgggcggtccactgctctgtccctcggggcatgttgtgggcatcttccgggctgctgtgtgcacccggggggttgcgaaggcggtggactttgtgcccgttgagtctatggaaactaccatgcggtccccggtcttcacggacaattcgtctcccccggccgtaccgcaggcgttccaagtggcccatctacacgctcccactggcagcggcaagagcactaaggtgccggctgcatatgcagcccaagggtacaaggtgcttgtcttaaatccatctgttgccgccaccttaggttttggggcgtatatgtctaaggcacatggtgtcgaccctaacattagaactggggtaaggaccatcaccacgggcgctcccatcacgtactccacctatggcaagttccttgccgacggtggctgctctgggggcgcctatgacatcataatgtgtgatgagtgccactcaactgactcgactaccatcttgggcatcggcacagtcctagaccaagcggagacggctggagcgcggctcgtcgtgctcgccaccgctacgcctccgggatcggtcaccgtgccgcatcctaacattgaggaaatagccctgtccaacactggagagatccccttctatggcaaagccatccccatcgagaccatcaagggggggaggcatctcatcttctgccattccaagaagaaatgtgacgagctcgctgctaagctgtcggccctcggaattcatgctgtagcatattaccggggtcttgatgtgtccgtcataccggctagcgggaatgtcgttgtcgtggcaacggacgctctaatgacaggctttaccggcgactttgactcggtgatcgactgtaacacgtgtgtcacccagacagtcgacttcagcttggaccctaccttcaccattgagacgacgaccatgccccaagacgcggtgtcacgctcgcagcggcgaggcaggactagtaggggcaggagaggcatctacaggttcgtgactccaggagaacggccctcgggcatgttcgattcttcggtcctgtgcgagtgctatgacgcgggctgtgcttggtacgagctcacacccgccgagacctcggttaggttgcgggcttacctaaatacaccagggttgcccgtttgccaggaccatctggagttctgggagagcgtcttcacaggccttacccacatagatgcccatttcttgtcccagactaagcaggcaggagacaacttcccctacctggtagcataccaagcaacggtgtgtgccagggctcaggctccgcctccatcatgggaccaaatgtggaagtgtctcacacggctaaaacccacactacacgggccaacacccctgttgtacagactgggagccgtccaaaatgaggtcaccctcacgcaccccataaccaaatacatcatggcatgcatgtcggccgacctcgaggtcgtcacgagcacctgggtgctggtaggcggagtccttgcagcgttggccgcgtactgcctgacaacaggtagcgtggtcattgtgggcagaatcatcttgtccgggaagccggctgttgttcccgacagggaagtcctctaccaggagttcgatgagatggaagagtgtgcttcacacctcccctacatcgaacagggaatgcagctcgccgagcaattcaagcagaaggcgctcgggttgctgcagacggccaccaagcaagcagaggctgctgctcccgtggtggagtccaagtggcgaacccttgaggccttttgggcgaacgacatgtggaatttcatcagcgggatacagtacttggcaggcttgtctaccctgcctgggaatcccgcaatagcatcactgatggcattcacagcctccatcaccagcccgcttaccacccaaagcaccctcctgtttaacatcttgggaggatgggtggctgcccaactcgctccccccggcgctgcttcggccttcgtgggcgccggcattgccggggcggctgttggcagtataggccttgggaaggtgcttgtagacatggtggcgggttacggagctggggtggcgggcgcactcgtggccttcaaggtcatgagcggcgaaatgccctccaccgaggacctggtcaacttactccctgccatcctctctcctggtgctctggtcgttggggtcgtgtgcgcagcaatactgcgtcggcatgtggacccaggagagggggctgtgcagtggatgaaccggctgatagcgttcgcctcgcggggtaaccacgtctcccccacgcactatgtgcccgagagcgacgccgcggcgcgtgtcactcaaatcctctccggccttaccatcacccagctgttgaggaggctccaccagtggattaatgaggactgctccacaccatgctccggctcgtggctaagggatgtttgggactggatatgcacggtgttggctgacttcaagacctggctccagtccaagctcctgccacggctgccaggagtcccctttttctcatgccaacgtgggtacaagggagtctggcggggagacggcatcatgcaaaccacctgcccatgtggagcgcagctcaccggacatgtcaagaacggttccatgaggatctggggccccaaaacctgtagcaacacgtggcacggaacattccccatcaacgcatacaccacgggcccctgcacaccctccccggcgccaaactattccagggcgctatggcgggtggccgctgaggagtacgtggaggttaggcgggtgggggatttccactacgtgacgggcatgaccactgacaacgtaaagtgcccatgccaggttccggcccccgaattcttcacggaggtggatggggtgcggctgcacagatacgctccggcatgtaaacctctcctacgggaggaggtctcattccaggtcgggctcaaccaatacgtggttgggtcacagctcccatgcgagcccgaaccggacgtagcagtgcttacttccatgctcaccgacccctcccacattacagcagagacggctaagcgtaggctggccagggggtctcccccctccttggccagctcttcagctagccagttgtctgcactttctctgaaagcggcgtgcaccacccgtcatacccccccagacgctgacctcattgaggccaacctcctgtggcggcaggagatgggcggaaacatcacccgcgtggagtcagagaataaggtagtaatcctggactctttcgacccgctccgagcggaggaggacgagagggaagtatccgttccggcggagatcctgcggaaatccaggaagttccctccagcgttgcccgtatgggcacgcccggattacaaccctccattgctagagccctggaaagacccggactacgtccctccagtggtacacgggtgccccttgccacctgtcaaggcccctccaataccacctccacggagaaagaggacggttgtcctgacagagtccactgtgtcttctgctttggcagagcttgctacaaagaccttcggcagttccgaatcgtcggccgctggtagcggcacggcgaccgcccctcctgatcagccctccgacgacggcgacgcaggatccgacgttgaatcgtgctcctctatgcccccccttgagggggagccgggggaccccgatctcagcgacgggtcttggtctaccgtgagcgaggaggatggtgagggcgtcatctgctgctcgatgtcctacacatggacaggcgccttgatcacgccatgtgctgcggaggaaagtaagctgcccatcaatgcgttgagcaactctttgctgcgtcaccacaacatggtctatgctacgacatcccgcagcgcaagccagcggcagaagaaggtcaccattgacagactgcaagtcctggacgaccactaccgggacgtgctcaaggagatgaaggcgaaggcgtccacagttaaggctaagcttctatctgtagaggaagcctgcaagctgacgcccccacattcggccaggtcaaaatttggctatggggcaaaggacgtccggaacctatccggcaaggccattaaccacatccgctccgtgtggaaggacttgctggaggacactgagacaccaattgacaccaccatcatggcaaaaaacgaggttttctgcgttcaaccagagaaaggaggccgcaagcctgctcgccttatcgttttcccagacttgggggttcgtgtgtgcgagaaaatggccctctatgatgtggtctccacccttcctcaagccgtgatgggctcttcatacggattccagtactctcctgggcagcgggtcgagttcctggtaaatgcctggaaatcaaagaagtgccctatgggtttctcatatgacacccgctgttttgactcaacggtcaccgagagtgacatccgtgtcgaggagtcaatttaccaatgttgtgacttggcccccgaagccagacaggccataaggtcgctcacagagcggctctatatcgggggtcccctgactaattcaaaagggcagaactgcggttatcgccggtgccgcgcgagcggcgtgctgacgaccagctgcggtaataccctcacatgttacttgaaagcctctgcggcctgtcgagctgcgaagctccaggactgcacgatgctcgtgtgcggagacgaccttgtcgttatctgtgaaagcgcggggacccaagaggacgcggcgagcctacgagtcttcacggaggctatgactaggtactctgccccccccggggacctgccccaaccagaatacgaccaggagttaataacatcatgctcctccaatgtgtcagtcgcgcacgatgcatctggcaaaagggtgtactatctcacccgtgaccccaccaccccccttgcgcgggctgcgtgggcgacagctagacacactccagtcaactcctggctaggcaacatcatcatgtatgcgcccaccttgtgggcaagaatgattctgatgactcacttcttctccatccttctagctcaggaacaacttgaaaaagccctagactgtcagatctacggggcctgttactccattgagccacttgacctacctcagatcattgaacgactccatggtcttagcgcattttcactccatagttactctccaggtgagatcaatagggtggcttcatgcctcaggaaacttggggtaccacccttgcgagcctggagacatcgggccagaagtgtccgcgctaagctactgtctcagggggggagggctgccacttgtggccggtacctcttcaactgggcggtaaagacaaaacttaaactcactccaatcccggctgcgtcccagttggacttgtccaaatggttcgttgctggttacggcgggggagacatatatcacagcctgtctcgtgcccgaccccgctggtttatgttgtgcctactcctactttctgtaggggtaggcatctatctgctccccaaccgatgaacggggagctaaacactccaggccaataggccatcctgttttttttttttt

SEQ ID NO: 797 - DNA, 9414 bp, Hepatitis C Virus
tgccagcccccgattgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggatattaagttcccgggcggtggtcagatcgttggtggagtttacttgttgccgcgcaggggccccaggttgggtgtgcgcgcgactaggaagacttccgagcggtcgcaacctcgtggaaggcgacagcctatccccaaggctcgccggcccgagggcagggcctgggctcagcccgggtacccttggcccctctatggcaatgagggcttggggtgggcaggatggctcctgtcaccccgcggctcccggcctagttggggccccacggacccccggcgtaagtcgcgtaatttgggtaaggtcatcgacaccctcacatgcggcttcgccgacctcatggggtacattccgctcgtcggcgcccccctagggggcgttgccagggccctggcacatggtgtccgggtgctggaggacggcgtgaactatgcaacagggaatctgcccggttgctctttctctatcttcctcttggctctgctgtcttgtttgaccaccccagtttccgcttatgaagtgcgtaacgcgtccgggatgtaccatgtcacgaacgactgctccaactcaagcattgtgtatgaggcagcggacatgatcatgcacactcccgggtgcgtgccctgcgttcgggaggacaactcctcccgttgctgggtggcacttactcccacgctcgcggccaggaatgccagcgtccccactacgacattgcgacgccatgtcgacttgctcgttggggtagctgctttctgttccgctatgtacgtgggggacctctgcggatctgttttccttgtttcccagctgttcaccttttcgcctcgccggcatgagacggtacaggactgcaactgctcaatctatcccggccgcgtatcaggtcaccgcatggcctgggatatgatgatgaactggtcgcctacaacagccctagtggtatcgcagctactccggatcccacaagctgtcgtggacatggtgacagggtcccactggggaatcctggcgggccttgcctactattccatggtggggaactgggctaaggtcttaattgcgatgctactctttgccggcgttgacggaaccacccacgtgacagggggggcgcaaggtcgggccgctagctcgctaacgtccctctttagccctgggccggttcagcacctccagctcataaacaccaacggcagctggcatatcaacaggaccgccctgagctgcaatgactccctcaacactgggtttgttgccgcgctgttctacaaatacaggttcaacgcgtccgggtgcccggagcgcttggccacgtgccgccccattgatacattcgcgcaggggtggggtcccatcacttacactgagcctcatgatttggatcagaggccctattgctggcactacgcgcctcaaccgtgtggtattgtgcccacgttgcaggtgtgtggcccagtatactgcttcaccccgagtcctgttgcggtggggactaccgatcgtttcggtgcccctacatacagatggggggcaaatgagacggacgtgctgctccttaacaacgccgggccgccgcaaggcaactggttcggctgtacatggatgaatggcactgggttcaccaagacatgtgggggccccccgtgtaacatcgggggggtcggcaacaataccttgacctgccccacggactgcttccgaaagcaccccggggccacttacaccaaatgcggttcggggccttggttaacacccaggtgcttagtcgactacccgtacaggctctggcattacccctgcactgtcaactttaccatctttaaggttaggatgtacgtggggggcgcggagcacaggctcgacgccgcatgcaactggactcggggagagcgttgtgacctggaggacagggataggtcagagcttagcccgctgctgctgtctacaacagagtggcaggtactgccctgttccttcacaaccctaccggctctgtccactggtttgattcatctccatcagaacatcgtggacatacaatacctgtacggtatagggtcggcggttgtctcctttgcgatcaaatgggagtatattgtgctgctcttccttcttctggcggacgcgcgcgtctgcgcttgcttgtggatgatgctgctggtagcgcaagccgaggccgccttagagaacctggtggtcctcaatgcagcgtccgtggccggagcgcatggcattctttccttcattgtgttcttctgtgctgcctggtacatcaagggcaggctggttcccggagcggcatacgccctctatggcgtatggccgctgcttctgcttctgctggcgttaccaccacgggcgtacgccatggaccgggagatggccgcatcgtgcggaggcgcggtttttgtaggtctggtactcttgaccttgtcaccacactataaagtgttccttgccaggttcatatggtggctacaatatctcatcaccagaaccgaagcgcatctgcaagtgtgggtcccccctctcaacgttcgggggggtcgcgatgccatcatcctcctcacatgcgtggtccacccagagctaatctttgacatcacaaaatatttgctcgccatattcggcccgctcatggtgctccaggccggcataactagagtgccgtacttcgtgcgcgcacaagggctcattcgtgcatgcatgttggcgcggaaagtcgtggggggtcattacgtccaaatggtcttcatgaagctggccgcactagcaggtacgtacgtttatgaccatcttactccactgcgagattgggctcacacgggcttacgagaccttgcagtggcagtagagcccgttgtcttctctgacatggagaccaaagtcatcacctggggggcagacaccgcggcgtgcggggacatcatcttggccctgcctgcttccgcccgaagggggaaggagatacttctgggaccggccgatagtcttgaaggacaggggtggcgactccttgcgcccatcacggcctactcccaacaaacgcgaggcctgcttggttgcatcatcactagccttacaggccgggacaagaaccaggttgagggggaggttcaagtggtttccaccgcaacacaatctttcctggcgacctgcatcaatggcgtgtgttggactgtcttccacggcgccggctcaaagaccctagccggcccaaagggtccaatcacccaaatgtacaccaatgtagaccaggaccttgttggctggccggcacctcctggggcgcgttccctgacaccatgcacttgcggctcctcggacctttacctggtcacgagacatgctgatgtcattccggtgcgccggcggggtgacggtagggggagcctactcccccccaggcctgtctcctacttgaagggctcctcgggtggtccactgctctgcccttcggggcacgctgtcggcatacttccggctgctgtatgcacccggggggttgccatggcggtggaattcatacccgttgagtctatggaaactactatgcggtctccggtcttcacggacaatccgtctcccccggctgtaccgcagacattccaagtggcccacttacacgctcccaccggcagcggcaagagcactagggtgccggctgcatatgcagcccaagggtacaaggtgctcgtcctaaatccgtccgtcgccgccaccttgggttttggggcgtatatgtccaaggcacatggtatcgaccccaaccttagaactggggtaaggaccatcaccacaggtgcccctatcacatactccacctatggcaagttccttgccgacggtggcggctccgggggcgcctatgacatcataatgtgtgatgagtgccactcaactgactcgactaccatttatggcatcggcacagtcctggaccaagcggagacggctggagcgcggctcgtggtgctctccaccgctacgcctccgggatcggtcaccgtgccacacctcaatatcgaggaggtggccctgtctaatactggagagatccccttctacggcaaagccattcccatcgaggctatcaaggggggaaggcatctcattttctgccattccaagaagaagtgtgacgaactcgccgcaaagctgtcaggcctcggactcaatgccgtagcgtattaccggggtcttgacgtgtccgtcataccgaccagcggagacgttgttgtcgtggcgacggacgctctaatgacgggctttaccggcgactttgactcagtgatcgactgtaatacgtgtgtcacccagacagtcgatttcagcttggaccccaccttcaccattgagacgacgaccgtgccccaagacgcagtgtcgcgctcgcagaggcgaggcaggactggtaggggcagggctggcatatacaggtttgtgactccaggagaacggccctcgggcatgttcgattcttcggtcctgtgtgagtgttatgacgcgggttgtgcgtggtacgaactcacgcccgctgagacctcggttaggttgcgggcgtacctaaacacaccagggttgcccgtctgccaggaccatctggagttctcggagggtgtcttcacaggcctcacccacatagatgcccacttcttatcccagactaaacaggcaggagagaacttcccctacttggtagcataccaggctacagtgtgcgccagggctcaagccccacctccatcgtgggatgaaatgtggaggtgtctcatacggctgaaacctacgctgcacgggccaacacccctgctgtataggttaggagccgtccaaaatgaggtcaccctcacacaccccataaccaaattcatcatgacatgtatgtcggctgacctggaggtcgtcaccagcacctgggtgctggtaggcggagtcctcgcagctctggccgcgtactgcctgacaacaggcagcgtggtcattgtgggcaggatcatcctgtccgggaagccggctatcatccccgatagggaagttctctaccaggagttcgacgagatggaggagtgtgcctcacacctcccttacttcgaacagggaatgcagctcgccgagcaattcaaacagaaggcgctcgggttgctgcaaacagccaccaagcaggcggaggctgctgctcccgtggtggagtccaagtggcgagcccttgagaccttctgggcgaagcacatgtggaacttcattagtgggatacagtacttggcaggcttgtccactctgcctgggaaccccgcaatacgatcaccgatggcattcacagcctccatcaccagcccgctcaccacccagcataccctcttgtttaacatcttggggggatgggtggctgcccaactcgccccccccagcgctgcctcagctttcgtgggcgccggcatcgctggagccgctgttggcacgataggccttgggaaggtgcttgtggacattctggcaggttatggagcaggggtggcgggcgcacttgtggcctttaagatcatgagcggcgagatgccttcagccgaggacatggtcaacttactccctgccatcctttctcccggtgccctggtcgtcgggattgtgtgtgcagcaatactgcgtcggcatgtgggcccaggggaaggggctgtgcagtggatgaaccggctgatagcgttcgcctcgcggggtaaccacgtctcccccaggcactatgtgccagagagcgagcctgcagcgcgtgttacccagatcctttccagcctcaccatcactcagctgttgaagagactccaccagtggattaatgaggactgctctacgccatgctccagctcgtggctaagggagatttgggactggatctgcacggtgttgactgacttcaagacctggctccagtccaagctcctgccgcgattaccgggagtcccttttttctcatgccaacgcgggtataagggagtctggcggggggacggcatcatgcacaccacctgcccatgcggagcacagatcaccggacacgtcaaaaacggttccatgaggatcgttgggcctaaaacctgcagcaacacgtggtacgggacattccccatcaacgcgtacaccacgggcccctgcacaccctccccggcgccaaactattccaaggcattgtggagagtggccgctgaggagtacgtggaggtcacgcgggtgggagattttcactacgtgacgggcatgaccactgacaacgtgaagtgtccatgccaggttccggcccccgaattcttcacggaggtggatggagtgcggttgcacaggtacgctccggcgtgcagacctctcctacgggaggaggtcgtattccaggtcgggctccaccagtacctggtcgggtcacagctcccatgcgagcccgaaccggatgtagcagtgctcacttccatgctcactgacccctcccacattacagcagagacggctaagcgtaggctggccagggggtctcccccctccttggccagctcttcagctagccagttgtctgcgccttccttgaaggcgacatgcactacccatcatgactccccggacgctgacctcattgaggccaacctcttgtggcggcaagagatgggcgggaacatcacccgcgtggagtcagagaataaggtggtaatcctggactctttcgacccgctccgagcggaggatgatgagggggaaatatccgttccggcggagatcctgcggaaatccaggaaattccccccagcgctgcccatatgggcgccgccggattacaaccctccgctgctagagtcctggaaggacccggactacgttcctccggtggtacacgggtgcccgttgccgcccaccaaggcccctccaataccacctccacggaggaagaggacggttgtcctgacagaatccaccgtgtcttctgccttggcggagctcgctactaagaccttcggcagctccggatcgtcggccatcgacagcggtacggcgaccgcccctcctgaccaagcctccggtgacggcgacagagagtccgacgttgagtcgttctcctccatgcccccccttgagggagagccgggggaccccgatctcagcgacggatcttggtccaccgtgagcgaggaggctagtgaggacgtcgtctgctgttcgatgtcctacacatggacaggcgccctgatcacgccatgcgctgcggaggaaagcaagttgcccatcaacccgttgagcaattctttgctacgtcaccacaacatggtctatgctacaacatcccgcagcgcaggcctgcggcagaagaaggtcacctttgacagactgcaagtcctggacgaccactaccgggacgtgcttaaggagatgaaggcgaaggcgtccacagttaaggctaaacttctatctgtagaagaagcctgcaaactgacgcccccacattcggccaaatccaaatttggctacggggcgaaggacgtccggagcctatccagcagggccgttacccacatccgctccgtgtggaaggacctgctggaagacactgaaacaccaattagcactaccatcatggcaaaaaatgaggttttctgtgtccaaccagagaagggaggccgcaagccagctcgccttatcgtgttcccagatctgggagttcgtgtatgcgagaagatggccctttatgacgtggtctccacccttcctcaggccgtgatgggctcctcatacggattccagtactctcctaagcagcgggtcgagttcctggtgaatacctggaaatcaaagaaatgccccatgggcttctcatatgacacccgctgttttgactcaacggtcactgagaatgacatccgtgttgaggagtcaatttaccaatgttgtgacttggcccccgaagccaaactggccataaagtcgctcacagagcggctctatatcgggggtcccctgactaattcaaaagggcagaactgcggttaccgccggtgccgcgcgagcggcgtgctgacgactagctgcggtaataccctcacatgttacctgaaagccactgcggcctgtcgagctgcgaagctccgggactgcacgatgctcgtgaacggagacgaccttgtcgttatctgtgaaagcgcgggaacccaagaggatgcggcgagcctacgagtcttcacggaggctatgactaggtactctgccccccctggggacccgcctcaaccggaatacgacttggagttgataacatcatgttcctccaatgtgtcggtcgcacacgatgcatctggtaaaagggtgtactacctcacccgtgaccctaccaccccccttgcacgggctgcgtgggagacagctagacacactccagtcaactcctggctaggcaacatcatcatgtatgcgcccaccttatgggcaaggatgattctgatgactcatttcttctccatccttctagctcaggagcaacttgaaaaaaccctagattgtcagatctacggggcctgttactccattgaaccacttgatctacctcagatcattgagcgactccatggtcttagcgcattttcactccatagttactctccaggcgagatcaatagggtggcttcatgcctcagaaaacttggggtaccacccttgcgagcctggagacatcgggccagaagtgtccgcgctaagctactgtcccagggggggagggccgccacttgtggcaagtacctcttcaactgggcggtgaggaccaagctcaaactcactccaatcccagccgcgtcccggttggacttgtccggctggttcgttgctggttacagcgggggagacatatatcacagcctgtctcgtgcccgaccccgctggttcatgttgtgcctactcctactttccgtgggggtaggcatctacctgctccccaaccgatgaatggggagctaaacactccaggccaataggccgtttctc

SEQ ID NO: 798 - DNA, 9646 bp, Hepatitis C Virus; identical to SEQ ID NO: 630

SEQ ID NO: 799 - DNA, 9440 bp, Hepatitis C Virus
acccgccccgattgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggaggtcaagttcccgggcggtggtcagatcgttggtggagtttacctgttgccgcgcaggggccccaggttgggtgtgcgcgcgatcaggaagacttccgagcggtcgcaaccccgtggaaggcgacagcctatccccaaggctcgccggcccgagggcagggcctgggctcagcccgggtatccttggcccctctatggcaatgagggcatggggtgggcaggatggctcctgtcaccccgcggctcccggcctagttggggccccacggacccccggcgtaggtcgcgtaatttgggtaaggtcatcgataccctcacatgcggcctcgccgacctcatggggtacgttccgctcgtcggcggccccctagggggcgctgccagggccttggcacatggtgtccgggttctggaggacggcgtgaactatgcaacagggaacatgcccggttgctctttttctatcttcctcttggctctgctgtcctgtctgaccgtaccagcttccgctcatgaggtgcgtaacgcgtccggggtataccatgtcacgaacgactgctccaactcaagcattgtgtttgaggcggcggacttgatcatgcgtactcccgggtgcgtgccctgcgttcgggagggtaactcctcccgctgctgggtagcgctcactcccacgctcgcggccaggaatgctaccatccacactacgacaatacgacaccacgtcgatttgctcgttggggcggctgctctctgctctgctatgtacgtgggggacctctgcggatctgttttcctcgtctctcagctgttcaccttctcgccccgccggcatgcgacattgcaggactgcaattgttcgatctaccccggccacgcgtcaggtcaccgcatggcctgggacatgatgatgaactggtcacctacaacagccctcgtagtgtcgcagttactccggatcccacaagccgtcatcgacatggtggcgggggcccactggggagtcctggcgggccttgcctactattccatggcggggaactgggctaaggttttgattgtgatgctactttttgccggcgttgacgggcacaccctcacaacgggggggcacgctgcccacctcaccagcgggttcgcgggcctctttacacctgggccgtctcagagaatccagcttataaacaccaatggcagttggcacatcaacaggactgccctgaactgcaatgactccctccagactgggttccttgccgccctgtcctacacatacaggttcaactcgtccggatgcccggggcgcatggccagctgccgctccattgacaagttcgaccagggatggggtcccatcacttatgctgatcctaaagacccggaccagaggccttattgctggcactacgcaccacaacagtgtggtatcataccccggtccgaggcgtgcggtccagtgtattgctctaccccaagccctgttgtggtggggacgaccgatcgtttcggtgcccctacgtataactggggggataatgagacggacgtgctgctcctaaacaacacgcggccgccgcaaggcaactggttcggctgtacatggatgaatagcactgggttcaccaagacgtgcggggcccccccgtgtaacatcgggggggtcggcaataacaccttgacctgccccacggactgcttccggaagcaccccgaggccacgtactcaaaatgtggctcggggccttggttgacacctaggtgcatggttgactacccatacaggctctggcactacccctgcactgtcaacttctccatctttaaggttaggatgtatgtggggggcgtggagcacaggcttaatgctgcatgcaactggacccgaggagagcgttgtgacttggacgacagggacagatcggagctcagcccgttactgctctccacaacagagtggcaggttctgccctgctctttcaccaccctaccggctctgtccactggcttgatccacctccatcagaacatcgtggacgtgcaatacctgtacggtatagggtcagcggttgtctcctttgcaatcaaatgggagtatgtcgtgttgcttttccttctcctggcggacgcgcgcgtctgtgcctgcttgtggatgatgctgctgatagcccgagccgaggccgccttagagaacctggtggccctcaatgcagcgtccgttgccggagcgcacggcatcctctccttcctcgtgttcttctgtgccgcttggtacatcaagggcaggctggtccctggggcggcatatgctttctatggcgcatggccgctgctcctgctcctcttgacattaccaccacgagcttacgccatggaccgggagatggctgcatcgtgcggaggcgcggtttttgtgggtctggcattattgaccttgtccccatattacaaggtgttcctcgctaggctcatatggtggttgcaatatcttatcgccagagctgaggcgcacttgcatgtgtgggttccccccctcaacgtccggggaggccgcgatgccatcatcctcctcacgtgtgcagtccacccagagctaatctttgatatcaccaaacttctgattgccatactcggaccgctcatggtgctccaagctggcataactagggtgccgtacttcgtacgcgctcaagggctcattcgtgcatgcatgttagtgcggaaagtcgctgggggtcattatgtccaaatggccttcatgagactgggcgcgctgacgggcacgtacgtctataatcacctcaccccactgcgggattgggcccacgccggcctacgggaccttgcggtagcagtggagcctgtcaccttctctgacatggagaccaagatcatcacctggggggcagacaccgcggcgtgtggggacatcatcctgggcctacctgtctccgcccgaaggggaagggagatactcctggggccggccgatagtctagtagggcaggggtggcgactccttgcgcccatcacggcctactcccgacagacccggggcctacttggttgcatcatcacgagtctcacaggccgggacaagaaccaggtcgagggggaggttcaagtggtctccaccgcaacacaatctttcctggcgacctgcgtcaacggcgtatgttggactgtctaccatggtgctggctcaaagactctagccggcccaaaaggcccaatcgcccagatgtacactaatgtagaccaggatctcgtcggctggccggcgccccccggggcgcgttccctgacaccatgcacctgtggcagctcggacctttacttggttacgagacatgcagatgttattccggtgcgccggcggggcgacaatagagggagcttgctctcccccaggcctgtctcctacttgaagggctcttcgggtggcccactgctctgcccttcggggcacgctgtgggcgtcttccgggccgctgtatgcacccggggggttgcaaaggcggtggattttgtccccgttgagtccatggaaactactatgcggtccccggtcttcacagacacgtcatctcccccggccgtaccgcaaacattccaagtggcccatctacacgctcccactggcagcggcaagagcactagagtgccggccgcatatgcgacccaagggtacaaggtgcttgtcctgaacccgtctgttgccgctaccttaggttttggggcgtatatgtctaaagcacatggtaccgaccctaacatcaggactggggtaaggaccattaccacgggcgcccccattacgtactccacctatggcaagttccttgccgacggtggttgctccgggggcgcttacgacatcataatgtgcgatgagtgccactcaactgactcaactaccatcttgggcatcggcacagtcctggaccaagcggagacggctggagcacggcttgtcgtgctcgccaccgctacgcctccaggatcggtcaccgtgccacaccccaatatcgaggaggtggccctgtcgaacactggagagatccccttctatggcaaagccatccccatcgaagccatcatggggggaaggcacctcattttctgtcactccaagaagaagtgcgacgagcttgccgcaaagctgtcaggcctcggaatcaatgctgtagcgtattaccggggtcttgatgtgtccgtcataccgaccagcggagacgtcgttgtcgtggcaacagacgctctaatgacgggctataccggtgactttgattcagtgatcgactgtaatacgtgtgtcacccagacagtcgacttcagcttggaccccaccttcaccattgagacgacgaccgtgccccaagacgcagtgtcgcgctcgcagcggcggggtaggactggcaggggcagggggggcatatacaggtttgtaactccgggggaacggccctcgggcatgttcgattccccggtcctgtgcgagtgctatgacgcgggctgtgcttggtacgagctcacccccgctgagacctcggttaggttgcgggcttacctaaatacaccaggattgcccgtttgccaggaccatctggagttctgggagagcgtcttcacaggcctcacccatatagatgcccacttcctgtcccagaccaagcaggcaggagataacttcccctacctggtggcataccaagccacggtgtgcgccagggctcaggccccacctccatcgtgggatcaaatgtggaagtgtctcatacggctaaaacccacgctgcacgggccaacgcccctgctgtataggctaggggccgtccaaaatgaggtcaccctcacacaccccataaccaaatacatcatggcatgcatgtgggccgacctggaagtcgtcaccagcacctgggtgctggtaggcggagtcctcgcagctctggccgcatattgcctgacaacaggcagtgtggttatcgtgggtaggatcatcttgtccgggaggccggctgtcgttcccgatagggaagtcctctaccgggagttcgatgaaatggaagaatgcgcctcgcacctcccttacatcgaacagggaatgcaactcgccgagcaattcaagcagaaggcgctcgggttgttgcaaacagccaccaagcaggcggaggctgccgctcccgtggtggggtccaagtggcgagcttttgagaccttctgggcaaagcacatgtggaatttcatcagcgggatacagtacttagcgggcttatccaccctgcctgggaaccccgcgatagcatcactgatggcattcacagcctctatcaccagcccgctcaccacccagaacaccctcctgtttaacatcttgggggggtgggtagccgcccaactcgctccccccagcgctgcttcggctttcgtgggcgctggtatcgctggtgcggctgttggcagcataggtcttgggaaggtgctagtggacattctggcgggctatggggcaggggtggctggcgcgctcgtggccttcaaggtcatgagcggcgaggcgccctctgccgaggacctgatcaatttgctccctgccatcctctctcctggtgccctggtcgtcggagtcgtgtgtgcagcaatactgcgtcggcatgtgggcccgggagagggggccgtgcagtggatgaaccggctgatagcgttcgcttcgcggggtaaccatgtctcccccacgcactatgtgcctgagagcgacgccgcagcgcgtgtcactcaggtcctctccagccttaccatcacccagctgctgaagaggctccaccagtggattaatgaggactgttctacgccgtgttccggctcgtggctgagggatgtttgggactgggtgtgcacggtgttgagtgacttcaagacctggctccagtccaagctcctgccgcggttaccgggtgtccctttcctctcatgccaacgtgggtacaagggagtctggcggggggacggcatcatgcacaccacctgcccatgtggagcacagatcgccggacatgtcaaaaacggttccatgaggatcatcgggccgaaaacctgcagcaacacgtggcatggaacattccccatcaacgcgtacaccacgggcccctgcacgccttccccggcgccaaactattccaaggcgctgtggcgggtggctgctgaggagtacgtggaggtcacgcgggtgggggatttccactacgtgacgggcataaccaccgacaacgtaaagtgcccatgtcaggttccagctcctgagtttttcacggaggtggatggggtgcggttgcacaggtacgccccggtgtgcaaacctctcttacgggatgaggttgtattccaggtcgggctcaatcaatacctggttgggtcacagctcccatgcgagcccgaaccggacgtagcagtgctcacttccatgctcaccgacccctcccacattacagcagaggcggctaagcgtaggttggccagggggtctcccccctccttggccagctcttcagctagccagctgtctgcgccctccttgagggcgacatgcactacccattcttcctataatcttgactctccggacgtcgacctcattgaggccaacctcctgtggcggcaggagatgggcggaaacatcacccgcgtggagtcggagaacaaggtggtagttctagactctttcgagccgcttcgagcggagggggatgagaatgaaatatccattgcggcggagatcctgcggaagtccaagaagttccccgcggcgatacccatatgggcacggccggattacaatcctccattgttagagtcttggaagaacccggactacgtccctccggtggtacacgggtgcccattgccacctgtcaaggcccctccaataccacctccacggagaaaaaggacggttgtcctgacggactccaccgtgtcttctgttttggcggagctcgctaccaaaaccttcggcagctccgaattgtcggccgccgacagcggcacggcgaccgcccctcctgaccagacctccgacaacggcggcaaagactccgacgctgagtcatgctcctctatgcccccccttgagggggagccgggggaccccgatctcagtgacgggtcttggtctaccgtgagcgaggaggctggtgagagcgtcgtctgctgctcaatgtcctacacatggacaggtgccctgatcacgccatgcgccgcggaagaaagcaagctgcccatcaacgcgttgagcaactctttgctgcgccatcacaacatggtctacgccacgacatcccgcagcgcgggcctgcggcagaagaaggtcacctttgacagactgcaggtcctggatgaccattaccgggacgtgcttaaggagatgaaggcaaaggcgtccacagtcaaggctaaacttctatccatagaagaagcctgccgcctgacgcccccacattcggccaaatccaagtttggctatggggcaaaggacgtccggaacctatccagcagggccatcaaccacttccgctccgtgtgggaggacttgctggaggacactgtgacaccaattgacaccaccgtcatggcaaagaatgaggttttctgcgtccaaccagagaagggaggccagaagccagcccgccttatcgtattcccagatttgggagttcgggtatgcgagaagatggctctctacgatgtggtctccacccttcctcaagccgtgatgggctcctcatacggattccagtactctcccgggcagcgggtcgagttcctggtaaaagcctggaaatcaaagaaaaaccctatgggcttctcatatgacacccgctgttttgactcaacggtcactgagaatgacatccgtgttgaggagtcaatttaccaatgttgtgacttggcccccgaagccagacaggctataaaatcgctcacagagcggctttatatcgggggtcccctgactaattcaaaagggcagagctgtggttatcgccggtgccgcgcgagcggcgtgctgacgactagctgcggtaataccctcacatgttacttgaaagcctctgccgcctgtcgagctgcaaagctccaggactgcacgatgctcgtgaacggggacgaccgtgtcgttatctgcgaaagcgcgggaacccaggaggatgcggcgagcctacgagtcttcacggaggctatgactaggtactccgccccccccggggacttgccccaaccagaatacgacttggagttgataacatcatgttcctccaatgtgtcggtcgcgcacgatgcatctggcaaaagggtgtactacctcactcgcgatcccaccacccccatcgcacgggctgcgtgggaaacagctagacacactccagttaactcctggctaggcaacattatcatgtatgcgcccaccttatgggcaaggatgattctgatgacccatttcttctccatccttctagctcaggagcaacttgaaaaagccctggattgccaaatctacggggcctgttactccattgagccacttgacctacctcagatcattgaacgactccatggtcttagcgcattttcactccatagttactctccaggtgagatcaatagggtggcttcatgcctcaggaaacttggggtaccgcccttgcgagtctggagacatcgggccaggaacgtccgcgctaaactactgtcccagggggggagggcggccacttgcggcaaatacctcttcaactgggcagtaaagaccaagctcaaactcactccaatcccggctgcgtcccagttggacttatccggctggttcgttgctggctacagcgggggagacatatatcacagcctgtctcgtgcccgaccccgctggttcatgctgtgcctactcctactttctgtaggggtaggcatctacttgctccccaatcgatgaacggggagctaaacactccagccaataggccatttccttttgttttttttttttt

SEQ ID NO: 800 - DNA, 9446 bp, Hepatitis C Virus
tgccagcccccgattgggggcgacactccaccatagatcactcccctgtgaggaactattgtcttcacgcagaaagcgtctagccatggcgttagtatgagtgtcgtgcaacctccaggaccccccctcccgggagagccatagtggtctgcggaaccggtgagtacaccgaaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacctatccccaaggctcgccagcccgagggtagggcctgggctcagcccgggtacccttggcccctctacgccaatgagggcttggggtgggcaggatggctcctgtcaccccgtggctcccggcctagttggggccccaccgacccccggcgtaggtcgcgtaatttgggtaaggtcatcgacacccccacatgcggcttcgccgacctcatggggtacattccgctcgtcggcgcccccctagggggcgttgccagggccctggcacatggtgtccgggttctggaggacagcgtgaactatgcaacagggaatttgcctggttgctccttttctatcttccttttagctttgctgtcctgtctgaccgtcccagcttccgcttatgaggtgcgcaacgtgtccgggatataccacgtcacgaacgactgctccaactcaagcattgtgtatgaggcagcggacttgatcatgcatactcctgggtgcgtgccctgcgttcgggaggccaactcctctcgctgctgggtagcgcttactcccacgcttgcggccagagactccagcatccccactgcgacaatacgacgccacgtcgacttgctcgttggggcggctgctttctgctccgctatgtacgtgggggacctctgcggatctgttttcctcgtctcccaactgttcaccttctcgcctcgcctgcatcagacggtccaggactgtaattgctcaatctatcctggccacctaacaggccaccgcatggcttgggatatgatgatgaactggtcgcctacagcagccctggtggtgtcgcagttactccggatcccacaagctatcgtggacatggtggcgggggcccactggggagtcctggcgggccttgcctactatcccatggtggggaactgggctaaggttttgattgtgatgctactttttgctggcgtcgacggaacgaccgtgacgatggggggaacggtagctaggactacctacggtttcacaggcctctttagacccggggcgtctcagaaaatccagcttataaacaccaatggtagttggcacatcaacaggaccgctctgaactgcaatgactccctcaacactggcttcctcgccgcgctgttctacacacacaggttcaacgcgtctggatgtccagaacgcatggccagctgccagtccattgataagtttgttcagggatggggtcccatcacctacgctgagaatggcagctcggaccagaggccctactgctggcactacgcgccccgacggtgtggcatcgtacccgcgtcgcaggtgtgtggcccggtgtattgcttcaccccaagtccagttgtggtggggacgaccgatcggtccggcgctcctacgtatagctggggggagaatgagacggacgtgctgctcctcaacaacacgcggccgccgcaaggcaactggttcggctgtacatggatgagcagcactgggttcaccaagacgtgcgggggccccccgtgcaatatcgggggggccggtaacaacaccttgacctgccccacggactgcttccggaagcaccccgaggccacctacacaaaatgtggttcggggccttggttgacacccaggtgcttggttgattatccatacaggctctggcactacccctgcactgtcaacttcaccaccttcaaggttaggatgtatgtgggaggtgtggagcacaggctcatcgctgcatgcaattggactcgaggagagcgttgcaacctggaggacagggatagatcagagctcagtccactgctgctgtctacaacagagtggcagatactgccctgttcctacaccaccctaccggctttgtcaactggtttgatccatctacaccagaacatcgtggacgtgcaatacctgtacggtatagggtcagcagttgtctcctttgtaatcaaatgggagtatgtcctgttatttttccttctcctggcggacgcgcgcgtgtgtgcctgcttgtggatgatactgctgatagcccaggctgaggccgccttagagaacctggtggtcctcaatgcagcgtccgtggccggagcgcatggcatcctctccttccttgtgttcttctgtgctgcctggtacatcaagggcaggctggtccctggggcggcgtatgcttcctacggcgtatggccgctgctcctgctcctactggcgttaccaccacgagcttacgccatggaccaagggatggctgcatcgtccggaggcacggttcttgtaggtttgatgctcttgaccttgtcaccatactataaggtggtcctcgctaggctcatatggtggttacaatactttatcacccgggccgaggcgcacttgcaagtgtgggtcccccctctcaatgttcggggaggccgcgacgccgtcatcctcctcacatgtgcagtctacccagagctagtttttgacatcaccaaactcctgctcgccatattcggtccactcatggtgctccaggctggtataatcaagatgccgtactttgtacgcgctcaagggctcattcgtgcatgcatgctggtgcggaaggtcgccgggggtcattacgtccaaatggccttcatgaagctggccgcgctgacaggcacgtacgtttatgaccatctcaccccactgcgggattgggcccacacgggcctacgagaccttgcggtcgcagtagagcccgtcgtcttctctgacatggagactaagattatcacctggggggcagacaccgcagagtgtggggatatcatcttgggctaccgttcttccgcccgaaggggaagggagatactcctgggaccggctgacagtcttgagggacaggggtggcgactccttgcgcccatcacggcctacgcccaacagacgcgaggcttacttggttgcatcatcactagcctcacaggccgagacaagaaccaggtcgagggggaggtccaagtggtttccaccgcaacacaatctttcctggcgacctgcgtcaacggtgtgtgctggactgtcttccatggcgctggctcaaaaaccctagccggcccgaaaggcccaatcacccaaatgtacaccaatgtagaccaggacctcgtcggctggcaggcggcccccgggatgcgttccctgacaccatgcacctgcggcagctcggatctttacttggtcacgagacatgctgatgtcatcccggtgcgccggcggggggacggtagggggagcctgctctcccccaggcccgtctcctatttgaaaggctcttcgggtggtccactactctggccttcggggcacgccgtgggcatcttccgggctgctgtatgcacccggggggttgcgaaggcggtggacttcgtacccgttgagtctatggagactactatgcggtctccggtcttcacagacaattcatcccccccggctgtaccgcagacattccaagtggcccatctacacgctcccacgggcagcggcaagagcactaaagtgccggctgcgtatgcagcccaagggtacaaggtgctcgtcctgaacccatccgttgccgccaccttaggttttggggcgtatatgtctaaggcacatggcaccgaccctaacatcagaaccggggcaaggaccatcaccacgggtgcccccatcacgtattctacctatggcaagttctttgccgacggtggctgctctgggggcgcctacgacatcataatatgcgatgagtgccactcaactgactcgactaccatcttgggcattggcacagtcctggatcgagcggagacggctggagcacgcctcgtcgtgctcgccaccgctacacctccgggatcgaccaccgtgccacaccccaatattgaggaggtggcattgcccaacactggagagatccccttctatggcagagccatccccatcgagttcatcaaggggggaaggcatcttattttctgcccatccaagaagaaatgtgacgagctcgccgcaaagctgtcagccctcggaatcaatgctgtagcgtattaccggggtcttgatgtgtccgtcataccgaccagcggagacgttgttgtcgtggcaacagacgctctgatgacgggctataccggcgactttgactcagtgatcgactgcaatacgtgtgtcacccagacagtcgatttcagcttggatcccactttcaccatcgagacaacgaccgtgccccaagacgcagtgtcgcgcacgcagcggcgaggcaggactggcaggggtaggggaggcatttacaggtttgtgactccaggagaacggccctcgggcatgttcgattcctcggtcttatgtgagtgctacgacgcgggctgtgcttggtacgagctcacgcccgctgagaccacagtcaggttgcgggcttacctgaatacaccagggctgcccgtctgccaggaccacctggagttctgggagagcgtcttcacaggcctcaaccacatagatgcccacttcctgtcccagactaagcaggcaggagacaacttcccctacctggtagcataccaagctacagtgtgcgccagggctcaggccccacctccatcgtgggatcaaatgtggaagtgtctcatatggctaaaacctgtgctgcacgggccaacacccctgctgtataggctaggagccgtccaaaatgagatcaccctcacacaccccataaccaaactcatcatggcatcgatgtcggctgacctggaggtcgtcactagcacttgggtgctagtaggcggagtccttgcagctctggccgcatactgcctgacaacaggcagcgtggtcattgtgggtaggatcatcttatctgggaggccggctgttattcccgacagggaggtcctctaccgggagttcgatgaaatggaagagtgtgcttcgcacctcccgtacatcgaacagggagtgcagctcgccgagcaattcaagcagaaggcgctcgggttgctgcaaacagccaccaagcaagcggaggccgctgctcccgtggtggagtccaagtggcgggccctcgagaccttctgggcgaagcacatgtggaacttcatcagtgggatacagtacttagcagccttatccactctgcctgggaaccccgcaatagcatcgctgatggcttttacagcctccatcactagcccgctcaccacccaaaataccctcctgtttaacatcttgggggggtgggtggctgcccaactcgctcccgccagcgctgcttcggctttcgtgggcgccggcagtgctggcgcggccattggcacgataggccttgggaaggtgcttgtggacatcctagcgggctatggggcaggggtggctggcgcgctcgtggcctttaaggtcatgagcggtgagatgccctccaccgaggacttggttaatctgctccctgccatcctctctcccggcgccctggtcgtcggggtcgtgtgcgcagcaatactgcgtcggcacgtggggccaggagagggggctgtgcaatggatgaaccggctgatagcgttcgcttcgcggggtaaccacgactcccccacgcactatgtgcctgaaagcgacgctgcagcgcgtgtcactcagatcctctccagccttaccatcacccaactgttgaagagacttcaccagtggattaatgaggactgttccacgccatgctccggctcgtggctaagggatgtttgggactggatatgcacagtgttaactgactttaagacctggctccagtctaagctcctgccgcgactaccgggagtccctttcttctcgtgccagcgcgggtacaagggagtctggcggggggacggcatcatgcaaaccacctgcccatgtggagcacagataaccggacatgtcaaaaatggttccatgaggatcgttgggcctaaaacctgcagcaacacatggcatggaactttccccatcaacgcatacaccacgggcccctgcacgcccgccccgacgccaaactattccagggcgttgtggcgggtggctgctgaggagtacgtggaggttacgcgggtgggggatttccactacgtgacgggcatgaccactgacaacgtaaaatgcccatgccaggttccggcccccgaattcttcacggaagtggatggggtgcggttgcacaggtacgctccggcgtgcaaaactctcctacgggaggaggtcacattccaggtcgggctcaaccaatacctggttgggtcacagctcccatgtgagcccgaaccggatgtagcagtgctcacttccatgctcaccgacccctcccacattacagcagagacggctaaacgtaggctggccaggggatctcccccctccttggccagctcttcagctagccagttgtctgcgccttccttgaaggcaacatgtactacccatcatgactccccggacgctgacctcatcgaggccaacctcctgtggcggcaggagatgggcgggaacatcacccgcgtggagtcagagagtaaggtggtaattttggactctttcgacccgctccgagcggaggagggtgagggggaagtatccgttgcggcggagatcctgcggaaatccaagaaatttcccccggcgttgcccgaatgggcacggccggattataaccctccactgctagagtcctggaaggacccggactacgtccctccggtggtgcacgggtgcccattgccacctgccaaggcccctccaataccacctccacggagaaagaggacggttgtcctgacagagtccactgtgtcttctgccttagcagagctcgccgttaagacgttcggcagctccgaatcgtcggccgtcgacagcggcacggcgactgcccctcccgaccaggtctccgacaacggcgacaaaggatccgacgctgagtcgtactcctccatgcccccccttgagggagagccgggggaccccgatctcagcgacgggtcttggtctaccgtgagtgaagaggctagtgaagacgtcgtatgctgctcaatgtcctactcttggacaggcgccctgatcacaccatgcgcagcggaggaaagcaagctgcccatcaacgcgctgagcaactctttgctacgtcaccacaacatggtctatgccacaacatcccgcagtgcaggcctgcggcagaagaaggtcacttttgacagactgcaagtcctggacgaccactaccgggacgtgcttaaggagatgaaggcgaaggcgtccacagtcaaggctaaacttctatccgtagaagaagcctgcaagctgacgcccccacattcagctaaatccaaatttggctatggggcgaaggacgtccggaacctgtccagcagggccgttaaccacatccgctccgtgtggaaggacctgctggaagacactgagacaccaattgacaccaccatcatggcaaagagtgaggttttctgcgtccaaccagagaaaggaggccgcaagccagctcgccttatcgtattcccagacttgggagttcgcgtatgcgagaagatggccctttatgatgtggtctccacccttcctcaggccgtgatgggcccctcatacggattccagtactctcctgggcagcgggtcgagttcctggtgaatgcctggaaatcaaagaagtgccctatgggcttctcatatgacacccgctgttttgactcaacggtcactgagagtgacatccgtactgaggagtcaatttaccaatgttgcgacttggcccccgaagccaaacaggccataaagtcgctcacagagcggctctatatcgggggtcccctgactaattcaaaggggcagaactgcggttatcgccggtgccgcgcgagcgtcgtgctgacgactagctgcggtaataccctcacatgttacttgaaggcttctgcggcctgtcgagctgcgaagctccaggactgcacgatgctcgtgaacggagacgaccttgtcgttatctgcgagagcgcgggaacccaagaggatgcggcaaacctacgagccttcacggaggctatgactaggtactctgccccccccggggatccgccccaaccagaatacgacttggagctgataacatcatgctcctccaatgtgtcggtcgcgcacgatgcatctggcaaaagggtgtactacctcacccgtgaccccaccactccccttgcacgtgctgcttgggagacagctagacacactccagtcaactcctggctaggcaacatcattatgtatgcgcccaccttatgggcaaggatgattctgatgacccacttcttctccatccttctagcccaggagcaacttgaaaaggccctggaatgccaaatctacggggcttgttactccattgagccactagacctacctcagatcattgaacgactccatgggcttagcgcattttcactccatagttactctccaggtgagatcaatagggtggcttcatgcctcaggaagcttggggtaccacccttgcgagtctggagacatcgggccagaagggtccgcgctaagctactgtcccagggggggagagccgccacttgtggcaagtacctcttcaactgggcagtaaggaccaagcttaagctcactccaattccggctgcgtcccggttggacttgtccagctggttcgttgctggttacagcgggggagacatatatcacagcgtgtctcatgcccgaccccgctggttcatgttgtgcctactcctactttctgtaggggtaggcatctacctgctccccaaccggtgagcggggagttaaacactccagccaatatttttttttttttttttttttttttttttttttttttttttttt

SEQ ID NO: 801 - DNA, 9415 bp, Hepatitis C Virus
tgccagcccccgattgggggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggatattaagttcccgggcggtggtcagatcgttggtggagtttacttgttgccgcgcaggggccccaggttgggtgtgcgcgcgactaggaagacttccgagcggtcgcaacctcgtggaaggcgacagcctatccccaaggctcgccggcccgagggcagggcctgggctcagcccgggtacccttggcccctctatggcaatgagggcttggggtgggcaggatggctcctgtcaccccgcggctcccggcctagttggggccccacggacccccggcgtaagtcgcgtaatttgggtaaggtcatcgacaccctcacatgcggcttcgccgacctcatggggtacattccgctcgtcggcgcccccctagggggcgttgccagggccctggcacatggtgtccgggtgctggaggacggcgtgaactatgcaacagggaatctgcccggttgctctttctctatcttcctcttggctctgctgtcttgtttgaccaccccagtttccgcttatgaagtgcgtaacgcgtccgggatgtaccatgtcacgaacgactgctccaactcaagcattgtgtatgaggcagcggacatgatcatgcacactcccgggtgcgtgccctgcgttcgggaggacaactcctcccgttgctgggtggcacttactcccacgctcgcggccaggaatgccagcgtccccactacgacattgcgacgccatgtcgacttgctcgttggggtagctgctttctgttccgctatgtacgtgggggacctctgcggatctgttttccttgtttcccagctgttcaccttttcgcctcgccggcatgagacggtacaggactgcaactgctcaatctatcccggccgcgtatcaggtcaccgcatggcctgggatatgatgatgaactggtcgcctacaacagccctagtggtatcgcagctactccggatcccacaagctgtcgtggacatggtgacagggtcccactggggaatcctggcgggccttgcctactattccatggtggggaactgggctaaggtcttaattgcgatgctactctttgccggcgttgacggaaccacccacgtgacagggggggcgcaaggtcgggccgctagctcgctaacgtccctctttagccctgggccggttcagcacctccagctcataaacaccaacggcagctggcatatcaacaggaccgccctgagctgcaatgactccctcaacactgggtttgttgccgcgctgttctacaaatacaggttcaacgcgtccgggtgcccggagcgcttggccacgtgccgccccattgatacattcgcgcaggggtggggtcccatcacttacactgagcctcatgatttggatcagaggccctattgctggcactacgcgcctcaaccgtgtggtattgtgcccacgttgcaggtgtgtggcccagtatactgcttcaccccgagtcctgttgcggtggggactaccgatcgtttcggtgcccctacatacagatggggggcaaatgagacggacgtgctgctccttaacaacgccgggccgccgcaaggcaactggttcggctgtacatggatgaatggcactgggttcaccaagacatgtgggggccccccgtgtaacatcgggggggtcggcaacaataccttgacctgccccacggactgcttccgaaagcaccccggggccacttacaccaaatgcggttcggggccttggttaacacccaggtgcttagtcgactacccgtacaggctctggcattacccctgcactgtcaactttaccatctttaaggttaggatgtacgtggggggcgcggagcacaggctcgacgccgcatgcaactggactcggggagagcgttgtgacctggaggacagggataggtcagagcttagcccgctgctgctgtctacaacagagtggcaggtactgccctgttccttcacaaccctaccggctctgtccactggtttgattcatctccatcagaacatcgtggacatacaatacctgtacggtatagggtcggcggttgtctcctttgcgatcaaatgggagtatattgtgctgctcttccttcttctggcggacgcgcgcgtctgcgcttgcttgtggatgatgctgctggtagcgcaagccgaggccgccttagagaacctggtggtcctcaatgcagcgtccgtggccggagcgcatggcattctttccttcattgtgttcttctgtgctgcctggtacatcaagggcaggctggttcccggagcggcatacgccctctatggcgtatggccgctgcttctgcttctgctggcgttaccaccacgggcgtacgccatggaccgggagatggccgcatcgtgcggaggcgcggtttttgtaggtctggtactcttgaccttgtcaccacactataaagtgttccttgccaggttcatatggtggctacaatatctcatcaccagaaccgaagcgcatctgcaagtgtgggtcccccctctcaacgttcgggggggtcgcgatgccatcatcctcctcacatgcgtggtccacccagagctaatctttgacatcacaaaatatttgctcgccatattcggcccgctcatggtgctccaggccggcataactagagtgccgtacttcgtgcgcgcacaagggctcattcgtgcatgcatgttggcgcggaaagtcgtggggggtcattacgtccaaatggtcttcatgaagctggccgcactagcaggtacgtacgtttatgaccatcttactccactgcgagattgggctcacacgggcttacgagaccttgcagtggcagtagagcccgttgtcttctctgacatggagaccaaagtcatcacctggggggcagacaccgcggcgtgcggggacatcatcttggcctgccctgcttccgcccgaagggggaaggagatacttctgggaccggccgatagtcttgaaggacaggggtggcgactccttgcgcccatcacggcctactcccaacaaacgcgaggcctgcttggttgcatcatcactagccttacaggccgggacaagaaccaggttgagggggaggttcaagtggtttccaccgcaacacaatctttcctggcgacctgcatcaatggcgtgtgttggactgtcttccacggcgccggctcaaagaccctagccggcccaaagggtccaatcacccaaatgtacaccaatgtagaccaggaccttgttggctggccggcacctcctggggcgcgttccctgacaccatgcacttgcggctcctcggacctttacctggtcacgagacatgctgatgtcattccggtgcgccggcggggtgacggtagggggagcctactcccccccaggcctgtctcctacttgaagggctcctcgggtggtccactgctctgcccttcggggcacgctgtcggcatacttccggctgctgtatgcacccggggggttgccatggcggtggaattcatacccgttgagtctatggaaactactatgcggtctccggtcttcacggacaatccgtctcccccggctgtaccgcagacattccaagtggcccacttacacgctcccaccggcagcggcaagagcactagggtgccggctgcatatgcagcccaagggtacaaggtgctcgtcctaaatccgtccgtcgccgccaccttgggttttggggcgtatatgtccaaggcacatggtatcgaccccaaccttagaactggggtaaggaccatcaccacaggtgcccctatcacatactccacctatggcaagttccttgccgacggtggcggctccgggggcgcctatgacatcataatgtgtgatgagtgccactcaactgactcgactaccatttatggcatcggcacagtcctggaccaagcggagacggctggagcgcggctcgtggtgctctccaccgctacgcctccgggatcggtcaccgtgccacacctcaatatcgaggaggtggccctgtctaatactggagagatccccttctacggcaaagccattcccatcgaggctatcaaggggggaaggcatctcattttctgccattccaagaagaagtgtgacgaactcgccgcaaagctgtcaggcctcggactcaatgccgtagcgtattaccggggtcttgacgtgtccgtcataccgaccagcggagacgttgttgtcgtggcgacggacgctctaatgacgggctttaccggcgactttgactcagtgatcgactgtaatacgtgtgtcacccagacagtcgatttcagcttggaccccaccttcaccattgagacgacgaccgtgccccaagacgcagtgtcgcgctcgcagaggcgaggcaggactggtaggggcagggctggcatatacaggtttgtgactccaggagaacggccctcgggcatgttcgattcttcggtcctgtgtgagtgttatgacgcgggttgtgcgtggtacgaactcacgcccgctgagacctcggttaggttgcgggcgtacctaaacacaccagggttgcccgtctgccaggaccatctggagttctcggagggtgtcttcacaggcctcacccacatagatgcccacttcttatcccagactaaacaggcaggagagaacttcccctacttggtagcataccaggctacagtgtgcgccagggctcaagccccacctccatcgtgggatgaaatgtggaggtgtctcatacggctgaaacctacgctgcacgggccaacacccctgctgtataggttaggagccgtccaaaatgaggtcaccctcacacaccccataaccaaattcatcatgacatgtatgtcggctgacctggaggtcgtcaccagcacctgggtgctggtaggcggagtcctcgcagctctggccgcgtactgcctgacaacaggcagcgtggtcattgtgggcaggatcatcctgtccgggaagccggctatcatccccgatagggaagttctctaccaggagttcgacgagatggaggagtgtgcctcacacctcccttacttcgaacagggaatgcagctcgccgagcaattcaaacagaaggcgctcgggttgctgcaaacagccaccaagcaggcggaggctgctgctcccgtggtggagtccaagtggcgagcccttgagaccttctgggcgaagcacatgtggaacttcattagtgggatacagtacttggcaggcttgtccactctgcctgggaaccccgcaatacgatcaccgatggcattcacagcctccatcaccagcccgctcaccacccagcataccctcttgtttaacatcttggggggatgggtggctgcccaactcgccccccccagcgctgcctcagctttcgtgggcgccggcatcgctggagccgctgttggcacgataggccttgggaaggtgcttgtggacattctggcaggttatggagcaggggtggcgggcgcacttgtggcctttaagatcatgagcggcgagatgccttcagccgaggacatggtcaacttactccctgccatcctttctcccggtgccctggtcgtcgggattgtgtgtgcagcaatactgcgtcggcatgtgggcccaggggaaggggctgtgcagtggatgaaccggctgatagcgttcgcctcgcggggtaaccacgtctcccccaggcactatgtgccagagagcgagcctgcagcgcgtgttacccagatcctttccagcctcaccatcactcagctgttgaagagactccaccagtggattaatgaggactgctctacgccatgctccagctcgtggctaagggagatttgggactggatctgcacggtgttgactgacttcaagacctggctccagtccaagctcctgccgcgattaccgggagtcccttttttctcatgccaacgcgggtataagggagtctggcggggggacggcatcatgcacaccacctgcccatgcggagcacagatcaccggacacgtcaaaaacggttccatgaggatcgttgggcctaaaacctgcagcaacacgtggtacgggacattccccatcaacgcgtacaccacgggcccctgcacaccctccccggcgccaaactattccaaggcattgtggagagtggccgctgaggagtacgtggaggtcacgcgggtgggagattttcactacgtgacgggcatgaccactgacaacgtgaagtgtccatgccaggttccggcccccgaattcttcacggaggtggatggagtgcggttgcacaggtacgctccggcgtgcagacctctcctacgggaggaggtcgtattccaggtcgggctccaccagtacctggtcgggtcacagctcccatgcgagcccgaaccggatgtagcagtgctcacttccatgctcactgacccctcccacattacagcagagacggctaagcgtaggctggccagggggtctcccccctccttggccagctcttcagctagccagttgtctgcgccttccttgaaggcgacatgcactacccatcatgactccccggacgctgacctcattgaggccaacctcttgtggcggcaagagatgggcgggaacatcacccgcgtggagtcagagaataaggtggtaatcctggactctttcgacccgctccgagcggaggatgatgagggggaaatatccgttccggcggagatcctgcggaaatccaggaaattccccccagcgctgcccatatgggcgccgccggattacaaccctccgctgctagagtcctggaaggacccggactacgttcctccggtggtacacgggtgcccgttgccgcccaccaaggcccctccaataccacctccacggaggaagaggacggttgtcctgacagaatccaccgtgtcttctgccttggcggagctcgctactaagaccttcggcagctccggatcgtcggccatcgacagcggtacggcgaccgcccctcctgaccaagcctccggtgacggcgacagagagtccgacgttgagtcgttctcctccatgcccccccttgagggagagccgggggaccccgatctcagcgacggatcttggtccaccgtgagcgaggaggctagtgaggacgtcgtctgctgttcgatgtcctacacatggacaggcgccctgatcacgccatgcgctgcggaggaaagcaagttgcccatcaacccgttgagcaattctttgctacgtcaccacaacatggtctatgctacaacatcccgcagcgcaggcctgcggcagaagaaggtcacctttgacagactgcaagtcctggacgaccactaccgggacgtgcttaaggagatgaaggcgaaggcgtccacagttaaggctaaacttctatctgtagaagaagcctgcaaactgacgcccccacattcggccaaatccaaatttggctacggggcgaaggacgtccggagcctatccagcagggccgttacccacatccgctccgtgtggaaggacctgctggaagacactgaaacaccaattagcactaccatcatggcaaaaaatgaggttttctgtgtccaaccagagaagggaggccgcaagccagctcgccttatcgtgttcccagatctgggagttcgtgtatgcgagaagatggccctttatgacgtggtctccacccttcctcaggccgtgatgggctcctcatacggattccagtactctcctaagcagcgggtcgagttcctggtgaatacctggaaatcaaagaaatgccccatgggcttctcatatgacacccgctgttttgactcaacggtcactgagaatgacatccgtgttgaggagtcaatttaccaatgttgtgacttggcccccgaagccaaactggccataaagtcgctcacagagcggctctatatcgggggtcccctgactaattcaaaagggcagaactgcggttaccgccggtgccgcgcgagcggcgtgctgacgactagctgcggtaataccctcacatgttacctgaaagccactgcggcctgtcgagctgcgaagctccgggactgcacgatgctcgtgaacggagacgaccttgtcgttatctgtgaaagcgcgggaacccaagaggatgcggcgagcctacgagtcttcacggaggctatgactaggtactctgccccccctggggacccgcctcaaccggaatacgacttggagttgataacatcatgttcctccaatgtgtcggtcgcacacgatgcatctggtaaaagggtgtactacctcacccgtgaccctaccaccccccttgcacgggctgcgtgggagacagctagacacactccagtcaactcctggctaggcaacatcatcatgtatgcgcccaccttatgggcaaggatgattctgatgactcatttcttctccatccttctagctcaggagcaacttgaaaaaaccctagattgtcagatctacggggcctgttactccattgaaccacttgatctacctcagatcattgagcgactccatggtcttagcgcattttcactccatagttactctccaggcgagatcaatagggtggcttcatgcctcagaaaacttggggtaccacccttgcgagcctggagacatcgggccagaagtgtccgcgctaagctactgtcccagggggggagggccgccacttgtggcaagtacctcttcaactgggcggtgaggaccaagctcaaactcactccaatcccagccgcgtcccggttggacttgtccggctggttcgttgctggttacagcgggggagacatatatcacagcctgtctcgtgcccgaccccgctggttcatgttgtgcctactcctactttccgtgggggtaggcatctacctgctccccaaccgatgaatggggagctaaacactccaggccaataggccgtttctct

SEQ ID NO: 802 - DNA, 9431 bp, Hepatitis C Virus
gccagcccccgattgggggcgacactccaccatagatcactcccctgtgaggaactactgtcttcacgcagaaagcgtctagccatggcgttagtatgagtgtcgtgcagcctccagggccccccctcccgggagagccatagtggtctgcggaaccggtgagtacaccggaattgccaggacgaccgggtcctttcttggattaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgactaggaagacttccgagcggtcgcaacctcgtggaaggcgacaacttattcccaaggctcgccagcccgagggcaggtcctgggctcagcccgggtacccttggcccctctatggcaatgagggcatggggtgggcaggatggctcctgtcaccccgtggctcccggcctagttggggccccacagacccccggcgtaggtcgcgtaatctgggtaaggtcatcgataccctcacatgcggcttcgccgacctcatggggtacattccgctcgtcggcgcccccctagggggcgctgccagggccctggcacatggcgtccgggtcctggagggcggcgtgaactatgcaacagggaatctgcccggttgctctttctctatcttcctcttggctttgctgtcctgtttgaccatcccagcctccgcttatgaagtgcgcaacgtgtccggggtgtaccatgtcacgaacgactgctctaactcaagcattgtgtatgagacagcggacatgatcatgcacacccccgggtgcgtaccctgcgttcgggaggacaactcctcccgctgctgggtagcgcttacccccacgctcgcggccaggaacgccagcatccctactacgaccatacgacgtcacgtcgatttgctcgtgggggcggctgctttctgctccgctatgtacgtgggggatctctgcgggtctgttttcctcgtctctcagctgttcaccttctcgcctcgccgacatgcgacagttcaggactgcaattgctcaatctatcccggccacgtatcaggtcaccgcatggcttgggatatgatgatgaactggtcgcccacagcagctctagtggtatcgcagttactccggatcccgcaagccgtcgtggacatggtggcaggggcccactggggagtcctggcgggccttgcctactattccatggtggggaactgggctaaggtcctgattgtgatgctactcttcgcaggcgttgacgggactaccaccgtgacgggggggtcgcaagctcgaaccgtctacgaactgacaagcctctatacacgcgggccgtctcagagaatccagctcgtaaacaccaacggcagctggcacatcaacaggacggccctgaactgtaatgactccctccagaccgggttccttgccgcgctgttctacacacgcagcttcaacagctccggatgcccagagcgcatggccagctgccgctccatcgaccagttcgatcaggggtggggtcccatcacctacgctgagccacgcgacttggaccagaggccctattgctggcactacgcgccgcgaccgtgtggtatcgtacccgcgtcgcaggtgtgtggtccagtgtattgcttcaccccaagccccgttgtggtggggacgaccgatcgctccggcgtccctacgtatagctggggggagaatgagacggacgtgctgctccttaacaacacgcggccgccgcagggcaactggtttggctgtacatggatgaatagcactgggttcaccaagacgtgcgggggccccccatgtggcatcgggggggtcggcaacaacaccttgatctgccccacggactgcttccggaagcacccggaggccacttacaccagatgcggttcggggccttggttgacacctaggtgcatggttgactatccatacaggctttggcactacccctgcactgtcaactttaccatcttcaaggttaggatgtatgtggggggcgtagagcacaggctcaacgccgcgtgcaactggactcgaggagagcgttgtgacctggaagacagggatagatcagagctcagcccgctgctactgtctacgacagagtggcaggtactaccctgttccttcactaccctaccagctctgtccaccggcttgatccatctccatcagaacgtcgtggacgtgcaatacctctacggtatagggtcagtggttgtctcctttgcaatcaaatgggagtacatcctgttgctcttccttcttctggcggatgcgcgcgtctgtgcctgcttgtggatgatgctgctgatagctcaggctgaggccgccttggaaaacctggtggtcctcaacgcggcgtccctggccggaacgcacggcattctctccttccttgtgttcttctgtgctgcctggtacatcaaaggcaggctggtccctggagcggcatatgctctctatggcgtatggccgctactcctgctcctattggcattaccaccacgagcatacgccttggaccgggagatggctgcatcatgcggaggcgcggtttttgtaggtctgataatcttgaccttgtcaccgcactacaaagcgttcctcgctaggctcatatggtggttacagtattttatcaccagagccgaggcgcttttgcaagtgtggatcccccccctcaacgttcgggggggccgcgatgccatcatcctcctcacatgcgcggttcacccagggttaatctttgacatcaccagactcctgctcgccatactcggtccactcatggtgctccaggctggcataacaagagtgccgtactttgtgcgcgctcacggcctcattcgtgcatgcatgttggtgcggaaagtcgctgggggtcattatgtccaaatggctttcatgaagctagctgcactgacgggcacgtacgtttatgaccatcttaccccgctgcgggactgccggcatgcgggcctacgagaccttgcggtggcggttgagcccgttgttttctccgccatggagactaagatcatcacctggggggccgacaccgcggcgtgcggggacatcatcttgggcctacccgtctccgcccgaagggggagggagatacttctgggaccggccgatagtctcgaagggcaggggtggcggctccttgcgcctatcacggcctacgctcaacagacgcgaggcctacttggctgcatcattactagcctcacaggccgggacaagaaccaggttgagggggaggtccaagtggtttccactgcgacacaatctttcctggcgacctgcgtcaacggcgtgtgttggactgtctaccatggtgccggctcgaagaccctagccggcccaaagggcccagtcacccaaatgtacaccaatgtggaccaggacctcgtcggctggcaagcgccccccggggcgcgttctctgacaccatgcacctgcggcagctcggacctttatttggtcacgagacatgccgatgtcattccggtgcgccggcggggcgacagcagggggagcctgctttcccccaggcccgtctcctacttgaagggttcttcgggtggtccactgctctgcccctcggggcacgccgtgggcatcttccgggctgccgtgtgcacccggggggttgcgaaggcggtggactttgtgcccgttgagtctatggaaactaccatgcggtccccggttttcacggacaactcatccccgccggccgtaccgcagacattccaagtggcccatctacacgcccctactggaagcggcaagacgactaaagtgccggctgcatatgcagcccaagggtacaaggtactcgtcctgaacccatctgttgctgccaccctaggctttggggcgtatatgtctaaggcacatggtatcgaccccaacatcagaactggggtaaggaccatcaccacgggcgcccctatcacgtattccacctatggcaagttccttgcggacggtggttgctctgggggtgcctacgatatcataatatgtgatgaatgccactcaactgactcgacctccatcttgggcattggcacggtcctggaccaagcggagacggctggagcgcggcttgtcgtgctcgccaccgctacgcctccgggatcggtcaccgtgccacactctaacatcgaggaggtggctctgtccaacattggagagattcccttctatggcaaagccattcccctcgagaacatcaagggggggaggcatctcattttctgtcactctagaaagaaatgtgacgagctcgctgcaaaactgtcgggcctcggaatcaatgctgtagcgtattaccggggtctcgatgtgtccgtcataccgaccagcggagacgtcgttgtcgtggcaacagacgctctgatgacgggctacaccggcgactttgactcagtgatcgactgtaatgtatgtgtcacccagacagtcgacttcagcttggaccctacattcaccattgagacgacgaccgtgccccaagacgcggtgtcgcgctcgcaacggcgaggcaggactggcaggggcaggatgggcatttacaggtttgtgactccaggagaacggccttcgggcatgttcgattcctcggtcctgtgtgagagctatgacgcgggctgtgcttggtatgagctcacgcccgccgaggcctcagtcaggttgcgggcttacctaaacacaccagggttgcccgtttgccaggaccatctggagttctgggagagcgtcttcacaggcctcacccacatagatgcccacttcttgtcccagactaagcaggcaggagacaacttcccctatctggtagcgtaccaggccacagtgtgcgctagggcccaagccccacccccatcgtgggatcaaatgtggaagtgtctcatacggctaaagcctacgctgcacgggccaacacccctgctgtacaggctaggagccgtccaaaacgaggtcaccctcacacaccccatcaccaagttcatcatggcatgcatgtcggccgacctggaggtcgtcacgagcacctgggtgcttgtaggcggggtcctcgcagccttggccgcgtactgcctgacaacaggctgcgtggtcatcgtgggcaggattatcttgtccgggaggccggcaattgttcccgacagggaagtcctctaccaggagttcgatgagatggaagagtgcgcctcacacctcccttacatcgaacagggaatgcaactcgccgaacaattcaagcagaaggcgctcgggttgctgcaaacagccaccaagcaagcggaggccgctgctcccgtggtggagtccaagtggcgagcccttgaggccttctgggcgaagcacatgcggaacttcatcagcgggatacagtacctagcaggcttgtccactctgcctgggaaccccgcaatagcatcactgatggcattcacagcctccatcaccagcccgctcaccacccaaagtaccctcctgtttgacatcttgggggggtgggtggccgctcaactcgccccccccagcgccgcctcggctttcgtcggcgccggcatcgctcgggccgctgttggcagtataggtcttgggaaggtgcttgtggacatcctggcgggctatggggcaggggtagcaggcgcactcgtggcctttaaggtcatgagcggcgaagtgccctccacagaggacctgatcaatctgctccctgccatcctctctcctggtgccctggttgtcggggtcgtgtgcgcggcaatactgcgcgggcatgtgggcccgggagagggagctgtgcagtggatgaaccggctgatagcgttcgccttcgcgggtaaccacgtctcccccacgcactatgtgcctgagagcgacgctgcagcgcgtgtcacacagatcctctctagcctcaccatcacccaactgctgaagaggctccaccaatggatcaatgaggactgctccacgccatgctccggctcgtggctgagggatgtttgggactggatatgcacggtgttgactgacttcaagacctggctccagtccaagctcctgccgcggctgccaggagtccccttcctctcatgccaacgtgggtacaggggagtttggcggggggacggcatcatgcacaccacctgcccatgcggagcacaaatggccggacatgtcaaaaacggttccatgaggatcgttgggcccaaaacctgcagcaacacgtggtatggatcattccccatcaacgcatacaccacgggcccctgcacaccctccccggcgccaaactactccagggcgctgtggcgggtagctgctgaggagtacgtggaggtcacgcgggtgggggatttccactatgtaacgggcatgaccactgacaacataaaatgcccatgccaggttccagcccccgaattcttcacggaagtggatggggtgcggctgcacaggtatgctccggcatgcaagcccctcctgcgggatgaggtctcgttccaggtcgggctcaaccactatccggtcgggtcacaactcccatgcgagcccgaaccggacgtggcagtgctcacttccatgcttaccgacccctcccacattacagcagagacggctaagcgtaggctggccagggggtctcccccctccctggccagctcttcagctagtcagttgtctgcgccttctttgaaggcgacatgcactacccgccatgactccccagatgccgatctcatcgaggcccacctcctgtggcggcaggagatgggcgggaacatcacccgcgtggagtcagagaacaaggtagtaattctggactctttcgacccgctccgagcggaggaggatgagagggaagtatccgttccggcggagatcctgcggaaatccaggaagtttcccccagcgatgcccatatgggcgcgcccggattacaaccctccactgttagagtcctggaaggacccggactacgtccctccggtggtgcatgggtgcccattgccgcctaccaaggcccctccaataccacctccacggaggaaaaggacggttgtcctgacagagtctactgtgtcttctgccctggcggagctcgccacaaagaccttcggcagctccgaatcgtcggccgtcgacagtggcacggcgaccgcccctcctggccaatcctccgacgacgtcgacacaggatccgacgttgagtcgtactcctccatgcccccccttgagggggaaccgggggaccccgatctcagcgacgggtcttggtctaccgtgagcgaggaggccaacgaggatgtcgtctgctgctcgatgtcctacacgtggacaggcgccctgatcacgccgtgcgctgcggaggagagcaagctgcccatcaacgcgttgagcaactctttgctacgccaccataacatggtatatgccaccacatcccgcagcgcaagccagcggcagaagaaagtcacctttgacagacagcaagtccaggacgaccactaccgggacgtgctcaaggagatgaaggcgaaggcttccacagttaaggccaggctcctatctgtagaagaagcctgcaagctgacgcccccactttcagccagatccaaatttggctatggggcaaaggacgttcggaacctatccagtaaggccgttaaccacatccgctccgtgtgggaggacttgctggaagacaatgtgacaccaattgacactaccatcatggcaaaaaatgaggttttctgtgtccaaccagagaaaggaggtcgcaagccggctcgccttatcgtgttcccagacttgggagttcgtgtgtgcgagaaaatggccctctacgacgtggtctccactcttcctcataccgtgatgggctcctcatacgggtttcagtactctcctggacagcgggtcgagttcctggtgaatacctggaaatcaaagaaatgccctatgggctttgcttatgacacccgctgttttgactcaacggtcactgagaacgacatccgtgttgaggagtcaatttaccaatgttgtgacttgggccccgaagccaggcaggccataaggtcgctcacagagcggctttatatcgggggtcccctgactaattcaaaagggcagaactgcggttatcgccggtgccgcgcgagcggcgtgctgacgactagctgcggtaataccctcacctgttacttgaaggccactgcagcctgtcgagctgcgaagctccaggactgcacgatgctcgtgtgcggagacgacctcgtcgttatctgtgagagcgcgggaactcaggaggacgcggcgaacctacgagtcttcacggaggctatgactaggtactctgccccccccggggacccgccccaaccagaatacgacttggagttaataacatcatgctcctccaatgtgtcggtcgcgcacgatgcatccggcaaacgggtgtactacctcacccgtgaccccaccaccccccttgcgcgggctgcgtgggagacagctagacacacttcagtcaactcctggctaggcaacatcatcatgtatgcgcccaccttatgggcaaggatgattctgatgactcacttcttctccatccttctagcccaggagcaacttgaaaaagccctagactgtcagatctacggggcttgctactccattgagccacttgacctacctcagatcattcaacgactccatggtcttagcgcattttcactccatagttactctccaggtgagatcaatagggtggcttcatgcctcaggaaacttggggtaccgcccttgcgagtctggagacatcgggccagaagtgtccgcgctaagctactgtccccggggggggagggctccacttgtggcaaatacctcttcaactgggcagtaaggaccaagcttaaactcactccaattccggctgcattccagttggacttgtccggctggttcgttgctggttacagcgggggagacatatatcacagcctgtctcgtgcccgaccccgctggttcatgtggtgcctactcctactttctgtaggggtaggcatctacctgctccccaacaggtgaacggggagctaaacactccaggccaataggccattctgttttttttttttttttttt

SEQ ID NO: 803 - DNA, 9400 bp, Hepatitis C Virus
gccagcccccgattgggggcgacactccaccatagatcactcccctgtgaggaactactgtcttcacgcagaaagcgtctagccatggcgttagtatgagtgtcgtgcagcctccaggtccccccctcccgggagagccatagtggtctgcggaaccggtgagtacaccgaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcatcatgagcacaaatcctaaacctcaaagacaaaccaaacgtaacaccaaccgccgcccacaggacgtcaagttcccgggcggtggtcagatcgttggtggagtttacctgttgccgcgcaggggccccaggttgggtgtgcgtgcgactaggaagacttccgagcggtcgcaacctcgtggaaggcgacaacctatccccaaggctcgccgcccgagggcaggacctgggctcagcccgggtacccttggcccctctatggcaatgagggcctagggtgggcaggatggctcctgtcaccccgcggctcccggcctagttggggcccctcagacccccggcgtaggtcgcgtaacttgggtaaagtcatcgataccctcacatgcggcttcgccgacctcatggggtacattccgctcgtcggcgcccccctagcggttgccagggccctggcgcatggcgtccgggctgtggaggacggcgtgaactatgcaacagggaatctgcctggttgctctttctctatcttcctcttagctttgctgtcctgcctgaccatcccagcttccgctcctgaagtgcgcaacgtgtccggggtgtaccatgtcacgaacgactgctccaactcaagtattgtgtatgaggcagcggacatgatcatgcatacccctgggtgcgtgccctccgtgcgggagagcaatttctcccgctgctgggtagcgctcactcccacgctcgcggccaggaacagcagtatccccaccacgacgatacggcgccatgtcgacttgctcgttggggtagctgctttccgttccgccatgtacgtgggggatctctgcggatctgtcttcctcgtctcccagctgtttgccttctcgccccgccggtatgagacggtacaggactgcaattgttcaatctatcccggtcatgtatcaggtcatcgcatggcttgggatatgatgatgaactggtcgcccacaacagccctagtggtgtcgcagttactccggatcccacaagccgtcgtggatatggtggcgggagcccactggggagtcctggcgggccttgcctactattccatggtgggaaactgggctaaggttttgattgtgatgctgctctttgccggcgttgacggggctacctacgcagcggggggggcagcaggcataccacccgcggcttcacgtccctctttacatctggggcttctcagaacattcagcttgtaaacaccaatggcagttggcacatcaacaggacagccctgaactgcaacgattccctcaacaccgggtttattgcctcgctgttttacacgcacaggttcaactcgtccggatgcccagagcgcatggccacgtgccgccccattgacaagttcgatcagggatggggtcccatcacctatgctgagcatggaggcccggaccagaggccttactgctggcactacgcacctcaaccgtgtggtattgtgcccgcgtcgcaggtgtgtggccctgtgtattgcttcaccccgagccctgttgtggtggggacgaccgaccgcttcggcgcccccacgtataactggggggtgaatgagacggacgtgctaattctcaacaacacgcggccaccgcaaggcaactggttcggctgtacatggatgaatagcaccgggttcaccaagacgtgcgggggccccccgtgtaacatcgggggggccggcaacaacaccttggtctgccctacggattgcttccgaaagcaccccgaagccacttacaccaaatgtggctcggggccttggttgacacctcggtgcatagttgactacccatacagactttggcactacccttgcactgtcaactttaccctctttaaggtcaggatgtatgtggggggtgtggaacacaggctcaccgccgcgtgcaattggactcgaggagagcgctgtgaattgggggatagggataggtcagagcttagcccactgctactgtctacaacagagtggcagatactgccctgttccttcaccaccctaccggctctgtccactgggctgatccacctccaccagaacatcgtggacgtgcagtacctgtatggtgtagggtcagcggtcgtctccgtcgtaatcagatgggagtatgtcctgctgcttttcctcctcctggcggacgcgcgcgtctgtgcctgcttgtggatgatgctgctaatagcccaggctgaggccgctttagagaacttggtgatcctcaatgcgccgtccgtggccggaaggcacggcgtcctctccttccttgtgttcttctgtgctgcctggtacatcaagggtaagctggtccccggggcggcgtatgctctctatggcgtatggccgctgctcctgcttctgctggcgttaccaccacgcttacgccatggaccgggagatggctgcatcgtgcggaggcgcggttttcgtaggtctggtactcttgaccttgtcaccacactataaaacattcctcgctaagctcatatggtggttgcaatatttcatcaccagggccgaagcgtacttacaagtgtggatcccccctctcaacgtccgggggggccgcgatgccatcatcctcctcacgtgcgtggtccacccagagctaacttttgaaatcaccaaaatcctgctcgctatttttggtccactcatggtgctccaagccggcctaactagagtgccgtacttcgtgcgcgctcaggggctcatccgtgtgtgcatgttggtgcggaaagtcgctggggatcactatgtccaaatggctctcatgaagctggccgcattgacgggtacgtacgtttacaaccatctcactccgctgcgggactgggcccatgcgggcctgcgagacctcgcagtggcagttgagcccgttgttttctctgacatggagaccaagatcatcacctggggcgcggatactgcagcgtgtggggacatcatctcgggtctacccgtctccgcccgaagagggagggagatacttcttggaccggctgacagtttcggagagcaggggtggcgactccttgcgcctatcacggcctattcccaacagacgcggggcctgcttggctgcatcatcactagccttacaggccgggacaagaaccaggtcgagggagaggttcaggtggtttccaccgcaacgcaatctttcctagcgacctgcgttaacggcgtgtgttggactgtctaccatggcgctggttcaaagacccttggcccgggaaagggcccaattacccaaatgtacaccaatgtagaccaggacctcgttggctggcagcggcctccgggtcgcgttccttgacaccatgcacctgcggcagctcggacctttatttggtccctatggcaagttccttaccgatgtcattccagtgcgccggcggggcgacagcagggggagcctactctcccccagacccgtgtcctacttgaagggctcctcgggtggtccactgctctgccccttggtgcttgtttcatcttccgggccgctgtgtgcactcggggagtcgcgaaggcggtggattttgtacccgtcgagtctatggaaaccaccatgcggtctccggtcttcacggataattcatctcccccggccgtaccgcagacattccaagtggctcatctgcacgcccccactggcagcggcaagagcaccaaagtggctgcatacgcagcccaagggtacaaggtactcgtcctgaacccgtccgttgctgctaccttgggttttggggcgtacatgtctaaggcacatggtgttgaccctaacatcagaactggggtaaggaccatcaccacgggcgctcccatcacgtactccacctatggcaagtttcttgccgacggtggttgctctgggggcgcctatgatatcgtaatatgtgatgaatgccactcaactgactcgacttccatcttgagcattggcacagttctggaccaagcggagacggctggagcgcgactcgtcgtgctcgccaccgccacacctccgggatcggtcaccgtgccgcatcctaatattgaggaggtggccttgtccaacaccggagagattcccttctatggcaaagccatccccctcgagaccatcaagggggggaggcatctcattttctgccattccaaggaggaatgtgacgaactcgctgctaagctgtcggccctcggagtcaatgctgtagcatactaccggggtctcgacgtgtccgtcataccaacaagcgggaacgttgttgtcgtggcaacagacgctctaatgacgggctacaccggcgacttcgactcagtgatcgactgtaatacatgtgtcactcagacagtcgacttcagcttggaccctaccttcaccattgagacgacgaccgtgcctcaagacgcggtgtcggcctcgcagcggcgaggcaggactggcaggggcaggaggggcatatacaggtttgtgactccgggagaacggccctcgggcatgttcgattcttcggtcctgtgtgaatgctatgacgcgggctgtgcttggtacgacgtcacgcctgccgagacctcagttaggctgcgggcttacctaaatacaccagggttgcccgtttgccaggaccatctggagttctgggagagcgtcttcacaggcctcacccacatagatgcccacttcttgtcccagactaagcaggcaggggacaacttcccctacctggtagcataccaagctacggtgcgtgccagggctcaggctccgcccccatcatgggatcagatgtggaagtgcctcatacggctgaagcctacgttacacgggccaacacccctgttgtataggctaggagccgtccaaaacgaggtcatccttacacatcccatgaccaagtacatcatgacatgcatggcagctgacctggaggtcgtcacgggcacctgggtgctggtaggcggggtccttgcagctctggccgcgtactgcctgacaacgggcagcgtggtcattgtgggcaggatcatcttatccgggaagccggctatcattcctgacagggaagtcctctaccgggagttcgatgaaatggaagatggcgcctcgcaccttccctacatcgaacagggaatgcagctcgccgagcaattcaagcagagggcgctcgggttgttgcaaacagccaccaagcaagcggaggctgctgctcccgtggtggagtccaagtggcgagcccttgaggtcttctgggcgaacgacatgtggaacttcatcagcgggatacagtacttagcaggcttgtccactctgcctgggaaccccgcgatagcatcactaatggcattcacagcctctatcaccagcccgtttaccacccaacaaaccctcttgtttaacatcttgggggggtggttggctgcccaactcgccccccccagcgctgcttcagcttttgtgggcgccggcattgttggggcggctgtcggcagcataggccttggaaaggtgctcgtggacatcttggcgggatatggggcgggggtggcaggcgcactcgtggcgtttaaaatcatgagcggcgatatgccctcctccgaggacttggtcaacttacttcccgccatcctctctcccggtgccctggtcgtcggggtcgtgtgcgcagcaatactgcgtcggcatgtgggcccgggagagggggctgtgcagtggatgaaccggctgatagcgttcgcctcgcggggtaaccacgtctcccccacgcactacgtgcctgagagcgacgccgcggcgcgcgtcacccagattctctccaaccttaccatcactcagctgttgaagaggctccaccagtggattaatgaggactgctccacgccatgttccggctcgtggctcagggatgtttgggactggatatgcacggtgttgactgacttcaagacctggctccagtccaagctcctgccacggctgccgggagttcccttcttttcatgccaacgtggatataagggagtctggcggggagacggagtcatgcataccacctgcccatgtggagcacaaattaccggacatgtcaaaaccggttccatgaggatcgttgggcctaaaacctgtagcaacgcgtggcacggaacattccctatcaacgcatacaccacaggcccctgcacgccctcgccagcgccaaactattccaaggcgttattgtggcgggtggcggaggagtacgtggaggttacgcaggtgggggatttccactacgtgacgggcatgactactgacaacataaaatgcccatgccaggtcccgtcccccgaattcttcacggaattggacggggtgcggctgcacaggtacgctccagcatgcaaacctctcctacgggatgaggtcacattccaggtcgggctcaaccaatacccggttgggtcgcagctcccatgcgaacccgaaccggatgtagcagtgctcacttccatgcacaccgacccctcccacattacagcagaaacggctaggcgtaggctggccagggggtctcccccctccttggccagctcttcagccagccagctgtctgcgccttccttgaaagcggcatgcactacccatcacgactccccagacgccgacctcatcgaggccaacctcctgtggcggcaggagatgggcgggaacatcacccgcgtggagtcggagaacaaggtagtaattctagactcttttgaccctcttcgagcggaggaggatgagagggaagtgtcgtccggcggagatctgcggaaaaccaagaggtttcccctggcgctacctatatgggcacgcccggactacaatccaccacttttacagccttggaaggacccggactacgtccctccggtagtacacgggtgcccattgccacctactaaggcccctccaataccacctccacggagaaagaggacggttgtcctgacagagtctaccctgtcttctgccttggcggagcttgctacaaagaccttcggcagctctgaatcgtcggctgttgacagcggcatgtcgactgcccctcctgatcaggcctccgacgatggagatgcaaaatccgatgttgagtcgtactcctccatgcccccccttgagggagagccgggggaccccgatctcagcgacgggtcttggtctactgtgagcgaggaggctggtgaggacgtcgtctgttgttcgatgtcctacacatggacaggcgctttaatcacaccatgcgccgcggaggagagcaagctgcccatcaatgcgttaagcaactctttgctgcgtcaccacaacatggtctatgccacaacatcccgcagcgcaagccagcggcagaagaaggtcacctttgacagactgcaggtcctggacgatcactaccgggacgtgctcaaggagatgaaggcgaaggcgtccacagtcaaggctagatttctatcagtggaagaagcctgcaactggacgcccccacactcggccagtctaaaatttggctacggggcaaaggacgtccggaacctatccagcaaggccgtcaaccacatccgctccgtgtggaaggacttgctggaagactctcagacaccaatcgacaccaccatcatggcaaaaaatgagatcttttgtgtccaaccagagaaaggaggtcgcaagtcagctcgccttatcgtattcccagacttgggggttcgtgtgtgcgagaaaatggctctttacgacgtagtctccactcttcctcaggccgtgatgggctcctcgtacggattccagtactctcctgggcagcgggtcgagttcctggtgaatgcctggaaatcaaagaaaagccctatggtctcatatgacacccgctgttttgactcaacggtcactgagagtgacatccgtgttgaggagtcaatttaccaatgttgtgacttggcccccgaagccagacaggccataaggtcgctcacagagcggctttatatcgggggtcccctaacaaattcaaaagggcaggactgcggttatcgccggtgccgcgcgagcggcgtgctgacgaggagctgcggtaatacccttacatgttacttgaaagcctctgcagcctgtcgagctggaagccaggactgcacgatgctcgtgtgcggggacgaccttgtcgttatctgtgaaagcgcggggacccaggaggacgcggcgaacctgcgagtcttcacggaggctatgaccaggtactctgccccccccggggacctgccccaaccggaatacgacaaggagttgataacatcatgctcctcaaacgtgtcagtcgcgcacgatgcatctggcaaacgggtgtattacctcacccgtgaccccgcctccccccttgcgcgggctgcgtgggagacagctagacacactccagttaactcctggctaggcaacatcatcatgtatgcgcccaccttgtgggtaaggatgattttgatgacccatttcttctccatccttctagctcaggagcaacttgaaaaagccctagattgccagatctacggggccacttactccattgagccacttgacctacctcagatcatacagcgactccatggtcttagcgcattttcactccatagttactctccaggtgaaatcaatagggtggcttcatgcctcaggaaacttggggtaccacccttgcgagtctggagacatcgggccagaagtgtccgcgctaagctactgtcccaaggggggagggctgccacttgtgaatacctcttcaattgggcggtaaagaccaagcttaaactcactccaatcccggctgcgtcccagctggacttgtccggctggttcgtcgctggttacagcgggggagacatatatcacagcctgtctcgtgcccgaccccgctggttcatgtggtgcctactcctactttctgtaggggtaggcatctatctgctccccaaccgatgaacggggagctaaacactccaggccaataggccaataggccatcctg

SEQ ID NO: 804 - DNA, 9408 bp, Hepatitis C Virus
ggcgacactccaccatagatcactcccctgtgaggaactactgtcttcacgcagaaagcgtctagccatggcgttagtatgagtgtcgtgcagcctccaggaccccccctcccgggagagccatagtggtctgcggaaccggtgagtacaccggaattgccaggacgaccgggtcctttcttggatcaacccgctcaatgcctggagatttgggcgtgcccccgcgagactgctagccgagtagtgttgggtcgcgaaaggccttgtggtactgcctgatagggtgcttgcgagtgccccgggaggtctcgtagaccgtgcaccatgagcacaaatcctaaacctcaaagaaaaaccaaacgtaacaccaaccgccgcccacaggacgtcaagttcccgggcggtggtcagatcgttggtggagtttacctgttgccgcgcaggggccccaggttgggtgtgcgcgcgaccaggaagacttccgagcggtcgcaacctcgtggaaggcgacaacctatccccaaggctcgccagcccgagggcagggcctgggctcagcccgggtacccttggcccctctatggcaatgagggtctggggtgggcaggatggctcctgtcaccctacggctcccggcctaggtggggccccacggacccccggcgtaggtcgcgtaatttgggtaaggtcatcgataccctcacatgcggcttcgccgacctcatggggtacattccgctcgtcggggcccccctaggaggcgctgccagggccctggcgcatggcgtccgggttctggaggacggcgtgaactacgcaacagggaatctgcccggttgctctttttctatcttcctcttggccttgctgtcctgtctgaccgtcccagtttccacttatgaagtgcgcaacgtgtccggggtgtaccatgtcacgaacgactgctccaactcaagtattgtgtatgaggcagcggacatgattatgcatacccccgggtgcgtaccctgcgtccgggagggtaattcctcccgctgctgggtagcgctcactcccacgctcgcggccaggaacagcagcatccccactacgacaatacgacgacatgtcgatttgctcgttggggcagctgctctctgctccgctatgtacgtgggggatctctgtgggtctgttttcctcgtctcccaattgttcaccttctcacctcgccggtatgagacggtacaggactgcaattgctcactctatcccggccacgtatcaggtcaccgtatggcttgggatatgatgatgaactggtcacctacaacagccttagtggtgtcgcagttactccggatcccacaagccgtcgtggacatggtggtgggggcccactggggagtcctggcgggcctcgcctactattccatggtggggaactgggctaaggtcttgattgtgatgctactctttgccggcgttgacgggactacctacgtgtcagtggggcatgcaagccagaccacccggcgcgttgcgtccttcttcagtcctggctcggctcagaaaatccaacttgttaacaccaacggcagttggcacatcaacaggactgccctgaattgcaacgagtccatcaacactgggttctttgccgcgctgttctacgtaaagaagttcaactcgtctggatgctcagagcgcatggctagctgtcgtcccattgacaggttcgctcaagggtggggtcccatcacccatgctgagtctcgcagctcggaccaaaggccttactgctggcactacgcacctcaaccgtgtggtatcgtgcccgcgttgcaggtgtgcggtccagtgtattgtttcaccccaagccctgttgtagtggggacgaccgaccgtttcggcgtccccacgtataactggggggacaatgagacggacgtgctactcctcaacaacacgcggccgccgcaaggaaactggttcggctgtacatggatgaacagcaccgggttcaccaagacgtgcgggggccccccgtgtaatatcgggggggccggcaacaacaccttgacctgccccacggattgcttccggaagcaccccgaggccacttacaccaagtgcggctcggggccttggttgacacctaggtgcatggttgactacccatacagactttggcactacccctgcactttcaactttaccatctttaagatcaggatgtatgtggggggtgtggagcacaggctcaacgcagcgtgcaactggactcgaggagagcgttgtaacatagaggacagggataggtcagagcttagcccgctgctactgtctacaacggagtggcagatactaccctgttcctttaccaccctaccagctctgtccactggtttgatccacctccatcagaacatcgtggacgtgcaatacctgtacggtgtagggtcagcagttgtctccattgtgatcaaatgggagtacgttctgctgctcttcctcctcctggcggacgcgcgcgtctgcgcctgcttatggatgatgctgctgatagcccaggctgaggccgccttagaaaacctggtggtcctcaatgcggcgtccgtggccggagcgcatggcatcctctcatttcttgtgttcttctgtgcagcctggtacatcaagggcaggctggtccctggggcggcatatgctttttatggcgtgtggccgctgctcctgctcctgttggcgttaccaccacgggcatacgccatggaccgggagatggccgcatcgtgcggaggcgcggttttcgtaggtctagcactcttgaccttgtcaccacactataaagcattcctcgccaggctcatatggtggttacaatattttatcaccagggtcgaggcgtgcttgcaagtgtgggtcccccctctcaacgtccgggggggccgcgatgccatcatcctcctcacgtgcgcggtccactcagagctaatctttgacatcaccaaaattctgctcgccatatttggaccgctcatggtgctccaggctggcctaactagagtgccgtacttcgtgcgcgctcaagggctccttcgtgcatgcatgttggtgcggaaggtcgctgggggccattatgtccaaatggctctcatgaagctggccgcactgactgggacgtacgtttatgaccatcttactccgctgcgggactgggcccactcgggcctgcgagaccttgtggtagcggtcgagcccgtcgtcttctccgacatggagaccaagatcatcacctggggggcggacacagcggcgtgtggggacatcatcttgggtctgcccgtctccgcccgaagggggagggagatacttctgggaccggccgatggtttcagagagcagggatggcgactccttgcgcccatcacggcctactcccaacagacgcggggcctatttggctgcatcgtcactagtctcacaggtcgggacaagaaccaggtcgaaggggaggctcaggtggtttccaccgcaacgcaatctttcttggcgacctgtgtcaacggcgtgtgttggactgtttaccatggcgccggctcaaagaccctagccggcccaaaggggccaatcaaccaaatgtacactaatgtggatcaggacctcgtcggctggcaggcgccctccggggcggcttccttgacaccgtgcacctacggcagctcggacctttacttggtcacgaggcatgctgatgtcattccggtgcgccggcggggcgacagcagggggagtctactttcccccaggcccgtctcctacttgaagggctcttccggtggtccactgctctgcccctcggggcacgctgtgggcatcttccgggctgctgtgtgcacccggggggttgcgaaggcggtggacttcatacccgttgagtctatggaaactaccatgcggtctccggtcttcacggataattcttctcccccggccgtaccgcagacattccaagtggcccatctacatgctcccactggcagcggcaagagcactaaggtgccggctgcatacgcagcccaagggtacaaggtactcgtcctgaacccgtccgttgccgccaccttgggttttggggcatacatgtccaaggcacatggtgttgaccctaacatcagtactggggtaaggaccatcaccacgggcgcccctatcacgtactccacctacggcaagttccttgccgacggtggttgctccgggggcgcctatgacatcataatatgtgacgagtgccattcaactgactcgacttctatcttaggcatcggcacggtcctggaccaagcggagacggctggagcgcggctcgtcgtgctcgccgccgctacgcctccgggatcggtcaccgtgccacatcccaacattgaggaggtggccttgcctaacaccggagagattcccttctatggcaaagccatccccctcgagaccatcaagggggggaggcatctcatcttctgccattccaagaagaagtgtgatgagctcgctgcaaagctgtcggccctcggggtcaatgctgtagcgtactaccggggccttgatgtgtccgtcataccgacaagcggagacgtcgttgtcgtggcaacagacgccctaatgacaggctacaccggtgactttgattcagtgatcgactgtaatacatgtgtcacccagacagtcgacttcagcttggaccctaccttcaccattgagacgacaacgctgccccaagacgcggtgtcgcgctcacaacggcgaggcagaactggcaggggtagagggggcatatacaggtttgtgactccaggggaacggccttcgggtatgttcgattcttcggtcctatgtgagtgctatgacgcgggctgtgcttggtacgagctcacgcccgcagtgacctcggttaggctgcgggcttacctaaatacaccagggttgcccgtctgccaggtccacctggagttctgggagagcgtctttacaggcctcacccacatagatgcccacttcttgtcccagactaagcaggcaggagagaacttcccctacctggtggcataccaggccacagtgtgcgccagggcccaggccccacctccatcgtgggatcaaatgtggaagtgtctcatacggctaaagcctacgctgcacgggccaacacccctgttgtataggctaggagccgtccaaaacgaggtcaccctcacacaccccataaccaaattcatcatggcatgcatgtcggctgatctagaggtcgtcaccagcacctgggtgctggtaggcggagtcctcgcagctctggccgcgtactgcctgacaacgggcagcgtggttattgtgggcaggatcatcttgtccgggaggccggctatcattcctgacagggaagtcctctaccaggagtttgatgagatggaggagtgcgcctcacaccttccttacatcgaacaaggaatgcagctcgccgagcaattcaagcagaaggcgctcgggctgctgcaaacagcctccaagcaagcggaggctgctgctcctgtggtagagtccaagtggcaagcccttgaggccttctgggcgaagcacatgtggaacttcatcagcgggatacagtatctagcaggcttgtccaccctgcctggaaaccccgcaatagtatcactgatggcattcacagcctctatcactagcccgctcaccacccaacataccctcctgtttaacatcttagggggatgggtggccgcccaactcgccccccccagcgctgcttcagccttcgtgggcgccggcatcgctggcgcggctgttggcagcataggccttgggaaggtgcttgtggacatcctggcgggttatggagcaggggtggcaggcgcactcgtggcctttaagggcatgagcggcgaaatgccctccaccgaggacctggtcaacttactccctgccatcctctctcctggcgccctggtcgtcggggtcgtgtgcgcagcaatactgcgtcggcatgtgggcccaggggagggggctgtgcagtggatgaaccggctgatagcattcgcctcgcggggtaaccacgtttcccccacgcattatgtgcctgagagcgatgctgcggcgcgtgtcaccaagatcctctccagccttaccatcactcagcgtctaaggaggctccaccagtggattaatgaggactgctccacgccatgctccggttcgtggctcagggatgtttgggactggatatgcacggtgttgactgacttcaagacctggctccagtccaagctcctgccgcggctgccgggagaccccttcttctcatgtcaacgtggatacaggggggtctggcggggagatggcgtcatgcaaaccacctgcccatgtggagcacagatcaccggacatgtcaaaaacggttccatgaggatcgttgggcctaaaacctgtagcaacacgtggcacggaacattccccatcaacgcatacaccacgggcccctgcacgccctccccggcgccaaactattccagggcgctgtggcgggtggctgctgaggagtatgtggaagtcacgcgggtgggggatttccactacgtgacgggcatgaccactgacaacgtaaaatgcccatgccaggttccagcccccgaattcttcacggaagtggatggggtgcggttgcacaggtacgctccagcttgcaaacctctcctacgggatgaggttacattccaggtcgggctcaaccaattcccggttgggtcacagctcccgtgtgagcccgaaccggatgtaacagtgctcacttccatgcttaccgacccctcccacattacagcggagacggctaagcgtaggttggccagagggtctcccccctccttggccagctcttcagctagccagttgtctgcgccttctttgaaggcgacatgcactacccgtcatgactccccggacgccgacctcatcgaggccaacctcctgtggcggcaggagatgggcgggaacatcacccgggtggagtcagagaataaggtagtaattctagactcttttgaaccgcttcgggcggaggaggatgagagggaagtatccgtggcggcggagatcctgcggaaaagcaggaagttccccccagcgttgcccatatgggcacgcccgagctacaacccaccactcctagagtcttggaaggacccggactacgtccctccggtggtacacgggtgccctctgccacctaccatggcccctccaataccacctccacggaggaagaggacggttgtcctgacagaatccaccgtgtcttctgccttggctgagcttgccacaaagaccttcggcagctccggatcgtcagccgttgacagcggcacggcgacggcccctcctgaccagccctccgatgacggagacagaggatctgacgatgagtcgtactcctccatgcccccccttgagggggagccgggggaccccgatctcagcgacgggtcttggtctaccgtgagcgaggaggctagtgaggacgtcgcttgctgctcgatgtcttacacgtggacaggcgccctaatcacaccatgcgccgcggaggagagcaagctgcccatcaatccgttgagcaactctttgctgcgtcaccacaacatggtctacgccacaacatctcgcagcgcaggcctacggcagaaaaaggtcacctttgacagactgcaggtcccggacgaccattaccgggacgtgctcaaggagatgaaggcgaaggcgtccacagttaaggctaaacttctatctgtagaagaagcctgcaagctgacgcccccacactcggccagatccaaatttggctatggggcgaaggacgtccggaacctatccagcaaggccgttaaccacatccactccgtgtggaaggacttgctggaagacactgaaacaccaattgacactaccatcatggcaaaaaatgaggtcttctgtgttcaaccagagaaaggaggccgcaagccagcccgccttatcgtattcccagaacttggggttcgtgtgtgcgagaaaatggccctttacgacgtggtctccactcttcctcaggccgtgatgggctcctcatacggattccagtactctcctgggcagcgggtcgagttcctggtgaatgcctggaaatcgaagaaaaaccctatgggcttcgcatattgcacccgctgttttgactcaacggtcactgagagtgatatccgtgttgaggagtcaatttaccaatgttgtgacttggcccccgaggccagacaggtcataaggtcgctcacggagcggctttatatcgggggccccctgactaattcaaaagggcagaactgcggttatcgccggtgccgcgccagcggtgtgctgacgactaactgcggtaataccctcacatgttacttgaaggcctctgcagcctgtcgagctgcaaagctccaggactgcacgatgctcgtgtgcggagacgaccttgtcgttatctgtgaaagcgcgggaacccaggaggacgcggcgagcctacgagtcttcacggaggctatgactaggtactctgccccccccggggacccgccccaaccagaatacgacttggagttaataacatcatgctcctccaacgtgtcggtcgcgcacgacgcatctggcaagcgggtgtactacctcactcgcgaccccaccacccccctcgcgagggcagcgtgggaaacagcaagacacactccagtaaactcctggctaggcaacatcatcatgtacgcgcccaccctgtgggcaaggatgattctgatgacccacttcttctccatccttctagctcaggagcaacttgaaaaagccctgggttgtcagatctacggggccacttacttcattgaaccacttgacctacctcagatcattcagcgactccacggtcttagcgcattttcactccacagttactctccaggtgaaatcaatagggtggcttcatgcctcaggaaacttggggtaccacccttgcgagtctggagacatcgggccagaagtgtccgcgctaagctactgtcccagggggggagggccgccacttgtggcaagtacctcttcaactgggcagtgaggaccaagcttaaactcactccaattccggctgcgtcccagttggacttatccggctggttcgttgctggttacagcgggggagacatatatcacagcctgtctcgtgcccgaccccgctggttcatgtggtgcctactcctactttctgtaggggtaggcatctacctgctccccaaccggtgaacggggagctaaccactccaggccaataggccattcccttttttttttttc

SEQ ID NO: 805 - DNA, 9390 bp, Hepatitis C Virus
cctgtgaggaactactgtcttcacgcggaaagcgcctagccatggcgttagtacgagtgtcgtgcagcctccaggaccccccctcccgggagagccatagtggtctgcggaaccggtgagtacaccggaatcgctggggtgaccgggtcctttcttggaacaacccgctcaatacccagaaatttgggcgtgcccccgcaagatcactagccgagtagtgttgggtcgcgaaaggccttgtggtactgcctgatagggtgcttgcgagtgccccgggaggtctcgtagaccgtgcaacatgagcacacttcctaaacctcaaagaaaaaccaaaagaaacaccatccgtcgcccacaggacgttaagttcccgggtggcggacagatcgttggtggagtatacgtgttgccgcgcaggggcccgcgattgggtgtgcgcgcgacgcgtaaaacttctgaacggtcacagcctcgcggacggcgacagcctatccccaaggcgcgtcggagcgaaggccggtcctgggctcagcccgggtacccttggcccctctatggtaacgagggctgcgggtgggcagggtggctcctgtccccgcgcggctctcgtccatcttggggccaaaatgacccccggcggaggtcccgcaacttgggcaaggtcatcgatacccttacgtgcggattcgccgacctcatggggtacatcccgctcgtcggcgctcccgtaggaggcgtcgcaagagccctcgcgcatggcgtgagggcccttgaggacgggataaatttcgcaacagggaacttgcccggttgctccttttctatcttccttcttgctctattctcttgcttaatccatccagcagctagtctagagtggcggaatacgtctggcctctatgtccttaccaacgactgttccaatagcagtattgtatacgaggccgatgacgtcattctgcacacacccggctgtgtaccttgtgttcaggacggcaatacatccacgtgctggaccccagtgacacctacagtagcagtcaggtacgtcggagcaaccaccgcttcgatacgcagtcatgtggacctattagtgggcgcggccacgatgtgctctgcgctctacgtgggtgatatgtgcggagccgtctttctcgtgggacaagccttcacgttcagacctcgtcgccatcaaacggtccagacctgtaactgctcactatacccaggccatctttcaggacatcgaatggcttgggatatgatgatgaattggtcccccgctgtgggcatggtggtatcgcacgtcctgcggttgccccagaccttatttgacataatagccggggcccattggggcatcttggcgggcctagcctattactccatgcagggcaattgggccaaggtcgctgtcatcatggttatgttttcaggggtcgatgccgaaacatatatcaccggtggcagtgcagctcatggtgtcagtacccttactagtctttttagttcgggcccccaacagaaactgcagctggtcaaaaccaatggctcgtggcacatcaacagtactgctctgaactgtaatgagtccataaacaccgggttcatagctgggttgttttattaccataagttcaactctactggatgtcctcagaggctcagcagctgcaagcccatcactttcttcaggcaggggtggggctccctgacagatgctaacgtcaccggtgcttctgctgacaaaccgtactgctggcactacgcacctagaccttgtgacgttgtcccggcattgaatgtctgcggccctgtgtactgcttcacaccatcgccagtggttgtgggcactaccgatcgcaagggcgtgcccacctacaactggggtgagaatgagtcagatgtgttcctgctggagtccctgaggcctcccagtggtcggtggtttgggtgtgcgtggatgaattccacggggtttctcaagacgtgtggagctcccccttgtaacatctacggaggtggagggaatcccaacaatgagtcacacctcttctgccccaccgactgcttcaggaaacatcctgacgccacatacagccggtgtggtgcagggccctggttgacacctcgttgcatggtcgactatccataccggctttggcattacccatgcacagtcaatttcacattgttcaaggtaaggatgtttgtgggtgggtttgagcatcggtttaccgccgcttgcaactggaccaggggggagcgctgtaatatcgaggatcgtgaccgcagcgaacaacatccgctgctgcattcaacaaccgagcttgctatactgccttgctctttcacgcccatgcccgcattgtcaacaggtctaatacacctccatcaaaacatcgtggatgtccaatacctttatggcgttggatctggcatggtgggatgggcgttgaaatgggagtttgtcatcctcattttcctcctcctagcggacgcacgcgtgtgcgttgctctttggctgatgctgatgatatcacaagcagaagcagccttggagaaccttgtcacgctgaaagctgtcgctgctgccggaacacatggtatcggctggtacctggtagccttttgcgcggcgtggcacgtgcggggtaaacttgtcccgctggtgacctacagcctgacgggtctttggtccctagcactgctcgtcctcttgctcccccaacgggcgtatgcttggtcgggtgaagacagcgctactctcggcgctggggtcttggttctcttcggcttctttaccttatcaccctggtataagcattggatcggccgcctcatatggtggaatcagtacaccatatgtagatgcgagtctgcccttcaagtgtgggtcccccccttacttgcgcgtgggagcagggacggtgtcatcttgctaacaagtctgctatacccatccttaatttttgacatcactaagctgctgatagcagtactgggcccattatacttaatacaggcctctatcactgccaccccctactttgtacgtgcgcatgtactggttcgcctttgcatgcttgtgcgctccatgatgggggggaaatacttccagatgatcatactgagcgttggcagatggtttaacacctacctatatgaccacctagcgccaatgcaacattgggccgcagctggcctcaaagatctagcagtggccactgaacctgtaatatttagtcccatggaaatcaaagtcatcacctggggcgcggatacggcggcttgcggagatattctttgcgggctgcccgtctctgcgcgattaggccgtgaggtgttgttgggacctgctgatgactatcgggagatgggttggcgcctgttggccccgatcacagcatacgcccagcagaccaggggccttcttgggactattgtgactggcttgactggcagggacaagaacgtggtgaccggtgaagtgcaggtgctttctacggctacccagaccttcttaggtacaacagtggggggggttatgtggactgtttaccatggtgcgggttcgagaacacttgcgggcgccaaacatcccgcgctccaaatgtacacaaatgtagatcaggacctcgttggatggccggcccctccaggggctaagtctctcgaaccgtgcgcctgcgggtctgcagacttatacttggttacccgcgatgccgacgtcatccctgctcgacgcaggggggactccacagcgagcttgctcagtcctaggcctctcgcctgtctcaaaggttcctctggaggccctgttatgtgcccttcgggacatgttgcggggatctttagggctgctgtgtgcaccagaggtgtagcaaaagccctacagtttataccagtggaaacccttagtacacaggctaggtctccatctttctctgacaactcaactcctcctgctgttccacagacctatcaggtagggtaccttcatgccccgaccggcagcggtaagagcacaaaggtcccggccgcttatgtagcacaaggatataatgttctcgtgctgaatccatcggtagcggccacattaggcttcggctctttcatgtcgcgtgcctatgggaccgaccccaacatccgcactgggaaccgcaccgttacaactggtgctaaactgacctactccacctacggtaagtttctcgcggacgggggttgctccgggggggcatatgatgtgattatctgtgatgaatgtcatgcccaagacgccactagcatattgggtataggcacggtcttagatcaggccgagacggctggggtgaggttgacggttttagcgacagcaactcccccaggcagcatcactgtgccacattctaacatcgaagaagtggctttgggctctgaaggtgagatccctttctacggtaaggctataccgatagccctactcaagggggggaggcacctcatcttttgccattccaagaaaaaatgtgatgagatagcgtccaaactcagaggcatggggctcaacgctgtagcgtactataggggtctcgatgtgtccgtcataccaacaacaggagacgtcgtagtttgcgctactgacgccctcatgactggattcaccggagacttcgattctgtcatagattgcaacgtggctgttgaacagtacgttgacttcagcttggaccccaccttttccattgagacccgcactgctccccaagatgcggtttcccgcagccaacgtcgtggccgtacgggccgaggtagactcggtacgtaccggtacgtcgcccccggtgaaagaccgtctgggatgtttgactcggttgttctctgtgagtgctacgacgcgggctgttcgtggtacgatctacagcccgctgagaccacagtcagactgagagcttacttgtccacgccggggttacctgtctgccaagaccatttagacttttgggagagcgtcttcactggactaactcacatagatgcccactttctgtcacagactaagcagcagggacttaacttctcgtacctaactgcctaccaagctactgtgtgcgcccgcgcgcaggctcctcccccaagttgggacgagatgtggaagtgtctcgtgcggcttaagccaacactacatggacctacgccccttctatatcgattggggcctgtccaaaatgaaacctgcttgacacaccccgtcacaaaatacatcatggcatgcatgtcagctgatctggaagtaactaccagcacctgggtgttgcttggaggggtcctcgcggccctagcggcctactgcttgtcagtcggctgtgttgtaattgtgggccatattgagctggggggtaaaccggcactcgttccagacaaagaggtgttgtaccaacaatacgacgagatggaggagtgctcacaagccgccccatacatcgagcaagctcaagcaatagcccaccagttcaaggaaaaagtccttggattgttgcagcgagccacccaacaacaagctgtcattgagcccatagtagctaccaactggcaaaagcttgaggccttctggcacaagcatatgtggaattttgtgagtgggatccaatacctagcaggcctccccactttgcctggtaatcctgctgtggcgtctcttatggcgttcaccgcttcagtcaccagtcccctgacgaccaaccaaactatgttttttaacatactcggggggtgggttgccacccatttggcaggccctcagagctcttccgcgttcgtggtaagcggcttggctggcgctgccatagggggtataggtctgggcagggtcttgcttgacatcctggcaggatacggagctggtgtctcaggcgccttggtggcttttaagatcatggggggagaactccccactactgaggacttggtcaacctgttgcccgccatactatctccgggtgctctcgtcgtcggtgtgatatgcgctgccatactacgtcgacacgtaggacctggggagggagcggtacagtggatgaacaggctcattgcgttcgcatcccggggcaaccacgtctcaccgacgcactatgttcccgagagcgatgctgcagcgaaggtcaccgcattgctgagttctctaactgtcacaagtctgctccggcggttacaccagtggatcaatgaagattacccaagtccttgcagcgacgattggctgcgtatcatctgggactgggtttgctcagtgttggccgacttcaagacatggctctctgctaagatcatgccagcgctccccgggctgcccttcatttcctgtcaaaagggatacaagggcgtgtggcggggggacggtgtgacaacaacacgctgtccttgcggggcaacaataaccggccatgtgaagaatgggtccatgcggcttgcagggccgcgtacatgtgctaacatgtggtacggcaccttccccatcaatgagtacaccaccggacccagcacaccttgcccatcacccaactacactcgcgcactatggcgcgtggctgccaatagctacgttgaggtgcgccgggtgggggacttccattacattacgggggccacagaagatgagctcaagtgtccgtgccaagtgccggctgctgagttctttactgaagtggatggggtgagactccaccgttacgcccctccatgtaagcccctgttgagagatgatatcacttttatggtggggttgaattcctacgcgataggatctcaactcccctgtgagccagaaccagatgtttctgtgctgacctcgatgttgagagacccctcccatatcaccgccgagacggcagcgcgtcgtcttgcgcgcgggtctcctccatcggaggcaagctcatccgccagtcaactgtcggctccgtcgctgaaggccacttgccagacgcataggcctcatccagacgctgagctagtagacgccaacttgttatggcggcaagagatgggcagcaacattacacgggtggagtctgaaacaaaggttgtgattcttgattcattcgaacctctgagagcccaaacagatgatgctgagctctcggtggctgcagagtgcttcaagaaacccccaaagtatcctccagcccttcctatctgggctaggccagactacaaccctccactgttggaccgctggaaaacaccggattacgtaccaccaactgtccatggatgtgccttaccaccacggggcgctccaccggtgcctcctcctcggaggaaaagaacaatccagctggatggctccaatgtgtccgcggcgttagctgcgctggcgaaaaaatcattcccgtccgtgaacccgcaggatgagaatagctcatcctctggggtcgacacacagtccagcaccacttccaaggtacccccctctccgggaggagagtccgattcggagtcatgctcgtccatgcctcctctcgagggggagccgggcgatccagacttgagttgcgactcttggtccaccgttagtgacagcgaggagcagagcgtggtctgctgttctatgtcgtactcttggaccggcgccttgataacaccatgtagtgctgaggaggagaaactgcccatcagcccactcagcaactccttgttgagacatcataacctagtctattcaacgtcgtctagaagcgcttctcagcgtcagaagaaggttaccttcgacagactgcaagtgctcgacgaccactacaagactgcattaaaggaggtaaaggagcgagcgtctagggtaaaggctcgcatgctcaccatcgaggaagcgtgcgcgctcgtccctcctcactctgcccggtcgaagttcgggtatagtgcgaaggatgttcgctccttgtctagcagggccattgaccagatccgctccgtctgggaggacttgctggaagacaccacaactccaattccaaccaccatcatggcaaagaacgaggtgttttgtgtggaccccgctagagggggccgcaagcgcgctcgcctcattgtgtaccctgacctgggggtgcgtgtctgtgagaaacgcgtcctatatgatgtgatacagaagttgtcaattgagacgatgggtaccgcttacgggttccaatactcgcctcaacagcgggtcgaacgtctgctgaagatgtggacctcaaagaaaacccccttggggttctcgtatgacacccgctgctttgactcaactgtcactgaacaggacttcagggtggaagaggagatatatcaatgctgcaaccttgaaccggaggccaggaaagtgatctcctccctcacggagcggctttactgcgggggccctatgtttaacagcaaaggggcccagtgtggttatcgccgttgccgagccagtggagttctgcctaccagcttcggcaacacgatcacttgttacatcaaggccacagcggctgcgaaggccgcaggcctccggaacccggactttcttgtctgcggagatgatctagtcgtggtggctgagagtgacggcgtcgacgaggatagaacagccctgagagccttcacggaggctatgaccaggtactctgctccacccggagatgccccacagcccacctacgaccttgagctgattacatcttgctcctccaacgtctccgtagcactggacaacaaggggaagaggtactattacctcacccgtgatgctactactcccctagcccgtgcggcttgggaaacagctcgtcacactccagttaactcctggttaggcaacatcatcatgtacgcgcctaccatctgggtgcgcatggtgatgatgacacactttttctccatactccaatcccaggagatacttgatcgaccccttgactttgaaatgtacggggccacttactctgtcactccgctggatttaccagcaatcattgaaagactccatggtctaagcgcgttcacgctccacagttactctccagtagagctcaatagagtcgcggggacactcaggaaacttgggtgcccccccctacgagcttggagacatcgggcacgagcagtgcgcgccaagcttatcgcccagggagggaaggccaaaatatgcggcctttacctcttcaattgggcggtacgcaccaagaccaatctcactccactgccagccactggccagttggatttgtccagctggtttacggttggtgtcggcgggaacgacatttatcacagcgtgtcacgtgcccgaacccgctatttgctgctttgcctactcctactaacggtgggggtaggcatctttctcctgccagctcggtgagctggtaggataacactccatttctt

SEQ ID NO: 806 - DNA, 9355 bp, Hepatitis C Virus
  misc_feature 3378: n = A,T,C or G
ttcacgcagaaagcgtctagccatggcgttagtatgagtgttgtacagcctccaggaccccccctcccgggagagccatagtggtcttcggaaccggtgagtacaccggaatcgccgggatgaccgggtcctttcttggattaacccgctcaatgcccggaaatttgggcgtgcccccgcaagactgctagccgagtagtgttgggtcgcgaaaggccttgcggtactgcctgatagggtgcttgcgagtgccccgggaggtctcgtagaccgtgcaccatgagcacgaatcctaaacctcaaagaaaaaccaaacgtaacaccaaccgccgcccaatggacgttaagttcccgggtggtggccagatcgttggcggagtttacttgttgccgcgcaggggccccagattgggtgtgcgcgcgactcggaagacttcggagcggtcgcaacctcgtggaagacgccaacctatccccaaggcgcgtcgacccgagggaaggtcctgggcacaaccaggatatccatggcctctttacggtaatgagggttgtgggtgggcaggatggctcttgtccccccgtggctctcgaccgtcttggggcccaaatgatccccgcgggaggtcccgcaatttgggtaaggtcatcgataccctaacctgcggcttcgccgacctcatgggatacatcccgctcgtaggcgcccccgtgggtagcgtcgccagggccctggcacatggtgtcagggctttggaggacgggatcaattatgcaacagggaatctccccggttgctccttttctatcttcctcttggcacttctttcgtgcctgactgtccccgcttcggccgttaactatcgcaatgtctcaggcatctaccatgtcaccaatgactgcccgaattcaagcatagtgtatgaggccgaccatcacatcatgcaccttccaggttgcgtgccctgcgtgagagaggggaatcagtcacgctgctgggtggcccttactcctaccgtcgcagcgccatacatcggcgcaccgcttgagtccttacggagtcatgtggatttgatggtgggggccgccactgtctgctcgggtctttacatcggggacctgtgtggcggcttgttcctagttggccagatgttttcattccgaccacggcgccactggaccacccaggattgcaattgttccatctacacagggcacattacaggccacagaatggcctgggacatgatgatgaactggagtccaacaaccaccttagttctcgcccaggtcatgaggatcccaaccactctggtagacttactctctggaggccactggggtgtcctcgtgggggtggcctatttcagcatgcaggccaattgggccaaagtcatcttggtcctattcctctttgcaggggttgatgccgagactcacgtgtctggggcagcagtcggccggagtaccgccggcttggctaacctcttttcttctgggtctaagcagaatttacagctcatcaacagcaatgggagctggcatataaataggactgcccttaactgcaatgacagcttaaacactgggttcttggctagcttgttctacacccacaagtttaacagctcagggtgttccgaacggctcgcgtgctgcaagagccttgacagctacggccaaggctggggcccactcggggtcgctaacatcagcggctcgtctgatgacaggccttattgctggcactacgcgcctcggccatgcgggattgtgccagcatccagtgtgtgtggccccgtgtattgtttcactcccagccctgtcgtggtcggtactactgatcacgtcggggtccctacttacacctggggggagaacgagactgatgtcttccttttgaactcgaccagaccgccgcatggtgcgtggtttggatgcgtgtggatgaacagtaccgggttcaccaaaacctgtggcgcccctccatgcgaggttaacaccaataatgggacctggcactgccccaccgattgcttcaggaagcatccggagactacctacgccaagtgcggatcagggccttggatcacaccacgctgcctgattgattacccgtaccggctgtggcatttcccgtgcaccgccaacttctccgtctttaacatcaggacatttgtcggcggtatagagcatcggatgcaagcggcatgcaactggaccaggggggaagtctgtggcttggagcacagggatcgggtagagctatcacccctgctccttaccactacagcgtggcagatcctcccctgctctttcaccactttacctgccctctccaccggcttgatccacctccaccaaaatatcgtggacgtccagtacctctatggtgttggatctgcagtggtatcttgggcccttaagtgggaatatgtggtgctcgcgttcctgcttctcgcggacgcgagagtctctgcctacctatggatgatgtttatggtaagtcaagttgaggcggctctgtccaacctaattaacatcaatgctgcttcagccgctggtgcccaaggcttctggtacgccatcctcttcatctgcattgtctggcatgtcaagggccggttcccagctgctgctgcctacgcagcctgcgggctgtggccctgttttctcctgcttctgatgctgcctgagagggcttatgcatacgaccaggaagtggcagggtcccttggcggcgccatcgttgtcatgctgaccattctgacactgtctccgcactacaagttatggctggctaggggattgtggtggatccaatattttatagctaggaccgaggctgtgctgcatgtctatattccatccttcaacgtgcgcgggcctcgcgactcagtgattgttcttgcagtcctggtctgtccagacctagtatttgacatcacaaaatatcttctggccatcttagggcccctccacatactccaggcctcgctcctacgcatcccttactttgtgagggcacaagcgctggttaagatctgcagcttgttgcgtggggtagtttatggcaagtacttccaaatggtcgtgcttaaaagcaggggcctgactggtacttacatctatgaccaccttactcccatgtcagattggccgccttacggcctccgcgatttggcggtggccctagagccagttgtgttcacgcccatggagaagaaagtcatcgtctggggcgctgacaccgctgcgtgcggagacatcataaggggattacctgtttcggccaggttgggcaatgagatcttgctcggaccagccgatacagaaacatcaaaggggtggagactccttgcccccatcacagcatacgcncagcagacccgcggcttgttcagcaccatcgtaacgagcctcactggcagggacaccaatgagaattgtggcgaagtgcaggtcttatccaccgctacgcagtccttcctgggtactgcggttaacggcgtgatgtggaccgtctaccacggggcgggtgccaagaccatcagcggcccgaagggacctgtcaatcaaatgtacactaatgttgaccaagacttggtggggtggccagcaccccccggagtcagatctcttgctccgtgcacctgcggctcggcagacttgtatctagtcaccaggcacgcggatgtaatacccgtgcgcaggagaggagacaccagaggagctctcttgagccctagaccaatatccattcttaagggatcttccggaggtccgctgctgtgccccatgggacaccgcgccggcatattccgtgcggcggtgtgtactcggggggtagccaaggcggtagacttcgtcccggttgaatctcttgagactaccatgagatcaccagtgttcactgacaactcaacacccccagcagtgccccagacctaccaggtcgcgcacctacacgcaccaacaggaagtggcaagagcactaaggtcccggcggcgcatgctgcccaaggctataaagtgctagtgctcaatccttcggttgcggccacactgggttttggggtatacatgtccaaggcatatggcatcgacccgaacatccggtcgggagtcaggaccatcaccacgggtgcgccaatcacgtactcaacgtatggtaagttcctggctgatggaggttgcagcggaggggcatacgacataatcatctgtgacgagtgctattccactgactccacaacgatccttggcataggcacagtcctggaccaagcggagaccgctggagtgcgcctcaccgtgctcgcgactgctactccgccagggtcagtgactacacctcattccaacatagaggaggtcgccctgccaacaacgggggaaatacccttttacggcaaggcgatccctctggagctgatcaaggggggcagacatctcatcttctgccattcaaagaaaaagtgcgatgaactggccagacaactgacatctcttggtctgaatgccgtagcctactacagaggcttagacgtttcggtgattcccacgtctggggacgtcgtggtatgcgccacggacgccctcatgacgggtttcaccggcgactttgactcagtgatagactgcaatacatctgtgatacagactgttgacttcagcttggaccccaccttctccatagagattacaaccgttccccaggacgcggtatcccgcagccagcggagaggccgcactggtagggggaggttgggcacataccggtatgtcaccccgggagagagaccatcaggcatgtttgacactgcagagctttgcgagtgctacgatgccgggtgcgcctggtacgagctgacacctgctgaaaccacaacaaggctgaaagcttacttcgacacaccaggccttcctgtgtgccaagaccatctggaattctgggagagcgtctttacagggttaacccacatagacggtcatttcctatcccagaccaagcaatcgggtgagaatttcccgtatcttgttgcttaccaagcgacggtgtcggccaaggtctggctcgctccaccaagctgggacaccatgtggaagtgcctaattcgccttaagcccaccctgcacgggcccacgcccctcctctacagactggggtctgtgcagaatgaagtggtgctcacccatcccatcaccaaatacatcatggcttgcatgtcagctgatctcgaggtagtgacaagtacgtgggtcttggtgggcggcgtcctggcagctctggctgcttactgtctttcagtgggcagcgtagtgattgttgggagagtcgtcctgtcgggccaacctgctgtcattcctgatcgcgaagtgctctaccaacagttcgacgaaatggaggagtgttccaaacacctcccactagtcgagcacgggttacaactggctgagcagttcaagcagaaggccttaggtctcctaaatttcgctggcaagcaagcccaagaggcaacaccagtgatccagtctaacttcgctaaacttgagcagttttgggcgaacgacatgtggaatttcatcagcggcattcaatatctcgctggactgtctactttgccaggcaatcctgccattgcttccctcatgtcctttactgctgccgttacaagccctctgaccacccaacaaaccctcctttttaacatcttggggggatgggtggcctcacagattcgcgactccgatgcttctaccgcattcgtcgtgagcggcttggcgggggcggcagttggcagtgtgggccttggcaaaattttggtggacattctgcccggttacggcgccggcgtacgtggcgctgtggttaccttcaagatcatgagcggcgagatgccttccacagaggacttggtaaatttgctcccggccattctatcgcccggagcattggtggtggaggtggtatgcccggcgattttgcgccgccacgtgggcccgggcgaaggggccgtgcagtggatgaaccgtctaattgcgttcgcatcgcgaggcaatcacgtgtctcccacgcattacgtccctgagtccgacgcggcacgccgcgtgaccaccatactatcatccctcactgtgacatcccttctcagacgcctccacaagtggatcaatgaagattgctccaccccatgtgccgaatcttggctatgggaggtatgggattgggtcttgcacgtgctgagtgacttcaagacgtgcttaaaagcaaagttcgtgcccttaatgccaggcatccccctcctctcatggccaagaggctataagggagagtggcgcggagatggcgtgatgcatacgacatgcccctgcggagcagatctggcaggtcacatcaagaacggctcgatgagaatcaccgggccgaaaacctgcagcaacacatggcatggaaccttccccatcaatgcctacaccacaggccctggtgtacccatcccggctccgaactacaagttcgcgctttggagggtgtccgccgaggactacgtggaggttcgcagagtgggtgatttccattatgtcaccggggtaacacaagacaacatcaagttcccctgccaagttccggccccagagctcttcacggaagtggacggcatcaggatacaccgccacgcccctaagtgcaaacccttgctgcgggacgaagtgtcgttctcagtaggactcaattcgttcgtagtgggatcacaactcccatgcgagccagagccggacgtggcagtgctaacatccatgctgacagacccatcacacataacggcggaatcggcgcgtcggagattggctcgagggtcacgaccctcgctagctagttcctcggcgagtcagctttcgccccgtcttcttcaggccacgtgtaccgctccccatgactcccctggtactgatctcctcgaggctaacctcttgtgggggtctaccgctaccagggttgagacggacgagaaggtaataatactagactcttttgagtcatgtgtggctgagcaaaatgatgacagggaagtctcggttgccgcggaaatcctgcgtccgaccaagaagttccctccagcactaccgatctgggcccggccggactacaatccacctcttaccgagacgtggaagcagcaggactaccaagctccgaccgtccacggttgcgctctgcctccggcaaagcagccccctgttccctctcccaggaggaaacggacggtacagctcactgagtccgttgtttctaccgctttggcagagctggccgcaaagacctttggccagtcagagccgagctcagaccgtgatacagaccttaccaccccaactgagaccacagactcgggccccatcgtcgtggatgatgcatccgatgacggatcttattcgtcaatgcctccactagagggggagcccggtgacccggacttgacatcagactcttggtccactgttagcggatcggaggacgtcgtgtgctgttcgatgtcatactcgtggactggggcgcttgtaacaccttgcgcggctgaagaatcaaagctgccaattagccccctgagcaattcacttttgcgccatcacaatatggtgtatgccacgaccacccgttctgctgtgacacggcagaagaaggtgaccttcgaccgcctgcaggtggtggacagtacctacaatgaagtgcttaaggagataaaggcacgagcatccagagtgaagccacgcttgcttaccacagaggaagcttgcgacctgacgcccccccactcagccagatcaaagttcggctacgggaaaaaggatgttcggagccattcccgcaaggccattaaccacatcagctccgtgtggaaggacttgctggacgacaacaataccccaattccaacaacaatcatggccaaaaatgaggtcttcgctgtgaacccagcgaagggaggtcggaagcctgctcgcctgatcgtgtatccggatctcggatcccgggtttgcgagaagagagcgcttcacgacgtcatcaaaaaaactgccttagccgtgatgggagccgcttatggcttccaatactccccagcgcagcgggtggaatttcttctgactgcttggaagtcgaagaacgacccaatggggttctcttatgatacccgctgctttgactccactgtaaccgaaaaggacatcagggtcgaggaagaggtctatcagtgttgtgacctggagcccgaagcccgcaaagtcatcaccgccctcacagatagactctatgtgggcggccctatgcacaacagcaagggagacctttgtgggtatcggagatgtcgcgcaaccggcgtctacaccaccagcttcgggaacacgctgacgtgctatctcaaagccacggccgccatcagggcggcggcgctgagagactgcactatgttggtttgcggtgatgacttagtcgtcatcgctgagagcgacggcgtagaggaggacaaccgagccctccgagccttcacggaggctatgacgagatactcggctcccccaggtgacgctccgcagccagcatatgacctggaactaataacatcatgttcatccaacgtctcagtcgcgcacgacgtgacgggtaaaaaggtatattacctaacccgagaccctgaaactcccttggcgcgagctgtatgggagacagtccgacacactccagtcaattcctggttgggaaacatcatagtctacgctcccacaatatgggtgcgcatgatattgatgacccactttttctcaatactccagagccaggaagcccttgagaaagcactcgacttcgatatgtacggagtcacctactctatcactccgctggatttaccggcaatcattcaaagactccatggcttaagcgcgttcacgctgcacggatactctccacacgaactcaaccgggtggccggagccctcagaaaacttggggtacccccgctgagagcgtggagacatcgggcccgagcagtccgcgctaagcttatcgcccagggaggtagagccaaaatatgtggcatatacctctttaactgggcggtaaaaaccaaactcaaactcactccattgcctgccgctgccaaactcgatttatcgggttggtttacggtaggcgccggcgggggagacatttatcacagcatgtctcatgcccgaccccgctatttactcctgtgcctactcatacttacagtaggggtaggcatcttcctgctgcctgctcggtaggcagcttaacactccgaccttagggtcccctttttttttttttttttgg

SEQ ID NO: 807 - DNA, 9340 bp, Hepatitis C Virus
tttcacgcagaaagcgtctagccatggcgttagtatgagtgtcgtacagcctccaggcccccccctcccgcgagagccatagtggtctgcggaaccggtgagtacaccggaattgccaggatgaccgggtcctttccattggatcaaacccgctcaatgcctggagatttgggcgtgcccccgcaagactgctagccgagtagcgttgggttgcgaaaggccttgtggtactgcctgatagggtgcttgcgagtgccccgggaggtctcgtagaccgtgcatcatgagcacacttccaaaaccccaaagaaaaaccaaaagaaacaccaaccgccgcccaatggacgtcaagttcccgggtggcggtcagatcgttggcggagtttacttgttgccgcgcaagggcccccggttgggtgtgcgcgcgacgaggaagacttctgagcgatcccagcccagaggcaggcgccaacctataccaaaggcgcgccagccccagggcaggcactgggctcagcccggatacccttggcctctttatggaagcgaaggctgtgggtgggcaggttggctcctgtccccccgcggctcccggccacactggggccccaatgacccccggcgtcgatcccggaatttgggtaaggtcatcgataccctaacctgtgggttcgccgatctcatgtggtacattcccgtcgtgggcgcgcctttgggcggcgtcgcggctgcgcttgcacatggtgtgagggcaatcgaagacgggatcaattatgcaacaggaaatcttcccggttgctctttctctatcttccttttggcactactctcgtgcctcacaacgccagcttcggctcttacctacggtaactccagtgggctataccatcttacaaatgattgctctaactccagcatcgtgctggaagcggacgctatgattttgcatttgcctggatgcttgccctgtgtgagggtcggtaatcagtccacctgctggcatgctgtgtcccccaccctagccacaccaaatgcttccacgcccgcaacgggattccgcaggcatgtggatcttctagcgggcgccgcagtggtttgctcatccctgtacatcggggatctgtgcggctctctctttctggcgggacaactattcgccttccagccccgccgtcattggaccgtgcaagactgcaactgctccatttatacaggccacgtcaccggccacaagatggcttgggatatgatgatgaattggtcgcccacaaccactctggtcctatctagcatcttgagggtacctgagatctgtgcgagtgtgatatttggtggccattgggggatactactagccgttgcctactttggtatggctggcaactggctaaaagttctggctgttctgttcttatttgcaggggttgaagcacaaaccatgatcgcccacggagtgagccaaactacttccggctttgcctcgcttctcacccccggtgccaagcagaatatacaactcatcaacaccaatggcagctggcacataaacaggactgctttgaactgcaatgattccctccagacggggttcttagcgtcacttttttacacccacaaattcaactcctccggctgcccagagcggatggctgcgtgtaagcccctcgcggaattccggcaggggtggggccagataacccacaaaaacgtctcgggcccctctgacgaccgtccctactgttggcattacgctcctaggccatgtgaagtggtgccggcccgctcagtgtgcggccctgtctactgcttcacgcccagccctgttgtggtaggaaccactgacaagcggggcaaccccacatacacctggggggagaatgagacggatgtattcatgctggaaagtcttcggccccctactggaggatggtttgggtgcacgtggatgaactctacgggctttaccaagacctgtggtgccccgccatgtcagatagtcccaggtaactacaacagctctgctaacgagcttttgtgccccaccgactgcttccgtaaacatccggaagctacataccagcggtgtggatcgggaccctgggtaacacctaggtgtctggtggattacgcttacaggttgtggcactacccctgcactgtcaacttcaccttgcacaaagtcaggatgttcgtgggaggcactgagcaccggtttgacgtcgcatgcaattggaccaggggcgagcggtgcgagctacatgacagaaacaggattgaaatgagcccgctgcttttctcaactacgcagctttccatactcccctgctcattttccaccatgccggccttatcaactggcctcatccacctgcatcagaacatagtggacgtgcagtacctctacggagtctccacgaatgtcacctcgtgggtagtgaagtgggagtacattgtcctgatgttcctggttctggcagatgctcggatttgcacgtgtctctggttaatgctgctcataagtaccgttgaagcagcagtggagaggcttgtcgtcctcaacgcggctagcgccgccggtactgccggctggtggtgggcggtgcttttcctgtgctgtgtttggtatgtgaaaggccgccttgtgcctgcgtgtacctacatggcactgggaatgtggccgctactcctgacaatcttggccctgcctccccgagcatacgctatggacaatgagcaagcggcatccctcggagctgttggtctgttggttatcaccattttcagcatcacccccatgtacaagaagctgttgaactgcttcatttggtggaatcagtatttcctcgcccgagctgaggccatggtacacgagtgggtgcccgacctacgggttaggggtggtagggactccatcatcttacttacctgcttgttacatccacagctggggtttgaggtcactaagattctactagctgtcctggcccctctatacatcttgcagtacagtttgctcaaagtgccttactttgtgcgcgcccacatactcctgcgtgcttgcctgcttgttcgtaggctagcaggaggtaaatacgtgcaggcgtgccttttaaggttgggcgcttggactggtacttttgtctatgaccacctcgcccccctttctgactgggctagcgacggactgcgcgatctggcagttgcagtcgagccggtcattttctctcccatggagaagaaaatcatcacctggggcgcggatactgccgcgtgcggtgacattttgagtggtctcccggtgtcagcgaggttggggaatttggtgctactgggacccgcggatgacatgcagcgcggaggttggaagcttttggctcccatcaccgcgtatgcgcagcagacgaggggcctagtcggcaccattgtgaccagcctaaccgggcgtgacaaaaatgaggtcgaaggggaggtacaagtggtttccacggatacccaatcctttgtggcgacctccattaacggtgtcatgtggactgtttatcatgggcccggttttaagactctcgctggaccgaaaggaccagtgtgtcaaatgtacaccaatgtggacttggacttagtaggatggccatctcccccgggagcaaggtcgctcaccccatgtaattgtggctctagtgacctctatctggtcacgagggaggccgacgtcatccccgcaaggcgcaggggtgacagccgtgctgccctcctctctcctaggcccataagcaccttgaaaggctcctcgggaggccccattatgtgtccctcggggcacgttgtgggactcttccgagctgccgtatgcacaaggggtgtagcaaaatccttagactttatcccagtggaaaacatggagacaactatgcgctctccctcattcacagacaactccacgccgcctgcggtgccccagacctatcaggtagggtacctgcacgcaccaacaggcagtggaaagagcacccgtgttccggcggcgtacgctagccagggctacaaggtgttggtcttgaacccatcggtggcggcaacgcttagcttcggctcttatatgaggcaagcttacggcgtggagccgaatatccggaccggggtcagaactgtaactacagggggcgctatcacgtactccacatacggggaattcttggccgatgggggatgttccggaggagcgtacgacatcatcatctgtgatgagtgccactccacagaccctacgacggtgctgggcgttggcacggttctcgaccaggctgagactgccggggttcgccttaccgtgctcccaacagcaacgccgccgggttctgtcactgttccccatcctaacataacagagacagccctcccgactacgggagaaataccattttatggaaaggccatcccccttgagtacatcaaagggggaagacatctcatattctgtcactcaaagaagaagtgcgatgagctggccgggaaactgaagtcactcggcttaaacgccgtcgcgttctacagaggtgtcgatgtgtccgtcattcccacctcgggcgatgtcgtcgtctgcgcgacagacgcccttatgaccggctacacaggtgatttcgattccgtcatcgactgtaacgtagccgtgacacaggtggtggatttcagcttggacccaacattttccatagagactactaccgtccctcaggatgcggtatcgcggagccaacgacgaggccgcacggggcggggtaaaccaggggtgtacagatttgtctcccaaggggagaggccttcgggtatgttcgacaccgtcgtcctgtgtgaggcttatgacacgggatgcgcatggtacgagctaaccccttctgaaacaactgtcaggttgagggcctatatgaacactcctggccttcccgtatgccaagaccacctggaattttgggaaggcgtgtttactggcttgactcacatagacgcccactttctgtctcacacgaagcaggcgggtgagaacttcgcgtacctcgtggcataccaggctacagtgtgcgccagggccaaagcccccccgccttcttgggatatgatgtggaagtgtctcatcagactcaaacccacccttaccggccccactccacttttgtatcggttgggggccgtccaaaatggggtaataacaacccatccaataaccaaatacatcatgacctgtatgtctgcggatttggaggtcatcaccagcacatgggtcctcgtgggtggagtcctagccgcgctcgcagcctactgcttgtcagtgggctgtgttgtcatctgtggcaggataactttgactggtaagcctgctgttgtccctgatcgcgagatcttataccagcaatttgacgagatggaggagtgctctaggcacatcccctacctcgctgagggccagcagatcgccgaacagttcagacaaaaggtgttgggactcctccaagcgagcgctaagcaggcagaagaactgaagcctgctgtccattccgcgtggcctagggtggaggatttttggaggaagcacatgtggaactttgtcagcgggattcagtacttggcgggcttatccactctgcccggcaacccagctgtggcatcattgatgtcatttacagcgtcgctgaccagtcctctgagaacttctcaaactctgctcctcaacatacttggcggttggatagccgcccaagtggctcccccccccgcgtctacagcttttgtcgtgagcggtctagcaggagccgcggttggaagcatccggctcgggagggtgttggttgatgtgctcgccggatacggagccggtgtgtctggtgctctagtcgctttcaagatcatgagcggcgagtgcccgagcacggaggacatggtcaatctgctacccgcgctgttgtcgccaggggtggctctcgtgggggtcgtgtgtgctgccatcttaagacgccacgttggccctgctgagggtgctaaccagtggatgaacaggctaatagcctttgcatcaagaggcaaccacgtgtccccgacgcactacgtgcctgagactgacgcgtcaaaaaatgtgactcagatactcacttctcttaccatcaccagcctgctccgtagattacatcagtgggtcaatgaagacacggccaccccttgcgctacctcatggttacgcgacgtgtgggactgggtgtgtacagtgctatctgattttaaagtatggctgcaagccaaacttttcccccgcctgccggggatccccttcctctcgtgccaagcgggatataggggagtctgggcaggggacggggtgtgccacaccacttgtacctgtggggccgtgatagctggacacgtcaaaaatggcaccatgaaaatcacggggcccaagacatgcagtaacacttggcacgggacttttccaatcaatgccactactaccggccccagcacaccacgaccagcccccaactatcagcgcgctctttggcgggtatctgccgaggactacgttgaggtacggaggttgggcgactgccactatgtggtaggggtcactgctgaagggttaaagtgcccttgtcaggtgcctgcgcctgaattcttcactgaggtcgatggcgtgaggatacaccgttacgcgccaccttgcaagcccttgctcagggacgaagtgactttctctgtgggtctctcaaactatgccgtagggtcgcagctcccttgcgagccagagcctgacgtgaccgtagtcacatcaatgctcacagaccccacgcacatcaccgcagaaacggcagcacggcggttaaagaaggggtcccccccctccttggccagctcttccgccaaccagttgtctgcaccgtccctcagggctacttgcacaacttcccaaaaacacccggaaatggaactcctccaagccaacctcctctggaagcacgaaatgggaagccacatccctcgagtccaatcagaaaacaaagttgtagtacttgactcctttgagctctacccgcttgagtatgaggagagggaaatttcagtatcagttgagtgccacaggcaacccaggtgcaaattccccccagttttcccagtatgggccaggcctgataacaacccaccttttatacaagcatggcaaatgcccggatacgagcctccagttgtgtctgggtgtgccgtcgccccacctaaaccggcaccagttcccccgccgaggcggaagaggctagtgcacttggatgagtccacggtctcgcacgccttggcgcagctcgccgacaaggtatttgtggagagtagtaatgacccaggacctagttcagactcggggctatcaataaccagtcccgttccacctgacccaacaacaccggaggatgccggctcagaagcagagtcctatagctcaatgccccctctcgagggggagcctggtgaccctgacctaagctcaggctcttggtccactgtgagcgatgaggacgacgtcgtatgttgttccatgtcctattcctggacgggggctctgataacaccatgtgctgcggaggaggagaagctcccaataaatcccctgagcaactccctcgtaagacaccataacatggtgtattctaccacatcacgcagcgccagcctccgccagaagaaggtcacatttgacagagtgcaagtgttcgaccaacattatcaggatgtactaaaggagattaagcttcgagcgtccacggtgcaggcgaagctcttatccatagaggaagcctgcgacctcacaccatcgcactcagcccggtccaaatatgggtatggtgcacaggacgttagaagccgtgctagcaaggccgttgaccacatcccctccgtgtgggagggcttgctagaagactctgataccccaattccaacgaccatcatggctaagaatgaggtcttctgcgtagatccatcgaagggtggacgcaagccggcacgcctaatagtttacccagacttgggcgtgcgggtctgcgagaagatggccctatacgatgtaacgcagaagttaccacaggccgtgatgggtccggcatacggattccagtactcccctaaccagagggttgagtacttgctcaaaatgtggcggtcaaagaaggtgcccatgggcttttcttacgacaccagatgttttgattcaaccgtcaccgagcgggatatccggactgagaacgacatctatcagtcttgccagctggatcccgtggcaaggagggtggtatcatctctaacggaacggctctacgtaggcggccccatggcaaactccaagggacaatcatgtggctaccgtagatgccgcgccagtggggtgctgcccaccagcatgggaaacaccctcacatgctatctgaaggcacaggccgcctgcagggcggccaacatcaaggactgtgacatgttggtgtgcggagatgacttggtggtcatttgtgagagtgctggcgtccaggaagacactgcgtcactgcgagcattcacggatgctatgaccaggtactcagctccccctggagacgctccgcaacctacgtatgacctcgagctcataacatcgtgctcgtccaatgtttccgtcgcccacgaaggcaatgggaagaaatattactacctcacacgtgactgtactactccactcgcgcgggccgcctgggagacagcccgccacactccagtcaattcctggttgggcaacatcattatgtttgcccccacgatatgggtgcgtatggttctgatgaaccattttttctccatcctccagtcgcaagaacaattggagaaagcattcgactttgacatctacggagtgacctattccgtttctccacttgatctcccagcaatcattcaacgactccatggtatggcagcattttcactccacggatactctccagttgagctcaatagggtaggggcttgcctcaggaaacttggggtacttccctcgcgagcctggagacatcgagccagagctgtcagagccaaactcattgcccaaggggggaaagcggctatatgcggtaagtacctctttaactgggcagtgaagaccaagctaaaactcactccattggtctccgcgagcaagcttgacttatcaggctggttcgtggcaggctacgacgggggggacatttatcacagcgtgtcccaggcccgaccccgtttcttactccttggcctactcctacttaccgtaggggtaggcatctttttgctccccgctcggtag

SEQ ID NO: 808 - DNA, 9343 bp, Hepatitis C Virus
ttcacgcagaaagcgtctagccatggcgttagtatgagtgtcgaacagcctccaggaccccccctcccgggagagccatagtggtctgcggaaccggtgagtacaccggaattgccgggatgaccgggtcctttcttggataaacccgctcaatgcccggagatttgggcgtgcccccgcgagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaaccaaaagaaacaccaaccgccgcccacaggacgtcaagttcccgggcggtggtcagatcgttggtggagtttacttgttgccgcgcaggggccctaaattgggtgtgcgcgcgactcggaagaattcggaacggtcgcaaccccgtggacggcgccagcctattcccaaggcgcgccgacccacgggccggtcctggggtcaacccgggtacccttggcccctttacgccaatgaaggcctcgggtgggcagggtggttgctctccccccgaagctctcggcctaattggggccccaatgacccccggcggaaatcccccaatttgggtagggtcatccataccctaacgtgcggattcccccacctcatggggtacatcccgctcgtaggcggccccgttgggggcgtctcaagggctctcgcacacggtgtgaaggttcttgaagacgggataaactatgcaacagggaatctacccggttgccctttctctatctttgtccttgcacttctttggtgcctgaccgtccccgcttccgcagttccttaccgtaatgcttctggggtttatcatgtcactaatgattgccccaactcttccatagtctacgaggccgacaacctgatcttacacgcacctggttgtgtgccctgtgtcctggaagataatgtcagtaggtgctgggtccaaatcacccccacgctgtcagccccgagcttcggagcagtcacggcccttcttcggagagccgttgactacttagcaggaggggctgccttctgctccgcgttatacgtcggagacgcgtgtggggcattatccttggtaggccaaatgttcacctataagcctcgccagcatactacggtgcaggactgcaactgttccatttacagtggccatattaccggccaccggatggcatgggacatgatgatgaaatggtcccctacgacggccctgctgatggcccagttgttgcggattccccaggtggtcattgacatcattgccgggggccactggggggtcctgctcgccgccgcatactttgcgtcaacggctaactgggccaaggttatactggtcttgtttctgtttgcaggagttgatggccgcacccatactgtgggcggtactgttggtcaaggtctgaagtcccttaccagtttctttaaccccgggccgcagcggcagttgcagttcgtaaataccaacgggagctggcatatcaatagtactgcccttaactgtaatgacagcctccagaccgggtttatagccggcctcatgtatgcccataaattcaactcttctgggtgtccagaacggatgtctagctgtaggccccttgccgcattcgaccaaggctggggaactatcagctatgccaccatatcgggccccagtgatgacaagccgtattgctggcactatcccccacgaccgtgcggggtggtgccagcccgggatgtctgcggtccagtctactgtttcacacctagcccagtggtcgttggcactactgaccgcagagggtgtcccacttataactggggcagcaacgagactgacatccttctcttgaataacattaggccccccgctggcaactggttcggctgcacctggatgaactccacggggtttgtgaagaattgcggagctccgccctgcaacttagggccaacaggcaacaacagccttaagtgtcctactgattgcttccgcaagcacccagacgccacctacaccagatgtgggtcaggaccctggctcaccccccggtgtttggtgcactacccttaccggttgtggcattacccgtgcaccgtaaattacaccatctttaaggtgcgcatgttcatcggaggcctagagcacaggcttgaagcggcatgcaattggacctatggtgagcggtgtgaccttgaagacagagatagggccgagttgagcccgctcctgcacaccaccacacagtgggccatattgccgtgctccttcacacctacgcccgctcttagcactggtcttatacacctacatcagaatatagtagacacccaatacctctacggcctgagctccagcatcgtctcgtgggccgttaagtgggaatacataatgctggtctttttactacttgctgatgcccgtatctgcacttgcctgttgatcttgctcctaatctgtcaggcagaagcaacctgcaagaacgtcattgtcctaaacgcggctgcggccgcagggaatcatgggttcttctggggcctgctcgttgtgtgcttggcttggcatgtcaagggcaggttggtccctggggccacctacctttgcttgggcgtttggccactactcttagtccgtctcctccggccccacagggccctggccctggactcaagcgatggcgggactgtgggttgtcttgtgctaattgttcttacaatctttacacttacccctgggtacaaaaagaaggtagtgctggtcatgtggtggcttcagtatttcatagcccgagtggaggccatcatccacgtgtgggtgcccccgttgcaggttaagggtggtcgtgacgctgtcatcatgctcacatgcctcttccaccctgccttggggtttgagatcacaaaaatcctcttcgggatactgggccccttgtacctgctgcaacattcactcaccaaggtcccctacttcctcagggcgcgcgccctgctgaggctgtgcctactagcaaagcacctggtttatggcaagtacgtgcaggcggccttgctccaccttggtaggctgaccggaacctacatttatgaccatcttgcccccatgaaggattgggcagcgtctgggctccgcgaattaacggtggccacagaacccatcgtattctccgcgatggagacgaaggtcatcacgtggggggctgacacggccgcgtgtgggaacatacttgctgttcttccggtatcagctagacggggccgcgaaattttcctggggccggccgacgacatcaagacgtcgggttggcgactcctcgcccctatcaccgcgtatgcgcagcagacgcgaggggtactgggcgccatagttctcagcctgaccggccgggacaaaaatgaagccgagggtgaggtgcagttcttatccacggcaacacaaacgtttcttggcatttgtatcaatggagtgatgtggacactcttccatggggccggttctaagacccttgctggccccaaaggcccggtagtgcagatgtacaccaatgtagacaaagacctggtggggtggccttccccccctggaaagggttcgctcacccggtgtacttgcgggtcggcggatctgtacctggttaccaggcatgcagacgtcattcccgcccgtagacggggcgacactcgcgcctccttgctcagcccgagacccatcagttacctcaagggttcctcgggtggcccgatcatgtgcccttccgggcatgtggtaggtgttttcagggccgccgtgtgcacgcggggtgttgcgaaggcgctcgagttcgtcccggtcgaaaacctggagaccacgatgcgctcacctgtgttcactgacaacagtacgccccctgcagtccctcatgagttccaagtggggcacctccatgcacccaccggaagcgggaagagcacaaaggtgcccgccgcttacgcggcccaagggtacaaggtgctggtgctaaacccgtccgtcgcagcaacgttcgggttcggggcatacatgtcaagagcatacggcgtggaccccaacatcaggaccggagttaggactgtcaccaccggagccggtataacatactctacttatggcaagttcttcgccgacggggggtgctcgggcggcgcgtatgacgtaatcatatgcgacgagtgccattcccaggacgctaccaccatccttgggataggcacagtccttgaccaggcagagacggctggagctaggctcgttgtcttggcgacggccattccccccggcagtgtaacgacgccccaccccaacattgaggaggtggccctgccttcggagggggaaatccccttctacggcagagccatcccccttgttcttataaagggcggtaggcatctcatcttctgccactctaagaaaaaatgtgatgaacttgccaaacaattgaccagtctgggcgtgaatgccgtggcatattatagaggtctagacgtcgccgtcatacccgcgacaggagacgtagtcgtgtgcagcactgacgcgctcatgacgggttttaccggcgactttgattctgtcatagactgcaactccgccgtcactcagacggtggacttcagtctggatcccaccttcaccattgagactactacagtgccccaggacgcagtgtccagaagccagcgtaggggccgtacagggagaggtaggcacggcatataccggtatgtttcgtctggggagagaccgtccggcattttcgactctgtggtgctctgtgagtgctacgatgccgggtgtgcatggtatgatctgactcctgctgagactaccgtgaggttgcgtgcttacctgaacacccccgggctccctgtctgtcaagaacatctggaattctgggaaggggtgttcacagggcttactaacatcgacgcccacatgctgtcacaggcaaagcagggtggggaaaacttcccataccttgtggcataccaagcaacagtctgtgttcgtgcgaaggcgcccccccccagctgggatacaatgtggaagtgcatgatctgtctcaaaccgactttaactggccccactcccctcctgtacaggctgggggccgttcagaatgagatcacactgacacaccccatcaccaagtacatcatggcttgcatgtccgcagacttggaggtcattaccagcacttgggtcttggtagggggtgttgtggcggccttagcggcctactgcttgacggtgggctcggtggccatagtcggtagaatcatcctatctgggagacctgcgatcacccctgacagggaggtactataccagcaatttgatgagatggaggagtgctcagcctccttgccctatgtggacgaggcacgtgccatcgccgggcaatttaaggagaaagtgcttggcctcattggcacggctggccagaaagctgaaactctgaaaccggcagctacgtccatgtggagcaaggccgagcagttctgggcaaagcatatgtggaactttgtcagtgggatccaataccttgctggcctttcgaccttgccgggtaatcccgccgtggccacgttgatgtctttcaccgccgcggtgacctcccctcttacaacacatcagaccctcctttttaatattctaggagggtgggtggcctcacagatcgcgccacccacggccgccaccgcgttcgtcgttagtggaatggccggggccgcagtcggtaacatcgggctgggtagggtccttattgacatcctagctgggtatggaacaggggtggctggggcgctcgtcgccttcaagatcatgtgtggggaaaggccgacagccgaagaactggtaaacctcctgccttcaatactctgccctggagccctagtggttggtgtcatatgcgccgccgttctgcggcgccacattggcccaggcgagggggctgtacagtggatgaataggctgattgcgttcgcttcccggggcaatcatgggtctccgacacactacgtgcccgagacggacgcgtcggctaaggtcacgcaactgctcagctccctcacagtaacatctcttctgaagaggctccacacgtggatcggtgaagactattccacgccctgtgatggtacatggcttagggccatttgggactgggtctgcacggcactgacagacttcaaagcctggctgcaggcaaaactcctcccgcaactccccggagtgcccttcttctcatgccagaaggggtacaagggtgtatggcgcggggatggagtgaactccaccaagtgtccttgcggagcgacgatatctggtcacgtgaagaacggaaccatgagaatcgtcggcccgaagctgtgcagtaacacctggcaaggcaccttcccaatcaacgccacaacaacagggcccagcgtacctgccccggcccccaactacaagttcgccttgtggagggtgggcgccgcggactacgcggaggtgcgccgtgtaggggactaccactacataacgggggtgacacaagacaatctgaagtgtccctgccaggtaccatctccagagttcttcacggagctggatggcgtgaggattcaccgcttcgcgccaccctgtaaccccctcctaagggaggaggttactttctccgtggggttgcactcctacgtggtagggtcccaactaccctgtgagccagaacctgatgtgaccgtcttaacatcaatgctgtcagatcccgcccacatcacggcggaaacggccaagcgcaggctaaatcgagggtctccaccctctctggcaaactcctcggccagtcagctctcagccccctctctcaaggccacctgcactatacaaggccaccacccagatgcagacctcataaaggctaatctgctatggagacagtgcatgggaggcaatatcacgcgagtagaggctgagaacaaggtcgagatccttgactgcttcaagccgctcaaagaggaagaagatgacagagagatctccgtgtccgccgactgctttaagaagggaccggcgtttccccccgctctgccagtgtgggcaaggccggggtatgacccgcccctcttggagacttggaagcgaccggattatgacccccctcaggtgtggggctgcccgataccacctgcgggccccccgcctgtcccgcttccgcggaggaaaaggaagccaatggaactatctgattctaccgtgtcccaagtcatggccgacttggcggacgccaggttcaaggtcgacacaccatccattgaaggccaggattctgcgttgggtactagcagccaacacgattcggggcctgaggagaagcgtgatgacaactcggacgcggcttcatattcttccatgcctccgctagagggcgaacctggggaccctgacctttcgtcagggtcatggtcaaccgtcagcggtgaggacaacgtggtgtgttgctccatgtcatacacctggactggggcgctcatcaccccttgctctgctgaagaggaaaaattacccatcaatcccttaagcaacaccttattacgccaccacaatcttgtgtactccacctcctctcggagtgcgggtctgaggcagaaaaaggtcacttttgacaggctacaagtcctcgacgaccactacagagaggttgtggacgagatgaagcgattagcctccaaggttaaggccagactactgcccctagaggaagcctgtgggttaacaccaccccactccgcccgttccaagtacggatacggcgcgaaggaagttcgctctctcgacaagaaagcccttaagcacatagagggtgtgtggcaagacttattggatgactctgataccccattgccgacaaccatcatggcaaaaaacgaagtgttcgcagtggagccgtctaagggggggaagaagcctgcacggctgatagtctaccccgaccttggagtccgcgtctgcgagaagcgggctttgtacgacgtagctcaaaaactgccgacagcccttatggggccctcgtatgggtttcagtactccccagcgcagcgggttgacttcttactgaaggcgtggaaatctaagaagatccccatggctttctcctatgacacccgctgctttgactcgaccattaccgaacatgacataatgactgaagagtccatttaccaatcatgtgacttgcagcctgaggcgcgcgtggcaatacggtcactcacccaacgcctgtactgtggaggcccaatgtataacagcaagggccagcaatgtggttatcgtagatgccgcgccagcggcgtcttcaccactagtatgggcaacaccatgacgtgctacattaaggctttagcctcctgtagagctgcaaagctccgggactgcacgctcctggtatgtggtgacgaccttgtggccatctgcgagagccaggggacacacgaagatgaagcgagcctgagagccttcactgaggctatgaccaggtactccgctcccccgggtgatcccccggttccagcttatgacctggagctcgtaacatcttgctcctcgaacgtgtccgtcgcccgcgatgcttcaggcaacagaatttactatctcacgcgtgacccgcaggtaccacttgcgaaggctgcgtgggaaactgccaaacactccccggttaattcctggctagggaacatcatcatgtacgcgccgaccttgtgggctcggatagtgctgatgacgcactttttcagcgttctacagagccaggaacagctggaaaaaaccctagcatttgaaatgtatgggtcagtttattctgttactccgctggatcttccagctatcattcaaagactccatggacttagcgcgttttcactccattcatactctccgagcgagatcaatagggtggctagttgcctcaggaagcttggggtaccccctttgagagcttggagacatcgggctcgagctgtacgcgctaagctcatcgcccagggaggtagggccgccatctgcggcatctatctcttcaactgggcggtgaagacaaaacgcaaactcactccattagctgacgctgaccggctggacttgtccagctggttcaccgttggcgctggcgggggggacatttatcacagcatgtcccgtgcccgaccccgcaacttactcctgtgcctactcctacttagcgtaggggtaggcatctttttactccccgctcggtgagctgggagctaaacactcc

SEQ ID NO: 809 - protein, 10 aa, Hepatitis B Virus
FLPSDFFPSV

SEQ ID NO: 810 - protein, 9 aa, Hepatitis B Virus
CLTFGRETV

SEQ ID NO: 811 - protein, 10 aa, Hepatitis B Virus
VLEYLVSFGV

SEQ ID NO: 812 - protein, 9 aa, Hepatitis B Virus
EYLVSFGVW

SEQ ID NO: 813 - protein, 10 aa, Hepatitis B Virus
ILSTLPETTV

SEQ ID NO: 814 - protein, 11 aa, Hepatitis B Virus
STLPETTVVRR

SEQ ID NO: 815 - protein, 10 aa, Hepatitis B Virus
AILSKTGDPV

SEQ ID NO: 816 - protein, 9 aa, Hepatitis B Virus
LLDPRVRGL

SEQ ID NO: 817 - protein, 9 aa, Hepatitis B Virus
VLQAGFFLL

SEQ ID NO: 818 - protein, 9 aa, Hepatitis B Virus
FLLTRILTI

SEQ ID NO: 819 - protein, 10 aa, Hepatitis B Virus
SLNFLGGTTV

SEQ ID NO: 820 - protein, 9 aa, Hepatitis B Virus
FLGGTPVCL

SEQ ID NO: 821 - protein, 9 aa, Hepatitis B Virus
LLLCLIFLL

SEQ ID NO: 822 - protein, 9 aa, Hepatitis B Virus
LLCLIFLLV

SEQ ID NO: 823 - protein, 10 aa, Hepatitis B Virus
LLDYQGMLPV

SEQ ID NO: 824 - protein, 10 aa, Hepatitis B Virus
LVLLDYQGML

SEQ ID NO: 825 - protein, 8 aa, Hepatitis B Virus
VLLDYQGM

SEQ ID NO: 826 - protein, 11 aa, Hepatitis B Virus
LLLDYQGMLPV

SEQ ID NO: 827 - protein, 9 aa, Hepatitis B Virus
WLSLLVPFV

SEQ ID NO: 828 - protein, 10 aa, Hepatitis B Virus
LLVPFVQWFV

SEQ ID NO: 829 - protein, 10 aa, Hepatitis B Virus
GLSPTVWLSV

SEQ ID NO: 830 - protein, 10 aa, Hepatitis B Virus
SIVSPFIPLL

SEQ ID NO: 831 - protein, 10 aa, Hepatitis B Virus
LLPIFFCLWV

SEQ ID NO: 832 - protein, 11 aa, Hepatitis B Virus
ILSPFFFLPLL

SEQ ID NO: 833 - protein, 9 aa, Hepatitis B Virus
VLCLRPVGA

SEQ ID NO: 834 - protein, 9 aa, Hepatitis B Virus
TLPSPSSSA

SEQ ID NO: 835 - protein, 9 aa, Hepatitis B Virus
HLSLRGLFV

SEQ ID NO: 836 - protein, 9 aa, Hepatitis B Virus
VLHKRTLGL

SEQ ID NO: 837 - protein, 9 aa, Hepatitis B Virus
AMSTTDLEA

SEQ ID NO: 838 - protein, 9 aa, Hepatitis B Virus
CLFKDWEEL

SEQ ID NO: 839 - protein, 9 aa, Hepatitis B Virus
LYSSTVPVF

SEQ ID NO: 840 - protein, 9 aa, Hepatitis B Virus
GLSRYVARL

SEQ ID NO: 841 - protein, 9 aa, Hepatitis B Virus
YMDDVVLGA

SEQ ID NO: 842 - protein, 9 aa, Hepatitis B Virus
FLLSLGIHL

SEQ ID NO: 843 - protein, 9 aa, Hepatitis B Virus
KYTSFPWLL

SEQ ID NO: 844 - protein, 10 aa, Hepatitis B Virus
ILRGTSFVYV

SEQ ID NO: 845 - protein, 9 aa, Hepatitis B Virus
SLYADSPSV

SEQ ID NO: 846 - protein, 9 aa, Hepatitis C Virus
MSTNPKPQK

SEQ ID NO: 847 - protein, 8 aa, Hepatitis C Virus
STNPKPQK

SEQ ID NO: 848 - protein, 9 aa, Hepatitis C Virus
STNPKPQKK

SEQ ID NO: 849 - protein, 9 aa, Hepatitis C Virus
GQIVGGVYL

SEQ ID NO: 850 - protein, 10 aa, Hepatitis C Virus
YLLPRRGPRL

SEQ ID NO: 851 - protein, 10 aa, Hepatitis C Virus
YLLPTTGPRL

SEQ ID NO: 852 - protein, 10 aa, Hepatitis C Virus
YLLPSRGPKL

SEQ ID NO: 853 - protein, 9 aa, Hepatitis C Virus
LLPRRGPRL

SEQ ID NO: 854 - protein, 9 aa, Hepatitis C Virus
GPRLGVRAT

SEQ ID NO: 855 - protein, 9 aa, Hepatitis C Virus
GPRLGFRAT

SEQ ID NO: 856 - protein, 9 aa, Hepatitis C Virus
RLGVRATRK

SEQ ID NO: 857 - protein, 9 aa, Hepatitis C Virus
KTSERSQPR

SEQ ID NO: 858 - protein, 9 aa, Hepatitis C Virus
NEGLGWAGW

SEQ ID NO: 859 - protein, 9 aa, Hepatitis C Virus
NEGCGWAGW

SEQ ID NO: 860 - protein, 9 aa, Hepatitis C Virus
NEGCGWMGW

SEQ ID NO: 861 - protein, 9 aa, Hepatitis C Virus
GLGWVGWLL

SEQ ID NO: 862 - protein, 10 aa, Hepatitis C Virus
ADLMGYIPLV

SEQ ID NO: 863 - protein, 9 aa, Hepatitis C Virus
DPRRRSRNL

SEQ ID NO: 864 - protein, 10 aa, Hepatitis C Virus
ADLMGYIPLV

SEQ ID NO: 865 - protein, 9 aa, Hepatitis C Virus
DLMGYIPLV

SEQ ID NO: 866 - protein, 9 aa, Hepatitis C Virus
ALMGYIPLV

SEQ ID NO: 867 - protein, 9 aa, Hepatitis C Virus
DLMGYIPAV

SEQ ID NO: 868 - protein, 10 aa, Hepatitis C Virus
RVLEDGVNYA

SEQ ID NO: 869 - protein, 9 aa, Hepatitis C Virus
LPGCSFSIF

SEQ ID NO: 870 - protein, 9 aa, Hepatitis C Virus
FLLALLSCL

SEQ ID NO: 871 - protein, 10 aa, Hepatitis C Virus
LLALLSCLTV

SEQ ID NO: 872 - protein, 10 aa, Hepatitis C Virus
LLALLSCLTI

SEQ ID NO: 873 - protein, 8 aa, Hepatitis C Virus
CPNSSIVY

SEQ ID NO: 874 - protein, 8 aa, Hepatitis C Virus
ILHTPGCV

SEQ ID NO: 875 - protein, 9 aa, Hepatitis C Virus
NASRCWVAM

SEQ ID NO: 876 - protein, 9 aa, Hepatitis C Virus
NASRCWVAM

SEQ ID NO: 877 - protein, 10 aa, Hepatitis C Virus
QLRRHIDLLV

SEQ ID NO: 878 - protein, 10 aa, Hepatitis C Virus
AIRRHVDLLV

SEQ ID NO: 879 - protein, 9 aa, Hepatitis C Virus
QLRRIDLLV

SEQ ID NO: 880 - protein, 10 aa, Hepatitis C Virus
VFLVSQLFTF

SEQ ID NO: 881 - protein, 9 aa, Hepatitis C Virus
FLVSQLFTF

SEQ ID NO: 882 - protein, 9 aa, Hepatitis C Virus
QLFTFSPRR

SEQ ID NO: 883 - protein, 9 aa, Hepatitis C Virus
MMMNWSPTT

SEQ ID NO: 884 - protein, 9 aa, Hepatitis C Virus
LVMAQLLRI

SEQ ID NO: 885 - protein, 9 aa, Hepatitis C Virus
SMVGNWAKV

SEQ ID NO: 886 - protein, 10 aa, Hepatitis C Virus
SMVGNWAKVL

SEQ ID NO: 887 - protein, 10 aa, Hepatitis C Virus
SLASLFTQGA

SEQ ID NO: 888 - protein, 11 aa, Hepatitis C Virus
SLLAPGAKQNV

SEQ ID NO: 889 - protein, 11 aa, Hepatitis C Virus
CRPLTDFDQGW

SEQ ID NO: 890 - protein, 10 aa, Hepatitis C Virus
RPLTDFDQGW

SEQ ID NO: 891 - protein, 8 aa, Hepatitis C Virus
YPPKPCGI

SEQ ID NO: 892 - protein, 11 aa, Hepatitis C Virus
VPASQVCGPVY

SEQ ID NO: 893 - protein, 10 aa, Hepatitis C Virus
GENDTDVFVL

SEQ ID NO: 894 - protein, 10 aa, Hepatitis C Virus
NTRPPLGNWF

SEQ ID NO: 895 - protein, 10 aa, Hepatitis C Virus
CVIGGAGNNT

SEQ ID NO: 896 - protein, 9 aa, Hepatitis C Virus
DYPYRLWHY

SEQ ID NO: 897 - protein, 10 aa, Hepatitis C Virus
YRLWHYPCTI

SEQ ID NO: 898 - protein, 9 aa, Hepatitis C Virus
RLWHYPCTV

SEQ ID NO: 899 - protein, 8 aa, Hepatitis C Virus
TINYTIFK

SEQ ID NO: 900 - protein, 10 aa, Hepatitis C Virus
RMYVGGVEHR

SEQ ID NO: 901 - protein, 9 aa, Hepatitis C Virus
LEDRDRSEL

SEQ ID NO: 902 - protein, 9 aa, Hepatitis C Virus
ALSTGLIHL

SEQ ID NO: 903 - protein, 9 aa, Hepatitis C Virus
EYVLLLFLL

SEQ ID NO: 904 - protein, 9 aa, Hepatitis C Virus
LLFLLLADA

SEQ ID NO: 905 - protein, 9 aa, Hepatitis C Virus
FLLLADARV

SEQ ID NO: 906 - protein, 8 aa, Hepatitis C Virus
FYGMWPLL

SEQ ID NO: 907 - protein, 9 aa, Hepatitis C Virus
FYGMWPLLL

SEQ ID NO: 908 - protein, 9 aa, Hepatitis C Virus
LYGVWPLLL

SEQ ID NO: 909 - protein, 8 aa, Hepatitis C Virus
MALTLSPY

SEQ ID NO: 910 - protein, 10 aa, Hepatitis C Virus
LSPYYKRYIS

SEQ ID NO: 911 - protein, 11 aa, Hepatitis C Virus
LSPYYKRYISW

SEQ ID NO: 912 - protein, 8 aa, Hepatitis C Virus
YISWCLWW

SEQ ID NO: 913 - protein, 9 aa, Hepatitis C Virus
YISWCLWWL

SEQ ID NO: 914 - protein, 10 aa, Hepatitis C Virus
PYFVRAQGLI

SEQ ID NO: 915 - protein, 10 aa, Hepatitis C Virus
TYVYDHLTPL

SEQ ID NO: 916 - protein, 8 aa, Hepatitis C Virus
RDWAHNGL

SEQ ID NO: 917 - protein, 9 aa, Hepatitis C Virus
AYSQQTRGL

SEQ ID NO: 918 - protein, 10 aa, Hepatitis C Virus
GLLGCIITSL

SEQ ID NO: 919 - protein, 9 aa, Hepatitis C Virus
CINGVCWTV

SEQ ID NO: 920 - protein, 9 aa, Hepatitis C Virus
CVNGVCWTV

SEQ ID NO: 921 - protein, 9 aa, Hepatitis C Virus
CVVGVCWTA

SEQ ID NO: 922 - protein, 9 aa, Hepatitis C Virus
SVNGVCWTV

SEQ ID NO: 923 - protein, 8 aa, Hepatitis C Virus
MYTNVDQD

SEQ ID NO: 924 - protein, 9 aa, Hepatitis C Virus
YLVTRHADV

SEQ ID NO: 925 - protein, 9 aa, Hepatitis C Virus
LLCPAGHAV

SEQ ID NO: 926 - protein, 9 aa, Hepatitis C Virus
LLCPSGHVV

SEQ ID NO: 927 - protein, 9 aa, Hepatitis C Virus
HAVGLFRAA

SEQ ID NO: 928 - protein, 10 aa, Hepatitis C Virus
AYAAQGYKVL

SEQ ID NO: 929 - protein, 10 aa, Hepatitis C Virus
TLGFGAYMSK

SEQ ID NO: 930 - protein, 9 aa, Hepatitis C Virus
LGFGAYMSK

SEQ ID NO: 931 - protein, 10 aa, Hepatitis C Virus
GAYMSKAHGV

SEQ ID NO: 932 - protein, 10 aa, Hepatitis C Virus
TGSPITYSTY

SEQ ID NO: 933 - protein, 10 aa, Hepatitis C Virus
TGAPVTYSTY

SEQ ID NO: 934 - protein, 9 aa, Hepatitis C Virus
TYSTYGKFL

SEQ ID NO: 935 - protein, 9 aa, Hepatitis C Virus
HPNIEEVAL

SEQ ID NO: 936 - protein, 11 aa, Hepatitis C Virus
FYGKAIPIEAI

(The sequence listing continues in the following parts.)

What is claimed is:

1. An immunogenic composition comprising a nucleic acid molecule that comprises a nucleotide sequence encoding a heterologous chimeric hepatitis viral antigen comprising hepatitis C virus (HCV) NS3/4A antigen fused to a hepatitis B virus (HBV) core antigen in the absence of an additional HCV or HBV antigen, wherein the nucleotide sequence is modified to encode an amino acid sequence that comprises one or more HCV NS3 protease cleavage site insertions at one or more non-naturally occurring positions and said immunogenic composition induces an effective cytotoxic T cell (CTL) immune response specific for one or more epitopes of said heterologous viral antigen.

2. The immunogenic composition of claim 1, wherein said one or more non-natural positions are located between NS3/4A and HBV core antigen.

3. The immunogenic composition of claim 1, wherein said one or more non-natural positions are located within HBV core antigen.

4. The immunogenic composition of claim 1, wherein said heterologous chimeric hepatitis viral antigen is encoded by the nucleotide sequence set forth in SEQ ID NO. 1182.

5. An immunogenic composition comprising:
   a DNA plasmid suitable for mammalian expression, wherein said plasmid comprises a promoter, which is functional in mammalian cells, operably linked to a nucleic acid sequence that encodes a heterologous chimeric hepatitis viral antigen comprising an (HCV) NS3/4A antigen fused to a hepatitis B virus (HBV) core antigen in the absence of an additional HCV or HBV antigen, wherein said nucleotide sequence is modified to encode an amino acid sequence that comprises one or more NS3 protease cleavage site insertions at one or more non-naturally occurring positions and wherein said DNA plasmid induces an effective cytotoxic T cell (CTL) immune response specific for one or more epitopes of said heterologous viral antigen.

6. The immunogenic composition of claim 5, wherein said one or more non-natural positions are located between NS3/4A and HBV core antigen.

7. The immunogenic composition of claim 5, wherein said one or more non-natural positions are located within HBV core antigen.

8. The immunogenic composition of claim 5, wherein said heterlogous chimeric hepatitis viral antigen is encoded by the nucleotide sequence set forth in SEQ ID NO. 1182.

* * * * *